United States Patent 7,365,185 (GENOMIC PLANT SEQUENCES AND USES THEREOF) - sequence listing, part 23

SEQ ID NO: 56745 - DNA, 1501 bp, Oryza sativa
tggcttttttaagccataagccactctaacactattaaggccttctttgtttaggcttataagccaacttctaagtcgaaaagtctaagcctaaacaaacaagcagcttttccgtttggcttttttgaagccataagccactctaacactattaagccaaaagctaggttgaagaagcttttttggcttatgtgaggtagatgtatgactcaactactaaacttaggacattaaatccaccggcttataaatcatttaagccaataagctgacttaaaagtctagcccaataagcctaagcctaaacaaagagggcctaagccaaaaactaggttggagaagcttttttagcttatatgagatagatgtatgactccaccactaaacttaggacattaaattcactggcttataaatcatataagccaataagctgacttaaaagtctaggccaataagcctaagcctaaacaaagagggccttaagctatcattaagcttattagctagcgctgtttacgagctctagtttattcggtggcagatctagaaatttttacaagcctgggcaaacctaataatagagaactacaattaaatccatacaaccacgtgcatgatttagtatagatcgagttctaatttataaagaagacaaccaatgcacgaaattatattgatgaaataaaactcgttaattgttaatgttgaatactagacattataattaattatatgtatatagctagtcattttgctagtatatgtgctgatccactgatctcatccattagaactagttgattaagcatgtaatttgctactagtagtattttactcaattgtatgtggctgaacacctgaacttgtatctaagcatggtaattaacataaactaataactactcactactataaaatatcaaataggtgtcggtactatagatgccggaagtgctaaaaccggtacctataggtcttttaccacctcagcggtccgaaaacacaaaaaaccggcacttttaagtaattataggtgtcggttctataaagaaaaccaacacctttaattaaagaaccgacacctataataattaaatgtgccggttttttttaaaaaaacgacacctttggaattgagccgagccggaccggatgagatatttcttctcccggcggggctcacacccggtggagataaggtcgatttttctcgacttctcgtctctcgctctcgaggcgccctcccctgcgctagatccgacagggccgggaggggaggcgcggtggcggctgacggcatgaaggggaggcgatggtggcccggcaggggcaggaggggcggagacgccctcccctccgccagatccagcaggggcgggaggggaggcgcagtggcggtggacgacatggaggggtggcggtggcggcccaatggtggaggggaggcggtggtggcccggcgacggtggatcctcggggcaacggcggcggtggcgcc

SEQ ID NO: 56746 - DNA, 1501 bp, Oryza sativa
ccactcctttcctttgatccttttccatctccaagaggaccaaaactgcaaaaaaaaacacacgagcagagcaggaagcaacttgaaactgcaagctttcctcttctttcttctttctcaacaaacccaaacccagttgcagctggcaggcagctgcgctcttctttttctcctcattgttttcctcgcgtggtctcccgattcgtgcgccgtgtgcatcgccattagtagtcgctgtcacgatcgaggatcaccacctctctccagctccaaatccacctccccccccccccccaccaccaccaccaccaccacgcggtcgccgcgccgagctgtcctcccccacgccgagatttgattcttccttcttcttgttcttgcgccaccgcggattcttgtaccagctgacactaccggggcggtggctgtgctccttggattgttggattggttggtttgggaaaggttaggcgccctcctttcgcttgggtacgcgtctctctgtttttcggttcttggtttgtttggttcgagaggcttgtagtctcgcggatttgtttttcgttgcagagattattaggagttaatctgttcttcttggaaggaggttcagtgattgaggatttgatccaactgtgagaaaaatcttggcccttttggatctgggagcggtgcaaagctactggagcgcctcacatgtccacaagtgctcgattttagcagtttcatgggttatgttcttggattcagtagatttctgatgcagacagtaattttttaccgaacaagtaatcggtgaatttacagttttttctttctttctttattacgagaggacgaagctctagttcactgtaccttgtttattatcgcttcctcctcgtgtaaaggatcaatttttacgatagcgatcgtgagtggtttagctccccctctctctctcttgccgctgggtgccttgctggtcccgttgctttcagatgctgctttatttgtctccttttgcccaatttgcgtgtacccttgtgcccttatctcctatggttgcttccactgtcaccaaagggggactcgccatctaccttgttcctcagttcatgcgaatttcatgcggtcctgggctgtgactgggagtagattgaggtcaatatgctgtcaaaggcatttcttttcttttccttttcgttgcttgttttccccttctgatgttgtgtgttgagtttattgtttggtttgctggtagatccagtatttggatcatttttccttttttttttctttcattgcttctgcggagggatgagtttgtgcatgaatcttttgttggttggattcgcttagttttcacactagtcctttgattcagcgcaaatctttgttaattggctcgcttaattctgacataaagtgttccttcttgggttctgcttgcagggttgatctcgtttgcggagtaacaaatttgcaagcctacaactgctagggagaatttgactaaaaa

SEQ ID NO: 56747 - DNA, 1501 bp, Oryza sativa
acatgacatacccgatcatagacatcctctcctggaacgtccgaggtttgaatagaccggccagaagagcgacaatgagagagactcttcaagaagccaaaccccatatcgcttgccttcaagaaacaaaaatgagtaacattgatgccagactggtacattcccttggcgggggacgcctaaaatcttttcaattcaagccagcgacaggaccgctaggaacaagaggtggcatcctgatcctctggaatgaggattttgctgagctcaaagactttgtgcaaggaacattctcgctttcggccacagtctccttaaaagaatgtcagaccaccttcctacttacggctgtttatgggccaaccagagagagtgccaagcaaacattcctgagagaaccgcggaacaccaagccatctgacaattcaaaatggctggtgctcggagacttcaacataatctacaaggcttccgacaaaaacaatgcaaacctcaatcgcagacaaatgcgaattttcaaagaaaccctcaacgcttgcgagctcaaggaggttgcacttcagaataggcgatacacctggagtaatgaacaagacaacccaaccctcgtcaaactggacccgtttttttgcaacgctagctgggacacaacattcgagagacatctattacatgccctatccaccttactctcagaccactgtccgctaatgctaaccggacaaggggaggccccacgatcgagaacttttcggttcgagaacttttggatccagctcccaggcttccacgaggcggtacaagaagcctggacagccccccaaccccatcatgaacctcaccatagaatctttcacaaattgggatgtacggccaaaagactaagatcgtggagcaaaaaattgatttcgcaggggaagcttcatttacacttggcgctcgagattattcttcaatttgatatataccaagagtcaaggcaactcactcaagccgaactcacgctaagaaggaaccttaaagacagagtgttgggtcttgcagtggtggaaagagcccgtagaacacaagctacacgaatcaccaatctcaaagagggggatgcaaatacgaagttctttcatttgaggatgaatgcaagaaagagaaaaaacttcattcagaggctacgagtgggaaacatgtggaaagtaaaacacgatgaaaaagctgctgttataaaagagcactttcagaccttcatggcacacccagctccacgctcaaaagatcttgactgggacgccctgcagttaccgactttcgacagctccgtaattagtggccccatcacggaagaggaggttcacgtggcacttaaacagtctcccagcgacaaagcgcctggtccggacggcttcacaggtgctttctataaagcctgttgggaaacgataaaagatgacatcatggcggtcattcattccttcgaccggctacgaagtaataacttctcgatcct

SEQ ID NO: 56748 - DNA, 1501 bp, Oryza sativa
caaaaaattgatttcgcaggggaagcttcatttacacttggcgctcgagattattcttcaatttgatatataccaagagtcaaggcaactcactcaagccgaactcacgctaagaaggaaccttaaagacagagtgttgggtcttgcagtggtggaaagagcccgtagaacacaagctacacgaatcaccaatctcaaagagggggatgcaaatacgaagttctttcatttgaggatgaatgcaagaaagagaaaaaacttcattcagaggctacgagtgggaaacatgtggaaagtaaaacacgatgaaaaagctgctgttataaaagagcactttcagaccttcatggcacacccagctccacgctcaaaagatcttgactgggacgccctgcagttaccgactttcgacagctccgtaattagtggccccatcacggaagaggaggttcacgtggcacttaaacagtctcccagcgacaaagcgcctggtccggacggcttcacaggtgctttctataaagcctgttgggaaacgataaaagatgacatcatggcggtcattcattccttcgaccggctacgaagtaataacttctcgatcctcaattcagcaaatgtggtgctcatcccgaaaaaggagggagctgaatgcgtaggagactacaggctgatcagtctcatacacggagttgggaagctaatttcaaaggtacttgcactgcgcttgcagcctcacatggggatcttgattagtcatgcccagagtgctttcataaagaaaatatgcacacatgacaactttatgtatgtgaggaatctgacaagaaaattccaccaaacgagaacgccgaatcttctgttgaagctcgacataaccaaagcttttgattcggttagatgggattacttaatcgacctcctccagagaaaaggcttcacatctcggtggactaactgggtctcaaacatcctagcctcatcgacaacaagggtcctcctcaatggatgcccaggatcacctataaagcatggaagaggcctctggcagggtgaccccctctcgccgctgctagttattttagccatcgacccactccaccaccttctagagaaagcaacagaattaggacacatgtcccctcttcgcggaagagctcccagatttcgaaccttcctctatgcagatgatgtggccatattcgtgaacccaagtgtccaagacatgacaaatctcactggcattctaagtgattttgggcaagtgacgggcctccgaacaaacctcaacaaaagccaaattgcgcctatccggtgtgatagcattgatctctccagcatcattgggatcttcccaacaggcctaacaaacttcccaatgaaataccttggcctacccctcgtggttggaaggctcaagaaggtccacattcagcccttaatggacaagtgcaaagcgcgtctcgctccttggcaaggcaaaatgatgtcgaccgccgct

SEQ ID NO: 56749 - DNA, 1501 bp, Oryza sativa
cagctcataccctgggtacacgacctcatcaactttgatcttcaagtagcgcccatcaagtgtcttaagatttatggtacactttgcaagtgcatccacaagacgaagaacccaatgaactaccaggtcatttccatagaggatgtaggtctcatgaggtgcgatgtcaagggtcaaaattaaatcatggggcggctggccgtaaaaatgggacccttcataaggaagtgttatttttgttcctttccttgatccaggcagcactttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctg

SEQ ID NO: 56750 - DNA, 345 bp, Oryza sativa
ttcctgcagcccccaaaaaataaaacgattattttatttttgtgtaaagagaagggaaaaaaaaaacgcgcgaaggagaaggagacgagctgcttcttcgtctccaacttcccttatctctatcaacccccattcctccattactctccctctctacatatacccttccccacccacctcccaccctcccctctccaaccacaccactctccaaatccatccatcgatcgagaattcctcttctccctcttcttgttcttcttctcctctctgaatttaacaagaaatcaagaactaggtgtttgttttgactaacaagaactcggtcgaacactctgcgtgcgt

SEQ ID NO: 56751 - DNA, 192 bp, Oryza sativa
gaagagtagagctacttctcgctgcacattaattctaggcgtgggcggaccgcatgcagcagagctagctcgatcggcaacagctgcaccccatgcaagcggtcgatctgtatgacgacaaaaatatacaaattaatcgatcagatagcagctgaggcgttgattaaacagctgatgatcgatctgttagga

SEQ ID NO: 56752 - DNA, 227 bp, Oryza sativa
acgctcaagaggaagggaacataggggagaggaggggctccagggagtagaggggccatgggaaagcgggagcgagtgcaatgagagggagggaggcaggagagaaggggtgccaaggagaagaggggctgtgggagagggggagcgcgtgcagcgaggaagagatttggggggggggagaaggaagggaggcaagagaggaggggcgccaaggagaacaggagcca

SEQ ID NO: 56753 - DNA, 213 bp, Oryza sativa
ttcctgcagcccgccgcgtatcttgaggcttggatgatctcgatagaccaagttgtcgatgacgatgatggttccgatctggtcggaagatgtacttcagttgggttagatctccgcacagccgaagtcatcgagtagcttgttgtcggagagtccatatcttaaacgcatctcgtcgaaatcctgaagcaccaaaatccccctacctgtcgc

SEQ ID NO: 56754 - DNA, 1501 bp, Oryza sativa
taaatgcaggcttcaaggaatggctattgttttttcaattgattttatttaaactcttttctgaaacaactaagtgagtgcttctcaaacaacacggatgagacagtgcgtctcgtccggtcggagtatgtgcaaggtatcagtcttttgaattgatcaaggttggcattcggccaacagctttcaaacggccacccgggcctggctgatcccatcagccgcagattttccaaacatcgaacccaaaccacatcagcaaattttacaaagcagtagtcaaacaaaactacgctaggaatcacctcacatccgcccatgaccgtgggcatggctattcgaacagtttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccctgacaccaccccgttgaatccacatgtctcttggcatcatggttcccccgattagctagttactcagccaggggtgtcccattccacccatgtggtcgcacttgtcttatgttcggatgaaattccaaggaaacggtccttaagtgcaagagcgggagactgtacacccggtacgttccccggtccgcgattttggaaattcatttagttcgcaagcaccgacccaggtgtcgggttttccaagtcttttgtaaaacccgagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccacctgtctgccttgcagacggggcaaacagattaagtgcaatcctatcaatgcataatattttgcaagcaatataattaagttcaaatataggctcaatatgttcaaaggtggcttgccttgctcgagatcttgagcttgatcctcgaaatcctcgcactgcggatcttcgggctccgaaactacacgcgaaacgggacaactcagcaaacggcgaaaataaggccctattattgacctctaagcgtgtcattaggtagatctcaagatttgaggaattttggaagttgaacggagtcaaacggacttacggttaggaagatattgaatttctaagattattggatttttggtctaaaggaaaaaggatttatttaaatcctttttgaaaagaaaagaagagaaaagaaggagggaggggaattagacttccctcgggcggctagggcgcggcccgagagaaagggggcggctcggccgaacttaacgggccggtcggcctgagaaggcggcccaaggca

SEQ ID NO: 56755 - DNA, 1501 bp, Oryza sativa
gtaatcagagtgcagctggattgtgattctgatccgaacacttggatcaacatgcatcatgcatgcatatattggcctcgatcttccattcataatcaatgagaaattacagttcacacagattgcatgttcttcttctcatgccaagaaatcatcctatctatgagaatttacaagatcacattgccttccatgcaaaccaagacatgttctgattcctacaaacttctgcagctactgctactactgaagaacactgatcacggtgccaacaaggcctcggatttggcccgcagctgctccttctccagcacaaacatcttcagccgcggcagcgacttgacggccgtggtcggccgcggggccgccatgtttgccggggtcagggtcggggccgggcgcggcgcgggcagcttgacgtccttgacggcgacgcgcacggtccggaaggggtcgtcgcgcgggaagttgccgttgtagatgacctcgaggtggccgtcgtcggcatcagcgtcggagacgacgaccgcgccgagccacatgacgaggcgcagcgtcgtggtccctagcctcccaaccggcgtgcggatgcgcacctcgtcgcccttcttgaaggacacgggcgccggcgacggcgcggatgacatcttcttgacgggcgaccctcctgacgccttattggagactactctccccttggcctcgacggcgagctcactgcggcggtggctgatcgggcgcgaggagcggggactcgagtggtggggaagcgccatggacgaacgagcgctgctgcgaggatgggtggaaggaattgtggggaatgcgtagacggagagtggcggcgggcttggatttatcggcagccgagtccgagtccgagtccgagttgaaatcggtgatggtagcaagtcggagacggagttggagttgaagtcggtgattagcttgctgtgattaatggctaatcctcgtgaattcttctctatatgcgcggcattgctgaatccgagcccgattagaaatcgcagattcgcgcgcgaagcctaagccgaactggtggaggtgtcgccggaggggctgggcgacgacttacggcggctcagtttgcaccttctccttatgcaatacggagaccaatcggagaaaagcagaacgagagatcgacgatgggcatatgtgtccggcgtcagtcgggaatgaagctcgctgaggaagctctggacgccggcggcgtcgttcttctccgatgatcctgtgaactgctgcccgtcaaagttgctaacttgcagctaatagacgacacgacactgtttcagttgtgcacggtgaagcagcatcacaggtttgcttgctcgaggaaagtgaagcaaacagaaaagaaaaggaaaggaaaaaaaggaagtgtcgtcaacaccaaaatcacacaagaaaaggaagaaactgcatacggcgatatccctcctaatctagaaaggcaagtagaggagattgcaagata

SEQ ID NO: 56756 - DNA, 1501 bp, Oryza sativa
tctcccaatattccttattttttaattctgaattttaactattttaaattgtatttctatatggattctgttttctttttctccaattaatgtaggaatttctaggccatgagagtgaatatggaggctcttttttctattcctttaataagttaatagatttgggtacctgatacctggtaagagctacacaatacccaatatcagatcaggtacctataggtatcaacccgatctagggaccaagtacctaataccttaggtacccgatacctagtaccaggtctggtacctactggtatctgaccgatgtagatactaagtacatggtatttaggtacctgatacctagtaccaggtctggtacttatggataccatcctgatctagggaccaagtaccccgatacctatactatcaggtctagtacctatggtactaactcgaataatctaggtaccagttacctaatatctaggtatcaaggactcgatacatagacattaaatacactgcacgtatcatgtatgatttgtgggtataaggtcttcgagccaacgagagccatgaggaatactatacatatgcccaagctcttaactctagtgcataaaaagacatactagaagagtgttagagcaagtttaatagtatagccaaatattagctccaaatcatctatagctaatctaataactcattcatgcaatagttacctataaaaatatactacaccattaatacactgtcctacctcttatacacacacaacggcttggggtccgtgttgcagctgcctacaaatctgtaacccgctttcttttctctcttctcttttcttctcgatatgtggttatagctggcttatagcctgctattgtacttgctcttagagcaggtctctagtgtgaactttggatgcataaaaaggtgtaccaatgaaaagccagtactacttagaaaagtgtggtatacagcggtactaaaaaaactatgtcggtgacatgggaccgggagtatcatgacttatagacttgaggcagacacgatcacccacgtggcctaaccccctcggggggggtcgggcccgagggtgatgcggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgtagcgcgctcgtttatccggtcagtgaccagtcacagaccggtcagatcgtgggttaggtggcgacaggcggtctgacgcatgcctcgccccatcccgtcaggacgagagcctccaagcactcgtccctagccggagccggcgtgttagctcctggagatggcacgttggttccagtcagatatatgccaggcttcatcctaaccattacaggcaaga

SEQ ID NO: 56757 - DNA, 1501 bp, Oryza sativa
catataaaaaactttcacaaaaaatgcaccgcttagtagtttgaaaagtgtgcgcgtggaaaatgagagaagtgagttgggaaagaggggaaaagaatactgtttgtcttcgaaacaaatgctattcttttaagactactatcatccaaacttataatctatatttaataccatagataagctcaaatgaaaagtgtagatcgcatctatatctacaacttgtatataggttttgttttcatgtttagaaattttaaatatacggaaacggcgctcgatcgatcgggaatttccgtgaccgttttcacccctaattgggatgaagctaccaagacaactgggacaaaacatagatcaaactgattctcaaatatatttggatcacatacgaatttacatgttgatccttctgtgaaaataacttatgtgcctctgagtttattcatcaatctatcccattataatcagaacctatcatgtcaaaatatttttttaattaatgtaaacaatatttagtcctccaaaacgaacatcatgacttttaaagctatccttataagattaagttggtaaaagacatgatttatgagcgatttcacccgttacaacgcatagatattttgctagtattttaaaaaacaagaggaccaaatactcttgccgtcaaaaaaaagactaagcctagctatgtctaggttcttttgggattcgttgatgttcttgagagccaaagtgagggaaatacatatggcccttgccttcctttcagaaaagaaaaatggcacagagactagcacaaaccactatccaattcagaatagaaatgacattaccagctagatgccttgtttgctgcataccctggttctcaacaaaggaaaggaaagccaaaggcgtgcaaagaattggaagctgaatcctagctacaagatcaaagttgtcagcaggtggattgtaatcatacgtgtaatcagagggcagctggattgtgattctgatctgaacacttggatcaacaaaaccaaggataacacgcatcatgcatgcatatattggtaaaaaaatgaaacaagaagagaaacctcgatctttcattcataatcaatgtgaaattacagttgacagattgcatgtccttcttctcatgccaagaaatcatcctatctacgagaatttacattttacaagatcacattgccttccatgcaaaccaagaacagaggaagaaatgttctgattcatacgagcttctgcacctactgctactactgaagaacactgatcacgatgccaacaaggcctcggggttggcccgcagcagctccttctccagcataaacatcttcagccgcggcagcgacttgccggccttgttcggccgcggggccgccatgtttgccggggtcggggccgggcgccgcgccggcagcttgacgtccttgacggcgacgcgcacggtctggaaggggtcgtcgcgcgggaagttgccgttgtagatgac

SEQ ID NO: 56758 - DNA, 1501 bp, Oryza sativa
ccgcgccgagccacatgacgaggcgcagcgccgtggtgcctagcctccccaccggcgtgcggacgcgcacctcgtcgcccttcttgaaggacacgggcgtcgccgtcgacggcgcggatgacatcttcttgacgggcgaccctgctgatggcttcttggagactactctccccttggcgtcgacggcgcggtggatgatcgggcgcgaggagcggggactcgagcgacggggaagcgccatggacgacgagctagcgctgctgcgaggatgggtggaaggaattgtggtgaatgcggagacggtgaggggcggcgcgctaggatttatcggcagccgaagcggagtccgagttgaaatcggtgaaggaagcaagtcggagacggagttcgagttgaagtcggtgcttagaggctgtgattaacggttaatccttctgaatccgattctgctctacgcggcattgatcaatcgagaccgatacgaaatctgagatcgctactacgggaacgcgaactgatggaggtatcgccgcctcgccggagggcaaagagacgacggcggctcggtttgcaccagcacaccgcctccataagaaataccaatccgataaatggaacgagatattaacggagggacatgtattccttgcttccgtgcactaatgtgccggttctaaaagtttatatcatatataggttccggcaccaattaccgtcggttcttgaaccagtattataggtgtaggggtgcacccgttttttatttttgcaggtgctaaaaaaatcaaaaaaaaatatttgatgtattttttaggcatctataccattatactcttccccacaaatcagatgatacatgtgcccatattcatatacacactctttcccacaaatcagatgataaatgtgcccatattcatatacacgtgctaagcaaaattcatactctcgttcccacaaatcacatgatacatgtgcccatattcatatacacgtactaagaaaaattcaaactcaagactttttgcttcaaacaaagtcaccttacatctcacctacaaacactttcggaagcatggttaccaaccttgcctcccgacacagaaaacaaagcacgcgattatagtgagattaattaagtatctatctattatatactaaaagtccattaaactttctacaaacgctttcaagccgtcacatggcgctcctacaaatgctcctaggccgccatatggcacaatataatttcactgtcgattttcacttaaattgtggacccattattttacattgttagattagatctttatctgtcattgattttcacttaaattggtggacccattattttataccaatgaattagatctacctttctcccgtacgtatgtatggtttgccggaaggatgattagtatctatggttgttagaagttgagattaattagctgtcatattgtattactactaatcatagctatatttattatatgcacgg

SEQ ID NO: 56759 - DNA, 1000 bp, Oryza sativa
ttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttgacctgcactggagttaagcagatctcctaggccgccgtgt

SEQ ID NO: 56760 - DNA, 303 bp, Oryza sativa
aaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactaaaattgcacacaatagctcatc

SEQ ID NO: 56761 - DNA, 296 bp, Oryza sativa
aattcctgcagcccatgaacttagtgagaatatagacatctattatatatcaaattccaatatagagtgcataggattacaagcatttgcaccaaattggtatagggatattaagtctaaaaaggatatagaaaaaattgttcaaagattagaggatattcaaattataggagaaattcctatgaaatattgggagaaaaacgctatcgagtgtaaaattaatatattaaacccagaatatattattaagaccagcccaatagaagcaactccgaaagatatagaagaatttaaga

SEQ ID NO: 56762 - DNA, 1501 bp, Oryza sativa; identical to SEQ ID NO: 56504

SEQ ID NO: 56763 - DNA, 1501 bp, Oryza sativa
tggcagggacgctctagatcttctcctgatgacggttgcagggtatttcagacatttcacagcagttacaaccgtcatacctgcctatttaaggacttcaccttctcatttcactcacacatctcaagcaaagctctctcatattctctcaagtttagtttagtgttctgaagctagtggagtaggaatagagtagaaatcggagtccggaagccttcggaagagttcaggtatggctctagtagatctcctcttctcttttgtaagctttttgcttttattagaatactcttctttatacatttatggtattgaaatactttccaagtatatgaatgccaactttgcattatgttcatgttatactgattatactgctagcttatctgggagatgcatcagtacgggtatagcgtttgcttatgcaattactctatgtcatgacgatgatattagagtagtatctggtagtttaggcgtagtgtctagattacgggatatcattatttggattatatgctgcggatgagaagtgggccgctgatggtgacagctcagcacgggtattcctccgcgcgtgtatatagtcctaagttaatttcctggggagggtactccttcgtatttagccctggttgtatggtcatgacgggctgccgtgaggaactcggcagtcaggggtggcttctcgaagtaccaagagggcatcggatagagagtattagctagttaatcttataactagaatgtatgtatactatgtatactagaagtataggaatagattctctttctattttctttccacttagcttagatattttagtatgagaatgagtagctccctccttgtgtgtcactctacccttggattatcttaacctctgcttagactctgattatttcaagtaacatataaattattagtccggttctctctactatgatcttcccacgggattaaataaatacaatactgtcagggttttggataccacatacctaatagtagttcactaaatctcagcaggacccaccacataccatgtcttatacagaaacaatcttcggatataggaggagttccgcataaggaaggatgaatatagttctacatagaaacgacaaggactactcggattgtatccatattggtttccctagttctatttggacaatgggacacctatgggtataaatacaaggccccctatgaggaaaggggagaggggaacgatagatcaatatacaagccaacatacgccaagacaagacgccggatatctatgttagagatttgtctaggaggaccctcgtatggtacttacgactaccgtcaggagggatctagcactatctctgatctcgccgggcacggattcgaggaggaagactaccctgttgtcgactacgtgatgatacttcaagccatcacgtcgacaacaaatagataggctacccccaaatattgtactggtgtgattatggtgaataagagcaa

SEQ ID NO: 56764 - DNA, 1501 bp, Oryza sativa
caccaccgcgttaatgtgatacggtgtacatttattgttcacgaacgttaaaactcgtttttagcgattagttggtcgttttccgttaaatcacctgaataatcgtccgtatgttgtatttgatgatcatttagtgttgttttctttacttaatttagaattgtttttgttttgttacatatatttttatgttttacttatttaatgcaaccaattctaccaccatatgatatataaatccggtgttagaagagttaatgttttacttatctgtttaattaaaaaacaacatgaagatatttgatttatatagttaaacaaatataattcttcaaataagtatataatataataaaatttgtacatatattcgcgaacgtcaaatttccgtataatttcgattaatcggtgaacgataccctttttgtccgacaaccgtattccgtcttctacaacactggtatgcggcgaagccaagggcggaggccgtgccccacccgcagcgagaggccgctccatgtctagaggctgccggcccagctccctcatctcgatcgccctcctccgacccgcgcactgcccgacgtcctctcagacgccgccccggcgaccggcgggtggcgaaagttggtgggcggtttctggggaatttttttgagaattaatattatttttatggaaaatcgcaaaagtagtggccaaccggggaaaatcgtgaaagtaggtccctgtcgaacgggtgcaattcgatagggcacctatcgaacgacgggcagtcgacaaagccctgtcgaacggctggcgttcgacacgctcacctgtcgaacggagggagttcgacagggcccaccacccggcgccgcgaggcctgtcgaaccgggggcgttcgacagggccctccaccgaccctatcgaacaatgggcgttcgacaggccggcttaaagccccgtccacccaggccgcgagttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacaccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttctttgttactaatagttgtaaattagtacacggcaatgtagtataagttgtaatagggtaattatcgaatgattaaatgattaaacgtgagactatttgtcatgttttatcagga

SEQ ID NO: 56765 - DNA, 1501 bp, Oryza sativa
agagagacgcccgggagagagggggccggggaagagatgggccgagcggaattcggcccatcgaacccgggggaggcaaactagacttttgcggagggattcgatttggaaggaattggatttggagttgaactcgacgatagatcggggattgagatcttgagatggcacggacactagacaacaagcaaggaaacaaatttcgcaattagggtttttaagagataattttcccgctaggcgccacgacggaacgggcgctacacggcggcgacgaactttgtcaatggcgacagcgacggcagcggcgtttgcggatgagggcggtggcggcggaggttacggacgaggacagcggcggtcgagggcggcggctgcggcggacgcggaagaggcgattgagggcggcggtagtcgagggcggcggcggacgcggacgagggcggtggcagcggcggcgacgacgacggcggacgcggacgagggcagcagcgacggaggtcgcgagaggacagcggtggtcgagggtggtagcggacgcggaagagggaggcggcagcggtcgagggtggaggtggacgaggacgaggggggtgctaatgggcgggtggtcgctgtgagcgatcacccgttcctcccctatgacagctcctctaccccttcctcctccccttcttctcttcctactacatcataattttctaaaaaaaataaaaaaacaaagttagaaaattttatatgtagaaatactatataaaaaatatttaaattcaaattcaaatttaaatcggatatataagcttttgacttataaactttgggtctataaattttaggtgtataaactttagatgcatagaaatactatatatataaaaaattttgaattcaaatttaaatttgaatcagatatataaacttttgacttataaactttgggtctctaaactttagacgtataaactttagatgtgtaaacttgaggtatacaaactttaggtggataaatttactaaaatagaaagttaatacggtgtcagaaaggaaacatgagatgatcgtccgggacgatcgatcacccattaggaaactcggaggacgaggcagcggcggacacggacgagggcggtggcagcggtcgagggcgtcggcggcggcgacgacggcggacgcggacgagggcagcagtgcctttgcttctgctgctcgtgctgctatcatcggttcctctctcttgccagcacgcccactctactactgcaggttaattggtgcccttctttttttctttcgtttgtccaacaagaggaaatcttcctccttggctaattccgttgtgctgctcattatcctcattgtttcttggttgatttttgcagacacagaattgaggactgacctctgttgttcatcttaggtgagaatgaatttacagactttcctttttctgctgggcaacactggcaatctattctggcattatctttctctttcgctactt

SEQ ID NO: 56766 - DNA, 1501 bp, Oryza sativa
aaaagcttacaaaagagaagaggagatctactagagccatacctgaactcttccgaaggcttccggactccgatttctactctattcctactccactagcttcagaacactaaactaaacttgagagaatatgagagagctttgcttgagatgtgtgagtgaaatgagaaggtgaagtccttaaataggcaggtatgacggttgtaactgctgtgaaatgtctgaaataccctgcaaccgtcatcaggagaagatctagagcgtccctgccaaaccccacatccaacggtggaggtgggtctggttcggccgaaccaggggccggcccaaccagcccacaatttggctggtggccttctggacttctcttctccgaagacttgtgaattttggcccaattgatcgtgtcatttctgagttcttaagccatttatatataagtctgattttcgacatcgtccgattgattaatcgtcttatttgatgtcgattctcctctactttatagttattcactgcaaaaggttagtgatccaaatactagtggaatattattattctaacagaaatatgcattgcaagcataactagttctcttctattttggtaatattgacggtcgaaactgatcgctaacgaccgtcaacgaaggcttcaaaattttcttgagtttgaggggatgtgctgccaaattttttggtgattttgttttggtgataatatacaacttggaggtgtcaaaaaggttagcaacttcatcctcctctattttgtggttagcatttgcatttagagatatgttttgtacactattttgcctctataaatttggaatgggagatgatgagagagaaagtttgtgtagagatggaataatatagaaatttttttatttagaatttgagaaaaaacttgtgataaaagagatgagaaagaaaaagatagaaaattaatctaaaagaatataaaactaagttaatttaaattaaattaagtacaacacattaaatagtttacaactttattgtggaattgaaacatgaataatttgtggtattattttataattattgtttgaataattatatataactattgtatgattgtttaattggttagaaaactaagttaatttaaaattaaaataattacaacacattaaatatttgtttacaacttcaaatataattaaaacatgaataatatgtggtattattttataatcaaatttgtttatttagaatttgaaaaaaaaaacttgtgataaaagtgatgagaaagaaaaagatagaaaattaatctaaaagaatagaaaactaagttaatttaaattaaattaagtacaacacattaaacatgaataatttgtggtattattttataattattgtttgaataattatatataactattgtatgattgtttaattagtttggctttagtgaattatttttctcgatttttgtgctttttgtgtagatggatcggcaatggatgtgc

SEQ ID NO: 56767 - DNA, 1501 bp, Oryza sativa
gggaaataagtgtttaatgcaggcctcaaggaaaggctggtatttttgcaattgattttatttgaactcttttctgaaacaactgagtgagtgcttctcaaacgacacggttgagacagtgcgtcccgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacaccgaacccctttttacacaacaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcgccgacccaggtgtcgggttttccaagtcttttgtaaaactccagttttacccaagttgttactcagattttaagtttgaaggcgaccgtcgatactcgcatagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaagggtggcttgccttgctcgagatctggagcttgatcctcgaaatcctcgcactgcgggtcttcgggctccgaaactacacgcgaaacgggacaactcaacaatcggcgaaaataaagccctattaaagacctctaagcgtgccactagatagatctcgagatttgggaaattttggaagttgaacagagtcaaacggatttacggttgggaagatattgaatttctaagattattgaatttttggcctaaaggaaaaggaattaaatccttttcggaaaagaaaaagaaaagaaaggagggaggaaatttagactttcctcgggcggctagggtgcggcccaagggatttggggcggctcggccgagcttaa

SEQ ID NO: 56768 - DNA, 1501 bp, Oryza sativa
atttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataagtttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagttgtcatgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggccaagggagttggctaggctgaaattctatacccgagaggagtgtgaggaggctatgatacgcactggattgaacccaggctggttggagtatgatacagaggatgaattggatgagtccgcttccgactccgatgatgatcgttcagtgcgtaagatgtcagagcatgaaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgtaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 56769 - DNA, 1501 bp, Oryza sativa
gagacgggcagatcggttggcaaagaaaaatgaaaaactttcgggacgcgatagcatattgaatgtcactaaaacaagaataaattcagcccaaaggtgcacgtaaattggtccaaaagtttatttgcaagtcaaataggcccagaatttcatcccaataattgggctattttgtggcccatagaaaaatcagtgatgggccaaaccgttgcctgacgtcagctggttgcagggcagaccgacgcttcgagtcccaaaacggtcaaaccgaaaccgagccacctctcgccgtcgtctccggtcgccaacccgtcccacccgtgacgtcatgccgaccgccaacctcaggtcgcgcgccgccgcggccgcggccgccgccgcatgcctcgcggccctcgcggtggcggctctcctccaccgccggcgcagacggggtcgcgctcgcgcaccagcctcgcccggcctcctcgggggacggcgagggcgccgcccgcgccgagcctgcgaggaggaggagaagccgcaggcccggttcaggcgcgtggtcgcggacaactcctactccgccttcaagcacctgcgccgccagggtgctggaccggttggctccggccaccacggcagcgaggcccagccgacgtctcaaggtgtggtcaccctgctcctgtttcttttgatctcggcattgccttgcccttgtagatgtgtggttgtattgggaattctgcgaacggttggtacgctaaggagactaaggcaggattaggggggacgtaatagcgtgttggttcttcggggaatttcgtcgaacattttgagtgcaaggttgctccgagcttgaggattgactatggagatctggacctgtctctttgcatacgaggaacataaggaaacgattgcttagttgattgcacagcgtgttagtccttacttggcataggaaggggccttcatgatgccagttcccttgttggagcttcgtcaggtagttatcaacgtgcactgaaaacacaacgtggagcttcgtcaggtagtccttacattgcatgctttgtctatttctttatcaatgcattactgtacatcatcacacccttacccataatatttggtacagttagtgcatctcttgtttaggaattaggattcctagttagacaaaaattaaaaaggtggatcgatcaaaattactacttcacgaggacttttattaactttaccaaagattcctacttctcaaatattatgagttagtaagtttactacaaggctgtactgcacagccttgctcacaatatttggtacagttactgcatctcatgtttagggactcctagttaggcaagtaaattgaaaagattgatcgattaaattactacaagtgcataaaccgttattgatagttagtaagaggagatgctgaaagcacaagtgcctgagtttaagtttgattgcatgagttttcaccatagtctctatgcgcatactgcaagcgaat

SEQ ID NO: 56770 - DNA, 1501 bp, Oryza sativa
atgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtgatagttgacagacttaccaaagtggctcatttcatcccagtaaaaacaacatattccggaagtcggttggcggaattgtatatggcaaggattgtgtgtttgcatggagtgcgtaagaaaatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtactttagacttcggtggaagttgggataagaatctaccttatgcggaattcttgtacaacaacagttatcaagctagtcttcagatggctccttacgaagcactgtatggtcggaagtgccgcactccgcttttgtgggatcaaacgggagagcgtcaggttttcgggacggatatcctaagggaagcagaagaaaaggtgaaaatcattcaagaaagattgcgtgtggcccagtctcgtcataagagttatgccgacaatcgtcgtagagatctaagttttgaagaaggagattatgtgtatcttcgtgtcacgcctcttcgaggagttcatcgtttccacactaaaggaaaattggcacctcgttttgtgggaccttataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaacaaatgagagaagaaccagaaatcgagttatccgcttttgcaaagttaattggagtaatcactcggaagaagaatcaacttgggaacgagaagatgagttgaagtcagctcatccgcatctgttcgccagttcttccgaatctcgaggacgagattctgtttaaggggggtaggtttgtcacaccctaaaaatccaaaatatataaattgttgtttaaatagaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttctttcggctttgggccgaaagtcagcccaaaaccctctctctctctccccggcc

SEQ ID NO: 56771 - DNA, 1501 bp, Oryza sativa
cgggtattaatggtgtagtatatttttataggtaactattatatgaatgggttattagattagctatagatgatttggagctaacatttggctatactattaaacttgctctaacacacttctagtatgtctttttatgcactagccactagagttaagagcttggccatatgtatagtactcctcatggctctcgttggcgcaaagacctgatacccacgaatcatacatgatacgcacaaggtatttgatgtctgtgtatcgagtccctaatacctaggtatcaggtaactggtacccagattattcgagttagtaccataggtactagacctgatactataggtatcgaggtacttggtcgctagatcgggatggtatccataagtaacagaccaggtactaggtatcgggtacctaaagtacttagtatctatatcggtcagataccagtaggtaccagacctggtactaggtatcgggtacctaaaatacttagtatctatatcggtcagataccagtaggtaccagacctggtactaggtatcgggtacctaaggtattaggtacttggtccctagatcgggttgatacctgtaggtaccaaacctgatattgggtattggatacctcgtactacattgggtattaggtacctaagtttgcactgatgttagcatcttaacaattgaaaccggtgtgttatgtcttcagcaagaagtcgtgcgctgacatgtggccccttgagagaacacgaagagatgtgggttgacacgtggggatttacgtgaagttgataaaataacacaagtggttggtcggtcaaatagtcatgctcatcaagtttggccgtaatctgaagaggcccaatataacgggaaagtgttttcatccatcgaggggagtttcatgcatgccacctaaatagtcatcaaaaaattttttaaaaaaattggtaacatatattaatatgagatatatcactctacaaacatgcaagtttaaattcaactcctataagttgtaataaaaataacaaatatagctatgaatgtacgataactatttttagtttaattttttacttttgttgtaacttgtagaagtttaatttggtctttatgtttgtggagtgatatatttcatattaatctatattgtctattgttttcaaattttttaatgactatttagatgatatgcaaacaacaaggagatatccactcgagagatgaaaatccacatcccaatataaccacatatgtattgtttcagactatcagtcgatctctcgttccatttttgggattggtattgcttatggcggcggtgcaacctgagccgccgttcccttaccttccggcgacaccttcagattgaacaatgccgcgcagagaatgaatagattgtccaagtagaataccggatcagttaatcacagccaagctaatggctgacttgaactcggacaccgacttcaattccaactcggactcggct

SEQ ID NO: 56772 - DNA, 1501 bp, Oryza sativa
gagcagcgcccgagagagcggagaggagggggaaacggaagggacggtccacggctcaccccgagacacgaggacggcggagacgacgaacggagtggagaaacgcggcggcgcggctcgggatgacgatgacggcggcgctccgacggtcggcgagcgaaacggaggcgcggacgaggtcgacggcgatgcggcgatgccgagggaggtggcgccgagccgggaggaagaccggagcgacgacggcggcgaaccggagcggaggaaggcgacggcgcggttcgggatgccgagggcgacggtgctccggcagccggcggacgaagcggagcggcggacggggtcggcggcaacacggcgaagcggatggaggtgtcgccgagtcgggcggaggaccggagcgacgtcggcggcgaaccgaaggtcggcggcgacggcggagagagaggagcacggcgcgagcacggatccgacggcgagagcgagcggcgagcggtggaaacggaagagcggagctcggggagcaattatatagcaccgagagggggagaacgcggccggagaggaaggaaacgggcgcggggatctcgggctccatagatgtcgccggcgaggattacgggatgaatccggacggatccgagggagagagagaggggaaatcgggggaaacgggggagggaaacgcggggaataatttccccctctttaaggcgcgcgggcaaggcgggatgcggcggaatccgcggcggcggcggcgctagggcacgggcgggcggcggcttcggcgcgaggaggaagacgacgggtgggtcccacccgtcagcgagagtggagggcgggcccgcctgtcaacggcgcgcgcgcgcgggggaggccgatgggccgtgggggaagagagagagagggagggactgggccgagccggcccaagaggggaaggggggggaaaagaacttcttttaagatttttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaatacatcgacccaatgcactgtagtccaggtgggttggttgggcctgttcaacgtggtgtagcgttgatcagtggagatttaatgttactctaattactcaaccgttttactgatttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagat

SEQ ID NO: 56773 - DNA, 1501 bp, Oryza sativa
ctgcccgccgccgttgccgccgcttggatcaccccgccgccgctccaaccgaggctccactcggtgccatctaaaccgatggggaaagtgagaaagaagaactgcgaggaaaaaggggaagggaagattgaaaaaagaagataatggtgaggcccactacaacgaacttacacttgagtatgtgaatttagagggctttggatctagttggcaactgaggctcaccaagtgcgatagctgcaccgtgaacacccttatgcagctggtggggccactggtcaccgatccgtaatacgaatatgattttcttggctaatcactggattatgtgtgcgagttagttggagagaaaataggcatgctcctgtggttatgtgcatttacgtacacggtttgcatgcataggaattaggtgagatctagcggcagcgagaggatcaatctaaacggcgagctcgccgacgatgccacacgatgggtagctagcaggcgatgatcatagccaatagaagcctattaatgtgcaggtcaatagaatggtctgttctgcacaaataaattaaattggaagtcgaatataatatggatcagtgatggcgatgtcctccgccgacgagcatgtgcgcggcgatgcctctctcgtctccgcctccatgctaggcgtgctcatgctcctcctctatggcgagcgtgtgcacagatcagccgccgctacgagctcgccgtggaggcggtgagatcgacggcgagctccactacctgccttgatgtgccagagatggagagaagggaaggcgcaaagaggagggggagaagaagaggattgggctgacagtgggccccaccatgtttatttgttgtggctgacagtgggtcccatgtatctttcttttgttttggttgaccagactgccacgtgtgcgtccacgtaggactgaaactacactgggtcgatctaggggggtaattcgtcccttttgtaagttcaaggttaaaaataaccggtattagagttcagggttaaaaatcagacgaccataactattgagggggtaattcgtactttttttcaaaatataactacaatgggggcctcaaagcccacaagccaaccccacttgcattcctatttgttggtggactagcgtcccccacttcttaactttctactcatggtttactcaattcattttttaattatttatggattattgaaacggaatatttcttccacacttcaaacaatatactttctttaaaaaaaacctttttttctactgcattgctaatatcatttgttttaagctatttgttaaccttgtttcttaaaatatttgatttgtcaatgaagcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgc

SEQ ID NO: 56774 - DNA, 1501 bp, Oryza sativa
tggaataaaatctgcagtgtgctgatagggtgtttctagaaaacttttgtaaattacttctttgttggttatccaccaacaaatacaattccctttcggttggctgctcattttttttccttacatgccagaggtattttttttcatgttatcctctttagtcacaattacatgtttggagtacagatagactaacttgttatcctttctgattggaaaggaatgtaatgtgttacttgaaccctaaactgaatataatttggttgtcaggtagtacttggtgagtccgtgagctgatgatgccttggtatggatgcttgactgattaacgatggaaatgtcagggcgcagtgaaagaatgtggaaacagccgtcatgcccctctaatttctcatctactgtgtacaatagtggattccctgatccaggattagcaccatatccaatgatgagtaatttctaaaaagggttcattgcacagcccaaaatagtgctctgcatctgttttctgcatggtacatacttgtgatgatgacatgttttctcttttttcccatcttttcccttgtgaacttgcagatcttgaaaagatactttaatcatttttatgattaatttatttgtaggatggcttcagtagccataccaacatattggcttcaggtgtagccgtgcagcaatgccacatcttccttcaaaggtaaattatagttagttttcctcggacccttgtccgtgttgtatatttactatctccgacaaacacacttcaggaataataaagctacactaactcgataactaattactatgtgataagaataagcctactccatgcatgctggtaatagttcacttcattctgcgctgtcttactttttggcttgtcttgctccttctccagtgtatatgtgacctataaagttagaactaaagattgaaacatgaacttaagttatcagtgaagcatatctaaggttatagcattctatatgatctatcggttttctggctcccttgatataaaggttggatttctatccattatctttaaaaaaaaaagtacagagggatcgcccttacccatagatctctttgtgcaaattttcaaaacctggttttataactgaatagttaccctccattagtatttgatttattagatgtggcaagttgcatgccattaagataacctcacatatttctcatctgtataatatatctcccaggtggagacaatgctatattatagcttgtgacggttggtttggtgtagtagatggagttgatcaatagttatttgaaggtaaacaaaatgcattgttttcctcctcagctaccgttttcttgtgtaacctcacggatatgttaaactcctgtccttgctttcttttgtaggaccaaagttgatggcataattgatctccctctcctctgtcctgctactgacattagaagtgcaagcttttcttgtaattgttttttagtgtacttttcttgt

SEQ ID NO: 56775 - DNA, 1501 bp, Oryza sativa
gttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtactccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgaccggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaaggggtcggggtgcctcggccctcggggccgagacgggagcggtccgacccctcggggagacaaagagaagggcggccgcatcaccctcgggcccgacccccccccccccccgagggggttaggccacgtgggtgatcgtgtcttcctcaagtctctaagtcatgatactcccagtcccatgtcaccgacagcagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcagcgagcgtaattaacgcgcgcatgagatgttccatctcgactgccacagccgcatatccacctcatgcaccgcaaacgggcgaatgggattagtggaagcgtgggtgcgagaaacgagggtgcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgcctcacgcgctcgctctcaaacatctcttcttccggcgtca

SEQ ID NO: 56776 - DNA, 1501 bp, Oryza sativa
ggccccctacgcagatcttcccgggtcggaggcgctgacgaaggagtggcggccgaatggcgagcaaccgccgccgctcgccgcgccctccgccttgacgacacggagccggtggtagcagctccagaggtcttggtggcggtggaccgctcaccagcacctaggcgctgtcgtgccgtcatgaccaagttggccacgtcgtccagccaacgttgggctggagactccaggtcagggacaatgggcgggtgacgtaggagcgcgcccgcagcttggagcgcgccctggggcgtgctgccgtcgccgtagacgaggaggcgacgctccccatctcgctgcccttctccatcacccgtggatgtcgaagtcacggatccttcgaccctctcgagcgcctcctcccggctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagaggcccctacctggcgcgccagatgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtcctccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgactggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaagg

SEQ ID NO: 56777 - DNA, 1501 bp, Oryza sativa
gctatactattaaacttgctctaacactcttctagtatgtctttttatgcactagagttaagagcttgggcatatgtatagtattcctcatggctctcgttggctcgaagaccttatacccacaaatcatacatgatacgtgcagtgtatttaatgtctatgtatcgagtccttgatacctagatattaggtaactggtacctagattattcgagttagtaccataggtactagacctgatagtataggtatcggggtacttggtccctagatcaggatggtatccataagtaccagacctggtactaggtatcaggtacctaaataccatgtacttagtatctacatcggtcagataccagtaggtaccagacctggtactaggtatcgggtacctaaggtattaggtacttggtccctagatcgggttgatacctataggtacctgatctgatattgggtattgtgtagctcttaccaggtatcaggtacccaaatctattaacttattaaaggaatagaaaaaagagcctccatattcactctcatggcctagaaattcctacattaattggagaaaaagaaaacagaatccatatagaaatacaatttaaaatagttaaaattcagaattaaaaaataaggaatattgggagaggagactagagtccatatagaaatacaattgagaaacaatagaaattcggaattaaaaataaagaataatagtagtagggtatagagtccatatagaaatacaattaagaaataatagaacttcggaactaaaaataaggaatattagaagtagagtagagagtacatataagaatttaaaactaactaaaatttggaataaacataataaatttaaaagtagagtttagagttcgtataaaaatacaatttacaaataactaaaattcgaaataaaaaaaacatgggaagaagagtctaaagtcaatataagaatacaatttagaattaacttaaattcgaaattaaaaattagggaatattgaaaaataagtttagagtccacatagaaatacaattagaaataataaaaatttagaattaaaagtaaatcatattggaagaagagcctagagtccatataggaatataatttacaaataactaaaatttgatattaaaaataattaataaataacttgtatataaaatacaatataaatattatacattactagtttcgtaaaggtagtacaaaatttaaaattatgttgtcattttaatatatttgaataatacattgagaaaacatattgtcatggttatggataccacatacctaatagtaggtgactaaatctcggcaggacccaccacataccatgtcctatacggaaacaactttcggatataggaggagttccgataaggaaagacaaccagagttctacatgaaaacgacaagtactactcggattgtagccatattggtttccctagttctacttggacaagaggacaccta

SEQ ID NO: 56778 - DNA, 1026 bp, Oryza sativa
ttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctgaaggaggaagaagacatatatataggggtgggactttagtcccggttggtagcaccaaccggggctaaagatcaccgggatcattagtcccggttggtattaccaaccgggactaaagttaagatctttagtcccggttggtaacaccaactggggctaaagatcaccgggatctttagtaataccaaccgggactaaagttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgttttccttttgaaccgggctaaagatcatctttagccccggtttttattgcatccgggactattgtggaaatcggccgaccgacgaaagatggtttctccaccagtggctataaggttttttatagctttctctcagcctacccatataatagttagctctttgtaattaatacaggcccacttatctttctcacatagtttcttggttcctgtgtccaagccggctgcaagtttacagcccacttctcctctctatcctcttttctctcctccacctcagcatttagcctgcttatagcctactattatacttgctcttaccgaatcca

SEQ ID NO: 56779 - DNA, 1142 bp, Oryza sativa
aatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactagggatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgattta

SEQ ID NO: 56780 - DNA, 748 bp, Oryza sativa
aataaatgagtttttaattaaatttaaatgaagaaattcgcaaatatccatttaaagagcatataaacttcaaatggccatatcttgaccatttgaactcggaattggaccgttcaagtctctaatttttccttaagaagtcaagaacccatttttgtgctttgtttctgctgttatatggagtttattagagtaaaagccttttcttttccgtcggtcgcgtagacgctgcagcttcggaagatccgctcttcgtggaagttgaagccgacgtttgggaaagcgagcaaggcaagtcacatcatccttgagcatattgaatcccagtttacgaaattattttaatttaaattaatgcattatcgctttatttaaattcccgcgttatcactgttttatttagccatgcctatttacctttgttatgaccttattattattgctattgttattatttccttgttcaccctagagtaaacaaaaccccaactagtggacattctactcatggcaccactagtttaattttaggtagatgcttcgcaatttaattaggtaacattaggtggttttacaactctagactttgggaatattcatatcacctggacactatggaatggtttggttattgtggaattggcttcacaccgctccttctattcaaaatccccaaattggttttaggctgggctcgaggtgcgtggttgggttttgatagtcgtacctcgggtactataaggattaa

SEQ ID NO: 56781 - DNA, 1501 bp, Oryza sativa
tcatggcctagaaattcctacattaattggagaaaaagaaaacagaatccatatagaaatacaatttaaaatagttaaaattcagaattaaaaaataaggaatattgggagaggagactagagtccatatagaaatacaattgagaaacaatagaaattcggaattaaaaataaagaataatagtagtagggtatagagtccatatagaaatacaattaagaaataatagaacttcggaactaaaaataaggaatattagaagtagagtagagagtacatataagaatttaaaactaactaaaatttggaataaacataataaatttaaaagtagagtttagagttcgtataaaaatacaatttacaaataactaaaattcgaaataaaaaaaacatgggaagaagagtctaaagtcaatataagaatacaatttagaattaacttaaattcgaaattaaaaattagggaatattgaaaaataagtttagagtccacatagaaatacaattagaaataataaaaatttagaattaaaagtaaatcatattggaagaagagcctagagtccatataggaatataatttacaaataactaaaatttgatattaaaaataattaataaataacttgtatataaaatacaatataaatattatacattactagtttcgtaaaggtagtacaaaatttaaaattatgttgtcattttaatatatttgaataatacattgagaaaacatattgtcatggttatggataccacatacctaatagtaggtgactaaatctcggcaggacccaccacataccatgtcctatacggaaacaactttcggatataggaggagttccgataaggaaagacaaccagagttctacatgaaaacgacaagtactactcggattgtagccatattggtttccctagttctacttggacaagaggacacctatgggtataaatacaagccccctaggaggacagggggacacccaccatgagacaatcaacacccaacacaatcgacatagaagcctacatacgccaagacacaccgccggatatcgacttcagggataaacacggctagtaccctacggtgtctccggatactgtcaggagagacgaaagcgctaaccgggcacgaattcgaggtggaaggctaccctgttgtcgactacgagtcagatcatcagaccgacatgttgacaacagttagataggctaccccaaacattgtactggtgtggttatcataaataagagcaataccagcttcggccaacaagatgtagggttattacctgacaactcatgggcccaaacctgtataaaaatcctcgtctccatctcttttacctcagtctcgcatatatcctagcaccgacgatccccatactgtccaaataccgtagtcgagacatcaaacgtcgacagtggcgcgccaggtagggggattttggtgcttcagggtttcgacgagatgagtttaagaga

SEQ ID NO: 56782 - DNA, 1501 bp, Oryza sativa
ttattagcatagttctctcttacaatcttcccttaggattaaataaatacgataccttataatactctcgggtgaaatgctacaatggtgtatccgtgcgcttgcggtatatccaggaccatttatggcgccattgctgggaatttatattcctaataatgtcgttaagaaataccaacagtatagctagtaacccaaaattaaaccttgagaaattttacggtctttaaatttttgtacatagaggtattatttttttgtgtaaaaatttttagattttattgaggtattaggtattagggtaattttatcattttattgaagtacgtaaaatttttagattttattgaggtattatgtattagggtaattttataatttttaagaaaacaaaatttaatacgtttagattttaggtattaaattttattgagggatctaaaaattttttacatagataccgaatatctgaaggtattaaattttgttttcttaaaaatgataaaattaccctaaaaccttatatcacaacttcataagaccaagcagagaagaagatgaattccgcagaatccaagtgagcttccaggaacgctttgcccttcattacaattgaataacactataatgtgaacggtggaatttgctcattctggtcaactcatgtgctgtgatttttttggctagctcaatatttatttttttcggagtacaattgtactatgagctagatagctattcagtcttcagataagcttttgtgtttataaaaaagttaatcttcggacatataactatatgattctacattctcatcgtctttgtttcgtctacttaattcctgggtgcctcgaattacttgtggttaattaggccatcacttcgcaaatgccatgcgtaaccatctgcatgcgtgcggtatcgacttgtactaccaatcagcaacaactggtgggtggtggcagtggcatagcagtgctacctaccagagtagctagctagctagtaggtatagcatcgcttgcgtaagtgacttttggtcactttgacgatttgctgctctcacgattagagcctactagaatttataggattcaactactcactggaaaatgtttaatttactcgcgaatttttggttgcatgcttctgcggttgaagccggagatgtagtatttctggtgcctcaataaaatctctccccgttacattttacatagaattgacccgcttatatcatagtagtatagaactgcagcaaaccgtgtagttcattgacacagcaaagcaaattcttcctgaaaatgttgattcaatgaaaatgaaaattaaattgtaaaattttgtactgtatagtacttctactagccaatcgttttgctttctgtcatatcgtcatcacgctggcgggtggagctgacttaaaatcgatggtgacatgattagtaagacaaaattggctaaattttgttcatcacgtcaaagaaacatgcataaaaca

SEQ ID NO: 56783 - DNA, 1501 bp, Oryza sativa
gctcttcgtggaagttgaagccgacgtttgggaaagcgagcaaggcaagtcacatcatctttgaacatattgaatcccagtttgtaaaattatgttgtttcaaattattgcattatcgctttatttaaattcccgcgttatcactgttttatttagccatgcctatttatctttgttatgaccttattattattgctattgttattatttccttgttcaccctagaataaacaaaaccccaactagtggacactctactcacgggatcactagtatgattttaggtagatgcttcgcttttaattaggtaacattaggtggttttacaactctagactttgggatgttctcatcacctggacacactggaattgttggattattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctgcctgcctgtcccgggtgtcccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctccggtatgggcaagccgagcaattgtacccaagtaagtgttttaattcttaaaacctggttaacaactaaaatatggaatggttggcctgggttggcttgggacgagctgggacccagggtcgggttgccagttcggtctgaatcatcgtaggccttgggttaaggcaggttcgtgtgggttcatggccttgataaataatattgtttagttctagaatcgtgtttacaaaatagccctgagcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacccagaagaggagccccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttt

SEQ ID NO: 56784 - DNA, 1501 bp, Oryza sativa
aactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttgttctgacggtaatatgtattatcgattttaatttatttttaatcttaaattgttggtttaattatgtatagagaaacagttagattagatataatatgtatagcttaaaataactaataactgtggttgtttttttttatcataactactaaaaaaatatagatcagtggagggggcagaaagtgttgtgcgtgtctaatggtgggggtgaggtggaggggactttgtttttctattttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcgaattagctacgtaatatcacggtaaagccatgtaaactgatttaattagctgtatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatatatatatatatatatatatatatatatatatatatatatatatatatatatgccgtgcatataataaatatagctatgattagtagtaatacaatatgacagctaattaatctcaacttctaacaaccatagatactaatcatccttccggcaaaccatacatacgtacgggagaaaggtagatctaattcatt

SEQ ID NO: 56785 - DNA, 1501 bp, Oryza sativa
tttacaaaagacttggaaaacccgacacctgggtcggcgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgttgtgtaaaaaggggttcggtgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgggacgcactgtctcaaccgtgtcgtttgagaagcactcactcagttgtttcagaaaagagttcaaataaaatcaattgcaaaaataccagcctttccttgaggcctgcattaaacacttatttcccctggcttgctgagtattcccgtacttacccttgctctataaaaaaaaatcccccccagttgctgaagaagatgaagtggatcctgctgacgaggagttcttccaggagcatgtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgcctccctgtgataccagcactatttcctgggactggtatcgattagcaggttaatttggagcgtcacgggctagttccggtcgggactagttcggggcgtgacacgccgtagtcgttgttgctgtcgggggaggcgaatatgcgatgaggccgggagaggcgaatagtctatgaggccggagggaggcgatgcggtgaggagcgaagggaccgagggcattgctacaaaacggaatgagtaccactgagatgtaatccaacggctgataattaaatgatgatgtggcttcaccaaatctcagctttgggttttaactttatagaaagaagggataccttagattttgt

SEQ ID NO: 56786 - DNA, 1501 bp, Oryza sativa
gttgatgcaataaagttgagatagttcaatctacatcttctagtttttatctacctgtgttttctaggtcccgacggtcagaccgacagcaaggtgacgttctaaccgacgagagtgcggtggtctaactgcaggtggcgcggtggtctgaccggccagacaatggaagtctgaccggcagcacgagggcggttcgaccgacgccttcaggacttcgtcgcctacttcatttgaggcaaatcttttattccgcaaaatattttgggtttttggttttccctaccattcacccctctctgataggtttgtttagtcttgttcgatcatatacctccatttttatttacatgggcagcgtaaaaaaaagagggagtataaatgtagcaatgaccaccccaaaaaaaaagacattaaccataacaggaaatacacaattatgtatattaagaatgttaaaaatgacaactgcaaataagatctcgatgaatagtttaggcacatgaaaactataaaatgtagcaatggcaccctgccctcacgacaaaaaataattataaattatatacagcattagggtggcctgttgaccaaattatctatgcaatgcttttagtttgatttgatacttatcgcatatgtggttaacctctaatttttcttacttcgtaggtttcaatttgccccacttgtgccggagagggtggagtcatttcagagtatcgcaaagaaatgtgctggagagggcgtgttcatgttggcaaggagatcaaagtaaaagttcctctaggtgttaggattccatcggatggctgattgagccgggagcgtttcagccgaagcccataggatggctgattcgactgagcccattcagcaaaacaaagtgggctcacaatggagggtaactggcgtttggttgatcaaggtggatattttccgtttcagttttactatatatttatggacaagttttctctcaaaaaattatgaaatgtaaataccctattgattataatttaattattatattataacttgtatgtaattttcatattataatatcaaattattaaatttgcttcaaggttcttgcaaacgtaagaggagaaaatcactgtgcgtgcacggggtgaggggattcgatatcacgacctccgctttgcaggaatcagcatgttacgacggaatttacgaaagttatatacaggatatattgaattacatgcatgattacatactacgactgtactatatttctgcccgaaaatttctctacaaaagcataaacagtcccgctgaactactactcctgtaacctgataggcccaattcaggcccacgaacgtgtttgggccgaaatgtgaacttgaacaggcctggattgaggcccaatacaactatgggcctaggtggaggcctcctgaacacaaaagaaagggaaaaaacccaagtgagaaaccctaaccgcgcgaggcgcctctcctcctctgcttgcctgcca

SEQ ID NO: 56787 - DNA, 601 bp, Oryza sativa
ctattttggctgtgcacattattttgccgattgtgttttgtctaagtaaatattcatggtcgatgatggtatgccactggaggtagcatcccttggatgtggcggccgtggcatacatgcatacgaaattgatttgcagtacttagcagcgacaagaccatccttttatttctgaattgactatgcattatatatgttatttgcatagatggaagaaatgcaacgcattcggcggtccctgattgctaaagcagctggattagttgctgtaatgaatgcttacattctgtttattacaagaagagccatgcgacgtacccctaggatctcctatggcccattgtccgaaagggacatagctagacaatccaatcttagtttcatctatcatacagatgatacaaattacttaaatcagctcagaatgaagagagccccattttttcagttgtgtaacttgttacgagaaagagcgttgttgcgggacagtatacatagctcagtggaagaacaagttgccatgtttcttcttgttgtaggccacaaccacagatttagagctttgcaacccacttttaggaggtcaattgaaactatcagt

SEQ ID NO: 56788 - DNA, 1501 bp, Oryza sativa
tcacatctttaatgtgtcacttgtggcggttaaaaaaaacatgttacatatgattatatatataatggctatttaaatcaacagtcaaaagtatctacagggacttagacccattagtgataattacttcatctgttctaaattataggacgttttgggatttgaatagtttcatacatatagatccatgtatgtgctttatctacatgtttaaattcatatggatgttagtaaatctatatgagagatgtaaagactaaaacgtctcataatgtgaaatagagggagtattgtgtgtaatatgtcctaaataggtgttgttacaaataaccttctaattaaaacaactctttattatgagttgttgtagatgaccagtaccagtcggcaaagacatttcctgattgacatatttttgccaactgaccactcaatatattctagttgtttagatttgccggccgacattatttttaccgaccaacatatttttgccgacgataacaattccagaccaacaatatgacgcaagcattagcattgctgacccacattcagtctaagattattcaaaccacatacagtgaccgttcattcattaaacaaaactatatttcactcattgattgattaaacaatgtcttcattcattcaacaaaattacacatcaattgtccaacttaacttcattcattctgttacaaaatgtgatagctaggcatgctcttaatagtgattttatgccgcattcctcctagtccaccaccctctctatcgctcgctccactagttcaccgcctttccacctctgcctgccccatctccacattcagtgacatggtagtgctacatcggatccacttctcacatgttggcggtgttgtccatcctccccctaagccacaccattgccagcctcccactcatgtaccgcacctctgttgccgctatcgtcatcgtcgtcagctactcgatgataaacggcgacagccacagagatgatgttgacctttgactgatgcagccatggtgaactccttgagcatgctcggcaaccacatggtgtcccccaggccccaaccctcttctgccaccctgtcttgccttactaccgtttctccctagatccgaccactctgagctcaagccggcatgaagaggggtggtgcggtggaaaagcggcgacgatgactacatcgagtgggcatagcgatgacagccactccgagcttgagctggcaagagcggctttgagcgagtgctttgatagcggtgggagcaaggttgtcaggatcgggatactagataatatcgttttgctcaaagtaatatcgtattgtagtatcgggatactatgcgattttcctttttttaagtttaattaatatttatattagttatatatagccattctatataaaaaaattaataatgatatatgttatgcaaatagagacatttatcgagagaaatcatgttggttttgatatatttaactgag

SEQ ID NO: 56789 - DNA, 1501 bp, Oryza sativa
cgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatccctagttgacattgataacaaggatctaa

SEQ ID NO: 56790 - DNA, 152 bp, Oryza sativa
ttttatcattatttatcgtatttatttttatcccagattaatctcttgctattttttgttgttgttcgcatataattacgcggcactattgaggcgattgatgctggtcatggactcgaggcgtctcagctttccggtcgatcggccgcgag

SEQ ID NO: 56791 - DNA, 1501 bp, Oryza sativa
caaggagatcattctcaaatctcatcacaatttgaaggtaaatttcagcatttagaagaattaacacaagtctatactcaatatatatccacacgccgctcatgaccgcgagcacagctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccacccacgtggcacaataccgttgtattggacagacttagtcacctaaactaccatgtcggggtaaataggaagttcctctgagttatccgaactcatacacaccggcctaccagaatgtaaggctaaaccataaataatttactaagcttgggctatcccatactagcacatttggttgcactgtatacgaaatgaactgacattgagtgaagtccttaggtcggtttgggcacactctcctcctatcggtacacaactaatcaccatatgtgcaccacttgaggcccaaacctaaaatccatgttttccatcattttatttatcaaaatcacaagtattaaagttctgtccagattatttctaaatcaatttttcatatttgtaatgagcccataatgacaaggaagaccattctaagcatggctaagcattatagtaacctagtgactccaaaattcatatataaagtggtgtagtcatattgttcctaaggttaggaatgagggatatggatatatgtggggttaaggtgataatgcaaataataggagtttgtctaacaagtttaacacaattttaatttgttaatgtacaatcgacatgcaggatttgcaaacattttcgataacctccatagttgtttaaattctcgaaacaaggtccctgacttcttttctcacgcagagaggcagaacagccatggctgagctcgatctcgagctcaccggcgacaaacgatggctcgtttgagggtgcaaccaaaagacaaaatgaagatcatgctattgcgattccattcctgtacttttcttggtcagtggacatcggagtaacgccggcggcgagttcgaaaggaggatgttttcgggtggtgatgcatgtgcttctacaatcatgtattggttaattgggtgcgtgcatgtatgttctataggctgaagggtgctcaccgagatgctagacatggctggggtagctaggctgatgacggcggcaagaacctccgggtgaacggcgatggctcaatcagctccaagaactatcatgcatgtgtgtccatgaggttagtgaggccccagggatggtgtatacgcgaagaatcggacaatggctcacc

SEQ ID NO: 56792 - DNA, 1501 bp, Oryza sativa
gcataaacacgtggtaacgtgtaattgtcgtgcagtaacactgttacttttgtgcaaactttttgtgcagtaacaagtgtatgattagcatctgagacttttaacccatatatttttgtttcaattgctgaattactgcaattcaccacaatattacggtcaaaagtgcaataacgtcatatacatgcagtaacgctatattggagggaggaaaccaattttcttgagaagagggaggaatgtaacatacccgaattctaggattaaggaatttccatcaagactagctgaaagggaagttcttcaattttgtaaaccaaaaatttccattttaaacaaaggtgaagttgatccaactcttgcataaataaaatttgagaacaaattaaaactttttcatctttaacataggacttggatgcaacccaagtgaaagcatgcatactctcatagacatgtttgacttgagtccttcatatgcatttggatttggattgcatttggattttcgatttgcatttcataataggtttcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaatagattatatcatatagggtatattctatcttaatcatcactataagcattctcttaatttaatactaaagtaaacttatgcataataggtaaggagcttatgacctgtgtaatgtaaattgtaattctaacatatcaacatcacctaggttaatgagagtccaaatataacttttataaacatttacatgcatttaggaaagggaagcatatataagacataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcattttactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaatttagaggacaaaataattccggaaattcgtccaaaaaccaagctcacccatgtttctgcctacacatctctcttccacctagt

SEQ ID NO: 56793 - DNA, 1501 bp, Oryza sativa
aagtctgattctcgacagcgtccgattgattgatcgtccattttgctgtcaattcttctccgtttcgtgttgtattctctacaagatgttagaatcctagtgcaagtggaaatagttaattttaaaacaaatatgcattgcaagcatagctagttgtcctttgttatagtaatatcggaggccgaaactgatcgataatgaccatcaacatcaactttacccacatggcacgattccacacatgttaccatgccccgaagtaccaccgcgatactgcaaatgggaaaatcgtgacaaaacctgtcatataaccctccctaaccgaacatacccacctcaggtttcacgccctccttatgccaagtcggccagtccccttttattcctaggtaaatccagaaacaatgaagaccaaaagccaggtccgaactgcaccatcgcctctacccttaccatggtatgtcagctaggttaaattatactctagattaagcctggagcccacgctggcatgtggtaagtacgattatatcttccaaggattcccgagaatcggtccttaattgtcatgggcatgacttccaaatccacgcatccacaacccactattaaagcatattttagtttaattaaacaataaccatgggggtacatcatcatataattaaggactaaattataatgaatcacattgtgaactaattgatctaagcatggctaagcatttctacaacaaacatctaatcaattatatcccaagttatcaatagcataagatatcaacaagctgaggacgataggcatccatcccacatgacattctaaaataatgcaatttaataaaaagcaggggattttataaaataggttcaacatgttcaatgttgtatgtatgacttgccttgctcttgaacagatggaacctcagcaaccacttcaaaataagctggatcaccggaactaccggaatctatacgacaaacaaattatacaagaaatacaagcaataaggctactgaaatagtaaaagaaatcaattttaatggattctatacattttaatgaattcactgcaacttgaatgggttaaaacggagctcagattatttagatatgaattttacaatatgagctgtgtaattactaacaaccgaaaaaccttaatcaattattacatattaatgcccatagagaaatagatcaatggaaatatatcaccagtaagcaagcctcacaaattagtgactcaaccagccaacacatcgtgacacgggaccgtcaaccaaaccggcgaacggaaccggcagctcagaacgactctaaactaaagaacgactcagaacgaccgaacggactaaagctttggcaatactacgtgcgaatgatcctaaagcaacttagcgaacggctgcagcaaagtcggcaactaagcatggtttgcggcaatgacccggtatggcaaacaataggccggtagagactcgcatgtactaaagcggct

SEQ ID NO: 56794 - DNA, 1344 bp, Oryza sativa
cccccccccgcctacaatgaaaattctttctaggaactccattcagaagaactgaagagaagcagaagaaaagatcttctgaatccagtttaaccattttctaaaaaccccatagctttcatcaccaacaaaatagcttcatgttcaatagtatcaaaggctttctcaaagtccaactttaaaagaacgatttcccttcttgagtggtgacattgatgaagaaactcaaaattccaagcaaggcaatcctgaatagttctcccttttataaaactatattgatttggatgtattactgataggattaccatctgcaatctgccagccaacaacttcgtcaaaatcttcagagaaatccccataagagaaataggcctatagtgatttatagtctcaggacacaattttttaggcaccaaagtgatgaaagagtgattcaaaggattcaagtctagagagcctcaatgaaaatcagcgcataatttataataatcttgacatataatgggccagcatttcttaataaaaaggccattaaaaccatccgaatcaggagctctatcaatagggagattcttaataagcttatcaacctcattcttagaaaagggggcatccaggatttccaaaccgtcttgtgaagggattaaagaagggagatcaaaaggcatacattcaaaacaagaaattcccatcctcatcttaaaagcattccaagcagtatgggctttagcctcatgatcagagagggttgacccatccacatcaaccaaaatagctatagaattcttcctgtatgattcagttgccattgcatggaaaaaatttgtgttttcccctccaaatttagcccatctaatagtacaccttttcttccagtatgtttgcttatatttctaagtatgtaagcaacttagatctgacaaaaactctgaaattccattccaacacagtgagatctctatattcctcaatgatatcaaaaaaaaaaagatcacaacattacattttgtgatgagtttctgaagcttacatagattcctactccattttataagcccctttcttaaagctttgagtttagatgaaatatttctagcagcatccaaaaaactgccatgattagcccaaatagattggactaaatcaaaaaacctttcatgctcaacctataaattctcaaacctgaacacatttgatctaggaataacaactgcacaatacaggcggtatgatcagaagttgacctagctaaaggcttgaataaagtattaggaaaagaggaagaccaactagtagaagtgaaaaaccagtccaattgctcaagttgagggtgattttgca

SEQ ID NO: 56795 - DNA, 1501 bp, Oryza sativa
agttctcagcattccccttttcacctttttgccagaattaaaatattacgaatttttgagtgaaactttgaaaaatggaaactaggtaactcaatctatctccacaccagaaaacacatttttgacactcttgtagataggtcaatctagttacccaagaatgagaggaagaaaatgcctgcaaatcaactagtttcaatgtgtacctatgtttctaaccttcctttatctgtcccgtggacccagctcgacttggccccacctgtcactgacctaggctctccaccaagccccatcccacctccaggtcgtgcacccagctcaggttcataaggcaagcaggaaaccctttcatcttcttcccctttcttcctcccttgtctgttctcccatgagctgagctctctcctaattttctccttcccgaatcttcttgaaaatgcaagaatcaagccctgcatgtcacaccactagatccttgtgattctaagctttccatccatccaaatggcttgcacatgcatagatttgtgagggagatcgagaagaaaagagaaggagcttgctgcttggtgcagtagcagtaacacttcgttttcctccacttggtgagcttccttccccatccatagcttctctcttaggttccctaatatgctgagcattcctagcctcctccaccggtcgccggttcaagatttcaaggataggagcaggttgcacgttgttttctgtcctttggtgacaactgctcggtgtcttctttgcttccctgttttggtgaggtatcagctcttcacctcaagccaaaaagtgtcttcttagcagtaggatcaagtccttaatgtatgtttttcttgcatgtgatgttcttgacatgcatgcaatagagcgatccacccacagcgctgcatcgttacatgcatgacatcccgagcgctggcacttgcagccgctgcctgcacctgtccggccaccactgggctgggtagagtataggaatggaatctcaaagacttgatctgcatggtctcttttgaccttgccccaattagagccatcgtttgctgccagcgagcttgagatcgagctcagccatggctgtctatgattgctgctcaattggagaagaagctggaccttgttgagaaatgggaaaacttcaaaaagccataagtatttcattttaactcatctttgaatgaatcaaatccctgtgtattcataaccttgtagaccttatgtttgtaaaggaaaacttttcaacttctgttaagaaaatgtcagtttttcatatgacttaggttagttcatatgtaactgaaacaatgccattttcagtgtatatggcttgttatttttatacctctcaaaccataaatgtaaatgagttgattcttgttcctaaaattagtttatcatactctctacctactgtaattaggccatgatttatagagcatgttgcatatgcatatttatttgaatcttatttgcatat

SEQ ID NO: 56796 - DNA, 1501 bp, Oryza sativa
ggcataaattctgatgatgggtggttggctattaggaataagatagaggaaagcggatgtgcatttttttttgtttacatgaaactaagagaagtaattttgatcattccttcattaggaagttcacccctaagcgttttgacaaatttgcttttttccccttctaggggtgcatttgggggtattttggtttgctgaaatagttatgtcttctctgttatgaatatcacaattgaaagttttgttgtccagctcacttttacttctaatgattctagtttatcttggacaatggttactatttatgagccctgtactggtgttgaaaggtctaatttttttggcttggctttatagtctccaaattcctgttggtgatttttggctgttgcttggtgattttaacttctatcgttcagttctaaatagaaataagccaggagcggatatgaatgatatttttctttttaatgaggtcatcagtaatttgggtttagtggaagtccctattaagggcatggcctttacctggagtaacatgcaaaatcaccctcaacttgagcaattggactggtttttcacttctactagttggtcttcctcttttcctaatactttattcaagcctttagctaggtcaacttctgatcataccgcctgtattgtgcagttgttattcctagatcaaatgtgttcaggtttgagaatttataggttgagcatgaaaggttttttgatttagtccaatctatttgggctaatcatggcagttttttggatgctgctagaaatatttcatctaaactcaaagctttaagaaaggggcttataaaatggagtaggaatctatgtaagcttcagaaactcatcacaaaatgtaatgttgtgatctttttttttttgatatcattgaggaatatagagatctcactgtgttggaatggaatttcagagtttttgtcagatctaagttgcttacatacttagaaatataagcaaacatactggaagaaaaggtgtactattagatgggctaaatttggaggggaaaacacaaattttttccatgcaatggcaactgaatcatacaggaagaattctatagctattttggttgatgtggatgggtcaaccctctctgatcatgaggctaaagcccatactgcttggaatgcttttaagatgaggatgggaatttcttgttttgaatgtatgccttttgatctcccttctttaatcccttcacaagacggtttggaaatcctggatgcccccttttctaagaatgaggttgataagcttattaagaatctccctattgatagagctcctgattcggatggttttaatggcctttttattaagaaatgctggcccattatatgtcaagattattataaattatgcgctgattttcattgaggctctctagacttgaatcctttgaatcactctttcatcactttggtgcctaaaaaattgtgtcctgagactataaatc

SEQ ID NO: 56797 - DNA, 190 bp, Oryza sativa
catttttacatgcgaccaaaagtgaattttacatacggccaatgaaaatcggacttttgcacgcgagcaacgcatcttatgttgtcacctataccggccgcatgcgaaaataaattcggcaaaaaaaaagataaaaataaaaaaccccaaaccctagcccgccgcctgctgttgtcgtctccatcaaagc

SEQ ID NO: 56798 - DNA, 1501 bp, Oryza sativa
cgcaaaacgtcatcctccgtgaccgaagcgcggccaaagtagagttaaattacacgcagacacgctcggggccaaaaagaactccgtctccgatccctctcccaaagtcaaacccaaaatacaacacaattgtatcacggtacgacgtaaagcaggcgtacgtgcaagacccgaccgacccgaggtcgccactcgaaagcgcccgccccaaaaaaaaacccgagcaacttctccagcggcgcgaggctgtttcgggccgcggtgacgtcggaagctgccccgcgcgcgccaggcgccaccctcgtctcgtcgtcgcgcgcccgcgcgtggcacacggcacccaccgccctcgcgggtagttgttggccaagtaggctggcgtccgcgcttttccagcaccaactctcgtacgccgctgatataccgtataaaaatgccaagggatatgaccatccgagtcgagggctgtgattctcgcgtccgctgcctatttctgcctccgccacgcccacgcccacgcccacgcccacgcgagcgcgtttgcactttcccccgtgttttgtgcacagtacactacccagcctgccgctcgatcgatctggccttctccgccgcaccgccgcgcggcgccccgaccgtcgtgcggccgcaggaggatgcaggcacccttcctttcgccgcttttctcctctggaagaagggctctcccatagacaacggctaagaattacaaggctgcttctttcgggagtagtttttctgttaattttacaagggaaataggtgagatttctcaggtgtaaaagagaattagtagtgctgtggctggggaagatgtccaagatcagctgcttctctgctcttctcgccggcaagaggaagttatcaaaggttggtggattatattcttaggagacccagttctttgatgaattttggtttaagtttttgttcttatcagctctgaacatggcaggttacgagcaagattggttacggcaagaagtctggtggcaatgagttccagaaggtgaaaccgttggagttcatggaggggacggacaccgtcgacatcgtgaaaggcggtggtgacattgtcctggcatgtgacacaaaggttgccgctttcaacgccgctgagttggcttgtgaaggccgcgacaaggacgatgacatgggtctcggtgaagagggacacatctgacgtcgacctcgtcgccggcggcgacgcagactcttccggctacaatagcgacgccgccgacaaggatgctagcagcgccgccgcagcaccggacgctagcgagcccggggttggcctcatggtgccggccatggcatcgaggctggaacgctcgtgctccaacatcgagacggcgaggcgtggctcgaaagcgttcgaacttccggcgaagtcgctctcctacggcgacctcatggccttgcctgccggtggctcagccacagccaccccagtcggcgcgcccgacgacagcccagc

SEQ ID NO: 56799 - DNA, 681 bp, Oryza sativa
actgattttccgatccagtgcacgctaaaggcttgtgcatcattgccctaaactaaaagtactttactagtgctaacttttaaccctggggataatttcgcaatctgaaatttttatgtacatgagcgagatctggacgcattttatcgtcttcccggtggacgagatgagtttgctccaacctttgcacattcaactgtcagataatgcgtttccagctcaagattctaaagctgacatctcacttttagtccaatccatatgacgcaatggaacatatcttgcccgcccaaagcatgcaggcctctattttaatggacgatgcatgtcaattcattagttcccaaaaaaatcgctctttgtataatgcatgcagattagcctgaaagttagatgcgatatgcttcgcttgtggattttcctcccttggtgacattcatcgtagtcttattttgcagactttgctttcaaaccggtaagaatggagatataaaagctttacctaaaaatgacttttgatatattgtcctatttgcctttgtttttctacggcttatgaactgtaccaagctagctagaactttaagaaaaaatagcttatttccctgtaatcggttgctttcagctggaattgcagacactcgattacagagccattgacaacatgtatgggagtagaat

SEQ ID NO: 56800 - DNA, 1501 bp, Oryza sativa; identical to SEQ ID NO: 49257

SEQ ID NO: 56801 - DNA, 1501 bp, Oryza sativa; identical to SEQ ID NO: 49258

SEQ ID NO: 56802 - DNA, 1501 bp, Oryza sativa
tatatccggttttgtggttgagggatactattcatacacggccatgagttgagggaggtaaactggacttattccttttgtggtgctagaaggcccaagtttgggtttgatcgggaccgtgttggtttggcttgggtcgacgaattaagggcggtgtttggatctggggtatataggttgtcgtatgggatattcgggtactaataaaaaaactaattacagaatctgtcagtaaaccgtgagatgaatttattaagtctaattaatccattattaacaaatgtttactgtagcaccacactgtcaaatcatggagcaattagactcaaaagattcgtctcacaaattaatcgcaatttgtgtaattagttatttttagtatatatttaatactttatacagatgttaaaacgttcgatgtgacggggtgtaaatttttttctgtgggatctgaacaaggcctaacaacgccaaagtcctttagaaaggacatgagttttggttaggcacggtcgccgaagctcactaggccggtgggctgtggcgatctgcccccataaatccattgcatatcggtccagtatactgtatacagaggtttttaggagctgtttcgattgatgatattttcaaccataacattatttagtaaaattaataattacgtggttatatttagttactaaatattataaatgtgtatggaattttggctatattattaagccaatcttactaaaattttgacaatattattaatttgccaaaattttgctattgttaaattttgataaggtttactttagcaacaatctgaatgaacccttaaaatgtaaatacgtcaccatcaaacgtactctctccgtccaaaaaacaacctataaaggaatatgatctctcctaatataggctgtatttagtttcttccaaagttggaagtttgggttgaaattgatatgatgtgactgaaaagttgtgtgtgtacgacaggttgatgtgatggaaaaagttagaagtttggatctaaacacagccatagtaatctggacaaactataaagggtcacatctttttttttctttttttttacggagaagtaagcaacgatttcttgccgccggccgacaccaacacctcccatgggaatcagctggacagaaatttcccctggcgaagcttctgcgaaaatcaacagagctaatttcgcaaagaattacgggagatttttttctctcgagcaagctacaacgaaacttcccggaagatgcatcaaggtacgctttgcttgcatgtcccgcattttgtgttgcttcgcggaaattctgcttgttgaattatttgtcgatcggttggcacattccattttggcttttgcctgtatcttgccgccgtgaccgatcgcggaaagtcaagatgaaaaaacggcgttcgcatgaacgtgtgctaccttgtttcctataaaatggtttgcacaccatatagacgtctatatcagtgtatg

SEQ ID NO: 56803 - DNA, 1501 bp, Oryza sativa
tcccacgtggtggcatgagagcgtttataggaaatttaatggacttttagtatataaagatagatatttttttcaaattacacagcgctcccatggaaagtcgaacccaggacctcaggtgctactgaagctcttataaccaattacaggctctttcgcatattgagtattagtatgagtatgagtattaagtatattaatactcaatatttaaagtgttgcatctattgtttaaggttatcttttttacatattgaggatgctcttatgtatgtttaggccgaattcggtatatatctaattaatcataaccatatctttactgttcattttgaagaggtttttttatatataaatgtaagtcatgtctgaacacaggaatcagcaattattcgatgtaaatcacacaaggggtgtgtttagttcacgttaaaattggaattggaatgatgtgatggaaaagtgttgggaagtctatgtgtgtagaaaaattttgatgtgatgaaaaagttaaaagttcgaagaaaaagtttagaactaaacgaggccgccaagatgctaactagttcgatgaattggatcgcctatgaaaccctagcaaccgtgacacagcaaataaagatacgagaaggatatggatgcatggatgttggatggtggacacccactgggcagtgggcactggcatcttgacacgcaggtgggtgatcatgtgtcagcgaaaaattccattggaaagttgagacaattttgaattctatgtaagggtgtgtttaggtcgcgaaaaaaaaaaattgagtggtaaatcggtagtttgaccggatgttggaaagaggttttcggacatgaataaaaaaactaatttcataactcgtctataaaccgtgagatgaatttattaattaggtctgtaaacagtttacatatgtgagttaatgtagcacttattactaatcatagactaattaggctcaaaagattcgtctcacgattttcatgcaaattgtgtaattattttttatctatatttaatgcttctatgtatgtatctaaaaatttgatgtgatgtttttgaaaaaaaaaaactaaataaggcctaaatcaagatttcaatgtcacacagtgtgcagtcagtactcagctggagcacgtactggtgcctggtggaccgattaggaaaagaaaaggacgaaaaaaaggtttagcactgtgaccgtgaggagcatcagcaatggtatctcagacccgtatccctgctcacggcgtcggcgtcccgtttctgagccgtctcccagcgtgggtgcgcgtttgctcgcagagggacgtgcccctcgctcacttttcgctgagacacggcacgagggcgcgtgttggctaggcgtgtgtcccgtggacactgctccctcccccaaatttccccttccacccctcgccgcagcgcctggacacccctctcccatatttccccttccacttccgctccctcccatggacatcgagg

SEQ ID NO: 56804 - DNA, 1501 bp, Oryza sativa
tattgtgggcttggtttcagcccatacgaaaggagaaggccatgatgatgcggaattcccagcccatgtcgccaccgctttaggcgcagccgaccggaattcactctctcacgattcccgatgctcgcgaagtttcttttctccgtttctcgcctcgtccccttccacacgactctactaaaaaaactcgatcgtctctctcaaaaaaaaagactcgatcgaatgaaaagaggattttcttcttcttcttccccaatgagctcgttgagttctcgcttccatcgctactaggtacgcaccacaaccattgcattcttttttcggtttttacagtcctggttattcagctcgtatgctaggcagttagggtttaggagcggtttaaactttaaagctgtcaataaaagtttttttttctctatctaattgtgcttttggatttagggatttggaatacgctgcgaatgcaatactgatgtcttgaagaaaattctgaggaagttggttgcttggttcagtggaaacccggggaatttgtactgacttggggcacaggttcgcatccatctgcggtgattttgttctgcagtcctcaatgcgtggagagaatacggtgagaccaatgagctctttgcattctgttcaactcttgactgctctgatgtgctttgcaaaaggatgttcgatttgacagatgtatagtactctttacatctgaaattcctcgcaccattgagacgcatgaaattcctaaatcctaatgcgctttacattgattgatcggatacttagttggcgatgcttgtgatttcagtgttgctttttgcccctaatgtgtaatctgtatctgaccttcctcttgcatagggtgttaggcaattagtctaatgctgcttcctgtaagagcaaggataatagtgggctataagcaagctatatgtttatgtagaagagagagataaacaaaagtggggagtgttggctctcatgcaagagctaactgcacacaaactccaagaaatatgcattaaattcatggtgagagaaagagagaggatgaaaaaaataaagataaccttatagccaacctactatacatgttagctttaacattgactaattgtaattagtgagctgtactattaaacttgctctaatctgtggcctgcaattttccccttcgtcgtaagtcttgagtaacgtgttggaatatttatgatgcgattattacatgaaaccaagtttcgttaggatttgcctcagaatcaaaattggggccaatactcaataggactcatgttcagatatgatgttcacatttagatgtgaagcaatataatctaattaacatcctagttgaacttatctcatgttgcagtaatgcaagttatgtttacctcctgaaactcaaatgctggtcatatctaggcttaattatggtacgcctgcttgtagaatactgatgttcttggtataagtattaattttcaacaggatggga

SEQ ID NO: 56805 - DNA, 1501 bp, Oryza sativa
ggatgcacagctagcacggacgcactgatcgatcacgtatgtagagtagtacagtagagagtgttccttttccgtgactgggccgacacgatgaatcgatgggcggattttgctcgaagcgaacgcctcgcccaatccaatccaataatccaacccatcacccggctgccgggtcctacatgtgcggatcagagtcggacgcgggggcgaggcgagtgcccctcgtccgcccggagaggcagcgcacacggcgtctgccacgacatccgatgactgacgcagcggatggaaaaggagaacgtcgcgtcaaacggccgatctatccagcgaattcccccgtactccgcgctaggaagccgcacgtctcgctcgactcccccgcgcgcgcatccacggcgtccccgcccgcgtgccgagccgtggagcggccgcgcgcgagggcctctccgcgttcgtgacgctgcgtgcgtgcgtgcgtggtcgtgtctcgctctcgcgagtacgtgctgccgcgctgtgtgtccagctgctacctggcaacgtacgccttcgtgctggccggccgggcagcttcgattcttcactcctcacacaactgatgcaccaaccggtgagagacgtacgccgcgatactagttaatactagtgcattagctagctgcttttatgctcttctgcactagtagtgtgtagtagttccccgtcttgacagacttgactgaataattggtctccgcgaacatggctgcgatcaggtcttgactgaatactttggatcgatcgatcgaatcgacgattatgcatgcgcaggccggtcgtcgcatggattcaccgtcttttttctcactttccaccgatcggcgtgtgtgttcgttgaacaaatcaatacggattgtcccccctagtgctggatgatgatggtgcgctcgtacgtagtatgccttactacgttgctgacgaatttacttactgacaagcgcaacaaattactactaattaatttaattaattcgcagttagggataaccctaacacgtactactgtactagtacgctagatagtactggtacgagtacttgtgaagaactgtcgacgattgaagattgatagatttatctatctgctttgtttttctggcagagatcgagccatgacctttttaatttggagctagcaatcagcgattgctgatgcaacaacccctctcctcttgtcgcttgaatgcgtaggcaactcgtatatttatcaagttgtcgttcatgtacgcataaagcgaaaaaaacatcgtcagaaagcaactctataactgaataagaattaaggaaactagcaagcgttagtatatatcaaggaggacaaacccatcgccatccgagttacctcatgtccatgaaagaacacatttcatatccacaagcaaattaaagatgaaagataattaatcatctactcatgccccatttcagtgaaatcttgtttcatgcataactagtgctacat

SEQ ID NO: 56806 - DNA, 1501 bp, Oryza sativa
ctgcgccggggaggagaggagaggaaaaccatgcacacgcatctgggcttttgggaggcacgcttgcctggctttccccttgcatcgcagtactgcactactggtctctctgcctgccaatctgccatgtcgagtagcagtagtagtagtagtaccccccatgtgggcaaaggcacggcacgcagcggcagcgtggcgttggcccctacctcacctgcgtgtactggagttctcggacacggcgagaagccggagaatggatacggcgcaccgtccaaaactccatgtttcccgactcacgatgcgatggtggcgcagcaggagaatcacccgatccaccgtccacacacacatgcgcttgttcacttgctcctcgtcgtcggcgtcggcgtcggctccgcccgagacgcgcgcacctctcgtcgatctgctcaggtgggcatcagtttgacgacgcagcagcagcagcaggggagcgagggtgtgggagggcgcagacgccacgtgcaagtgtgtggcgcccatctccagcttggattgcgtacccgggcctcgtgccgcgtcctcctggattccccggatccaacgcctcctcccacagttcgatcgtgcgcctcacccaaaacaactcgcgcagttttgtaggaaccaccatacacacagcggtaatcccatgtcaagaacactgcacacccaaacaagtttctgaaacgagaactgagaggagaggaaggaattgcaagtggagaggagaggtgagtttctgaaacgagaaccagaaagaggaagggattgcgagtttgcaagtggagagattgattaatgggcatagatctccctttggattgaatatactgtactcaagagtagaaagatagccgtaaagtggtgttcgtgagatcattttatcgtaccaaactaattgcgcatgggcagagctgtgcttcgacttggccaccgagagatacacatgtaatcatatactacacacaacgcttaaattatttagcagacaagccgtaaaggcaagggcgagatcaatgatcatcccatcgatcaaccacctagcattaccctatatcttaagctagcgtggctccaaaagaaagaaaagaaagtgttgcctctttagtccaagcaatcgattacaaccatcgcttcgagatcgcaaagcggcactgggatctcgctaccgaaaaagaatatgatccccggcaaatcacaccacattagaaacgcataattatgtgctaaaataacaggccaggtgcaacctaggagtaccatggtggcgtatcaacagattatctcgtgccaaatatatgcgcggcttcagcggatgcgaaaatcaactgagaaagacctagcaactcttacaaataccccccactgaattagtgcatccatcatattggcaaatcatagcagggtgaattcctccttgcaagaaaatcaggattacttatacaaattttgcaagaaaatcaggattacttataca

SEQ ID NO: 56807 - DNA, 584 bp, Oryza sativa
acatgcaataatatataactatagttacaatgtaattatagtgtaactacactataactatattgttatctctatataaattacatataaagttgcatatattattttaatacatatatataagttattattagtatagtatagatctagtgaaattatatactatagttagatttgaaagttttctcctcaaacattggacagttttttagctagtccctttctttattgtttgaaaaagttagattttgtttctttatgtccttgtcgggttccgccagcatctggaatagagctaccaatacacatggaagtagatttttcttgtcactttcccctttttgtttttaaaagctataaactcgtactcctacttctttcgtggagtactacaataatccatactactccctccgtttcaaaatgtttgacaccgttgactttttagcatatgtttgaccgttcgtcttattcaaaaaacttttatgagatatgtaaaattatatgcctacataaaaatatatttaacaatgaatcaaatgatagaaaaagaattaataattacttaaattttttgaataaga

SEQ ID NO: 56808 - DNA, 1501 bp, Oryza sativa
tagtccctctcacaaaagaataagtcactaccctaaggacttatgtttttaagagaggggctaaagtttagcaactagagactaaactttagtccctctcataaaagtgtccttaccctaagaacttatgtttttgagagctcgcaaacacccccttaaaaagtctcatttctcagggcagtctttgcatggggcattgattgacctgaacaagtgtggtctgattggagtgggctggtagaaaagcagttgaaaagttgggcacattggacctaccgcccagtaccgacctgtccgagcctcggagacacgaagtggatgtgctgctgcgtgacgacgaccgggcgaccatgacgccgcacgcctccgcaccgagccactcgttgatggcgctgtatgccaaattcctcggcgttagcggtcaagcgagctgggctggggtgagcgtggttggttggtacaaatcgcgtttgaagtttccgaagctgcagacagattactcaaagtagagacgcagcgaaaattgaagctgattcctggaataaaccaaacggcatatttacatatgagaagtaaggtgttaataaaacttttatatacgtgttcttagcaacctaaaagcaaaaactgaaaaataaatttcgataaaaaaaccccaaaattagcttcaaatttaatgttgaaaatgtaaattttggctaattagtataaacataagcgaaaagatgaagccattaatttctccattactacctggctagctagctgtgctgtctgagagaatgtaatagtgtcgtgaactagctagagagagtatgcagggtgtgtttagttcctgatattggggagaagtttggaaaaaattgatagtttggaaaaaaaagttaggagtttatgtgtgtaggaaagttttagatgtgatgtgatgtgatggaaagttaggagttgggaagaagtttgatgtgaagtaaacataccgtagtaacgagctattaagtgaaagcctttaattttcacgttcggcgcagacagccagccagccaagccacaggaatctacggcgctcgcgcccgcaacactcgcacggcacgttttatctagcgcgcacgcaccggcagtccatcgatcggctctagcgacagtacgattattcagcgtattcagcgtattctgttcactgctggccgctgctcgcgtcgcgcacacgcagccggcagctcgatcggtggatcacttaggcccggtttagttttcaatttttattttctaaaaaagtcacatcaaatatttaaacacatgcatagagcattaaatatagataaaaataagaactaattgcacagttagaaaaaaaaatcacgatacaaatcttttgaatttaattagtccatgattagtcataagtgctacagtaacccatacgtattaatggcacattaattaggcttaaaagattcgtctcacggtttccagatgagttataaaattactccattcgtct

SEQ ID NO: 56809 - DNA, 1501 bp, Oryza sativa
cgacggtcgaaacactgtccctttcagttaccacagttcgcgacgcacacgcgctgcaaatccgccacacgggcacgaccatcgtcgttgtgttcttcgtctgcgattagtcagtgctcgtccgacgtggtcacgtggctgacagagcgaggcgactagccgaatgttttcatcaccctatccctgtggcttgtcgacgatggcaaacattttttttgtttggattagtacaagctttcatttgcttattccagcgtttcaccgggcaacacactctatgtgcatatgtttcggagtgcagccgttcgtattggtaaataccattattatagagagttttgcccggtgatttgtttgcctggcgaaaaaaggtagtataatgttttatcttgagagaaaaagttgtactacatggtagtagtatatctctcggctgcagattgacacgaacattacaacattgagtgaaaaaaaaaacccaacatctacagctacttcctctgcatgaggtgcgtgtgcaaggagagcttgattaaccgctaaagttcaccacagggacatgttcaccagacaccaagttcaccactccacagggacatgttccgcaggacgaacagggtcgcgtggcgcgtcaggcagcgccggagccggggtcgcggctggcggagtgggcggaggaggggacgacgaggatgaggcaggcggcgacgacgagggcgacggcgagcgccaccgcaacagtcacccgcgcgaagggatccacggcgggagcatgaggcgcagccgccgcggcggcggcgcctcgaacgacgcggacgtagcgcgcgagaagcatgttcccgaggactggcgcggtgacggcgcccaagacgaagacgcaaatggcgacgtcgtcgacgaggctccggccggagaggccgagcaggacgcggagcacctcggggccgcccaccacggcgcagccgagggagagaacaatcgccatcgcaacatcagaagccatggcgatcaagaagagcacgcacggaaaagatcaaaacaaaaattcgcaagaataccaaaagagaaagcagagtcctctgaaaagcctctcctctctctctctctctgccttgctcaccctgttcactgttaccagtagatcaggcaagaagtagagaagaacagaggaggaagaggttgtgcactggtgtgtgttgctaggtgtagcatttgctccgggtaatataggcgattcggcacctggtttgggcatggttaggtggtgacgcctcgttccagccaagtcggcacggcgcgacgggtcatctcggcagcgaaagaaaaaggtggattggagtgtggaggccattaaggactaatccgatctttgactgatttgatgtgcctgtccgtgtcactgtgttagatctccctatccatgtggttttgccatcatcttggcttaatccctatgctttcgaatactttgttggcaaaattttggcatggagatatgttc

SEQ ID NO: 56810 - DNA, 298 bp, Oryza sativa
tttttttcattcatactattcaggtccttagggtgtgtttagttcacgttaaaattagaagtttgattgaaattgtaacgatgtgacggaaaagttgaaagtttgtgtctaggaaagttttgatttgatgtgatgaaaaagttaaaagtttgaaaaaaagttttacaactaaactcggccttagactgcgaacatttcagcagcataaataatttggatagttggaatactgcatgcgttggagcgaccgggagggacggacgcgtacgagaggagtataatccaatagaaaaggtaa

SEQ ID NO: 56811 - DNA, 1501 bp, Oryza sativa
caagttgatgcattcgtgaatcgtgacagttgaggcagcaagccagcaacgcggacatgtttgtgtgtacacgaggaagtctcacgtactgtccgagagtgcacaaggctaccccagcgtcatcccttacatcacacaatttacggagaagaatttcaaaagtcgggtcgagagaaatcgccgacggtacacgtcaaggtctcctcgacttggtggctttccatgtcaatggacaaccgcactccctgacggccacctgctaggaccacgatcaggagctgggttaatttgcagcaaaaaatgcagatgtggtgtgttcaattgccgttgttgctcgcgctcagatacctgcaaactggcaaaatggccggcatggatactctattactcctgtccggatgtagggtctgcctgcccatcagatcccggttttatcaggttggaggggaacgtcgcatttgctcgtcgtcaccacacccatcgtgcgcgtgcacatgtgggatgtgcaggtcagaggcatcagtttcctagtcgacggctcacggctccaaaagcaattggctgccttcaaaaatatagattcccacctgatcatggaagatcttccttttccctacgggctccatcgctatgcttcggcttatccaccgaacttgtccttttgatttcagatttttcagcggaagcatttctaccgctgggcaggttatgattaaacgatcttctatgaattggtagttcgtagccctcctcgtgtatttctttttgtgtgtgtgtgtgtgttcgtactgggggtcacaggatcagcctctaccaacatattggcagctattacctggcccacgtaattcggctgaaaatctcacagcctagtcaacaaatcgatggggttcagctgagaagccacaaccttgtcgttatttttctccgtgtcttatcctcaagtagttaacctcttggcactgggcatattgatttggttgttgttattaggggagacaaagtaggggaggagttagctggtgttccccagcatgctacctttctttactttctgtcgtttttttgtttcttagtctgtaatgaactcgtattctttttagtaaaagcttggcgtaatgcctttcgtccaaagtaagggaggagtaagaaaacaaacgacagaatacgcattatacgacggattcagcttgttgctacgatcaactttactctcaccattatcttatagctgaacatatctccatgccaaaattttgccaacaaagtattcgaaagcatagggattaagccaagatgatggcaaaaccacatggatagggagatctaacacagtgacacggacaggcacatcaaatcagtcaaagatcggattagtccttaatggcctccacactccaatccacctttttctttcgctgccgagatgacccgtcgcgccgtgccgacttggctggaacgaggcgtcaccacctaaccatgcccaaaccaggtgccgaat

SEQ ID NO: 56812 - DNA, 1501 bp, Oryza sativa
tctttaaaaaaataccataagggtcccacatatttcagaaaaaccatgtccactatttgcatatttcttcaatacatgcatacaacaaatttattaattcatatgcaagcatatagcaaattgcgtgcatgtgaaccaattaaattaagcacttgatggtaaaaataaaacattcatcggcgatataaatttcttgaagtttcttaagaaaaaaaagatataatgcacaatgaattaaaaaatagtatatcttactttcacaatttgttatatctgtttaaaaaaaactaatacacatgcccgcgcgaatgcgcgggctacctttcctagtttcagaaacgatcgtgcggtatttcttttcctaattctcgtgattaaccactttgatctacaatcatgtcctcctcaatcctcataactgtccgcgtatatagaaactttaaaagttagtccgagcggtcgtcgctcagttcacaatcacacatggtctggagtctggacccatcctaaaaaattccacccaacccgacggaagataaagataatcggactttcacgctcgcgacccccaccaaagaataggcagcgaagaacgaaaaggaccgcgccgcgccgccctgactattgacctggtccgccgcaagaatataacgcagatggtgcaccaataataatcacaaaaccggtcagttggatttatctgccgatgtgtttctcggtatgagttggaagaagtcgggtggaacggattttcagagacgagtcgacgcacgccaccagaacgggcggcaccatttagcgagccactcgaaatatcgaatactcgatcggtcgaaaatgccgtcagacttgcatatttcgtgtgtgcaaacaaacgtaccactcctggcgctaagtacattcttcctgcaagttcagctttgccggagagtagagtactctggtagtacccgtagtccaagcgcagctttgccaagtttcaacgggaaaaggagaggctgtcgatcgtcctgccggatcgatccacaccacgtcaccatcctacctcgaccgaactcaacttggctcggatccactgaaagccacctgttgcgtacgggtaggtcgttgtgtttcgctttacatgtcagtcttgtggtgcctagctgggactgatgcaatgcaatccatctgaaatctgcaacgcagttcaactggtgcccgtgccaaagtgccattcttggcctccatcttttgtcttccgttctgcaatatggcaccgagctaagcgatcagccaatcatttcgatcgagatctaagtcgaactacaggaatccaagtacaagtagagtagtaaacagagttttaagtctctctttgtacacacgatcatatgaaaattgttcgattgtttgggttgataaatacagggaaagcgctggaaaaggagatatgctgactgaaccacactcacactctgcccctacatcgggtgaaaaaaaaatcaccttgatcgagtaa

SEQ ID NO: 56813 - DNA, 1501 bp, Oryza sativa
atctagtattagatttattgtttagacaaaggtagtacggccatgtttagttcccacacaaaaattttataccctgtcacaacgaacgtttgaacacgtgtatgaaatattaaatataagctaaaaaaactaattacatagattgcgactaatttgctagactaatcttttaagcttaattgcttcatgatttgacaatgtggtgctacagtaaacatttgctaatggtggattaactaggcttaataaatccgtctcgctgtttactggcggattctgtaattatgtttttattagtgcctgaacacctcatacaacacactatataatacccgatgttacacatcaaaacttaacacccctaatctaaataccaccctacgtctactaatgaaattgaatacggcattctttaggacacctatagtgttggtgggattagggccctgtttagtttcatgggctaattattagccacccaccttttagccctgaattagcccctaaggatccaaacatgtgggttaatttggggctaaagtgaattagcccccctcaaaacattagcctctccaaagagtgctaatgggactaattttctgtggggaccataaaaaaaacagtcctatcttcctccccccctctctctcctctctctccatcttttagccctaaactagctcatggatccaaagatattgtcccagactaatgtttagcctaccaattcaagactaaatattagctcttaaaattagcccgggactaatcttccaaacaagacctatttcgattgactcgagcgaacaaaatctcaaatcaatcgctacagtgtagaaattgatttgtgggaattcgcgtaaaaaaaatctcagggcttgtttggtttagggtcataccaaaacatcggtagtgccaaaacctaggtatgttttggcactattaataatttggtagggtagaatactaggtaatgtgtttggattaataccacttggaagccaaattttatattatggtaaagaaagttctagaattgtaccaaattaaccatgggcattactattcatttggcttcaaaccaaaccatcatatttactattcaaactaccaaaaaattggcatgtcatattttggcatcaatccaaagtggcccttagtctgggtggttctaacgggcgatcgatcgccaaggctatcggggagcgatcgattcccctccccctccctccctccacctggtttccttttttggcaccgtattactttcctattttagtaaatttatacacctcaaagtttatacaccttaagtttacacatctaaagtttagagaccaaaagtttataagtcaaaagtttatatatccgattcaaatttgaatttgaattcaaatatcttttttatatatagtgtcgacgtttgatgtctcaactatggtatttggacagtatggagatcgttggtactagagtatatgcgagattgaggtaaaagaga

SEQ ID NO: 56814 - DNA, 463 bp, Oryza sativa
catccgccgtggcacggcattcagcgccagctgacgtggcgttgaggtgtctaagttcagcgccaaatgatttggcgttgagcaaaagagtcagatttgaaataagttttggcgacggttcatttgtaaaaatagtttttgcaaagggtcagattgttaaaatttgtgccttttgcaggtatcagctgtgccgacttcttcagaatctgccctgcggcctccacttgatgtctgctgccttgggtggcaagtacccttctcctgttctaccggttagttttccttggccttgacacaatgcctgtattccactgtcatgccactctcccctcctgtcctgcactgcacggtggtctggttgtggttgctggtttggctggtgactttagtttctgataactctgaactctgaagtagaagcaaagacagacaggacaaggacaagatatgcctacttcagttc

SEQ ID NO: 56815 - DNA, 1501 bp, Oryza sativa
attcagttatagagttgctttctgacgatgtttttttcgctttatgcgtacatgaacgacaacttgataaatatacgagttgcctacgcattcaagcgacaagaggagaggggttgttgcatcagcaatcgctgattgctagctccaaattaaaaaggtcatggctcgatctctgccagaaaaacaaagcagatagataaatctatcaatcttcaatcgtcgacagttcttcacaagtactcgtaccagtactatctagcgtactagtacagtagtacgtgttagggttatccctaactgcgaattaattaaattaattagtagtaatttgttgcgcttgtcagtaagtaaattcgtcagcaacgtagtaaggcatactacgtacgagcgcaccatcatcatccagcactaggggggacaatccgtattgatttgttcaacgaacacacacgccgatcggtggaaagtgagaaaaaagacggtgaatccatgcgacgaccggcctgcgcatgcataatcgtcgattcgatcgatcgatccaaagtattcagtcaagacctgatcgcagccatgttcgcggagaccaattattcagtcaagtctgtcaagacggggaactactacacactactagtgcagaagagcataaaagcagctagctaatgcactagtattaactagtatcgcggcgtacgtctctcaccggttggtgcatcagttgtgtgaggagtgaagaatcgaagctgcccggccggccagcacgaaggcgtacgttgccaggtagcagctggacacacagcgcggcagcacgtactcgcgagagcgagacacgaccacgcacgcacgcacgcagcgtcacgaacgcggagaggccctcgcgcgcggccgctccacggctcggcacgcgggcggggacgccgtggatgcgcgcgcgggggagtcgagcgagacgtgcggcttcctagcgcggagtacgggggaattcgctggatagatcggccgtttgacgcgacgttctccttttccatccgctgcgtcagtcatcggatgtcgtggcagacgccgtgtgcgctgcctctccgggcggacgaggggcactcgcctcgcccccgcgtccgactctgatccgcacatgtaggacccggcagccgggtgatgggttggattattggattggattgggcgaggcgttcgcttcgagcaaaatccgcccatcgattcatcgtgtcggcccagtcacggaaaaggaacactctctactgtactactctacatacgtgatcgatcagtgcgtccgtgctagctgtgcatccatcaatggatcgattatacatgatgacataggatcgatagagagaaacaaaaaatgagatatgaacaacacgctatctgtatcacgagtcatctttaacaatatccatctcatcattttattgcctgccgaaaaatattcagttcagcctccacaccgctcggtcgccctgccccgggggcgacgcgg

SEQ ID NO: 56816 - DNA, 1501 bp, Oryza sativa
ccagctactggcacattcatcccaatccaatcctattaccaccatccggtccctcagcaagcaccacagccgcccatgccgcagcctgtgccacagccacaacaatcacacgctttcgacccaaatactggcatgtattacattcccatgcgcacgaatgcgcctcaggcatatagcatgcctcctggtgccgctgctgtgccgcctcccacccttgttgacactacaccaaaaccaaccgtgccaattcctcagatggccgtgaagcagcctgaactgcagcaacctggtttgtaccgaactaccgcagcacctacccctgtaccagcgtctaatgctcctgcgtatgctgggatgggctaccaccatgttattcaaacacaccatcatccagcgccacagcctgcagcgactgtggcaggcaattttggatatgactatggtgatcccacgcgagcacaggtcttctactcgcaggcagcggcaccaccaacattgccacctcagtatcagcccatgggctcgcccgatgctggccaggctgacctgaaacaggcccgggcttcatagctcaaggatttgtgaactctggtatgttgagaatcctagaagtgtagttatcctgccgttaattatcactattgttattacatgttacatgagtcagttggcaaccagtggatggatgatggcattaggcagctgtgcatttgggatcaaaataagatgaaaatgggatggtagttcttgtgttgggtgaaactcaagagggtgtttgtgattggttctggagatgccaatcgccaatgctggagcaagtggcggggagtggcttccaattccaattgccgtcttcttattttttaaaaaaataaatatatagtgtctaaagaactcggtacaaattctgaatcaagaactcatcatttgtgtagccctttgtatatttgaacctggaagttattgaggttgaaatgtcagataaaagtgtcattactttgcttgtagaaacttcatttgagttaaatatcatatatatacatcattcctgtctctgtattttgccattgatgttgatatgtttcttatggtttattacattgacttgaatcttgctgctattgggtcatcacagttccgtgtgtgtttttcctttgggccagttgcttttgaattggaacttattggctcgcaagtccaggtgatttgtttcttttcaatgtatatcgctttctgtagactgcccgcttgcaaatcaagtcagcatgaacatctatcctgttcattctataacgtaatgttacgggcacggagacagaagattgtgcatttatatggactgcgagccttcagtatcagtcccatgtattactaggttatcaaatgagcatatatattttttgacgcaaaaaatgagcatatttgcttagctgctaattcattactttttttactgtggatttctaatttgtataagtaatcctgattttcttgcaaaatt

SEQ ID NO: 56817 - DNA, 1501 bp, Oryza sativa
aattattaaaccaccatgacaaattgacaaagacacaatgcctttccccattagcaaaagtaggagtatactatggtgccaatcacatgatacacgttagagcagacggccgcagcgtcaaatatccgcatctaacctcataatcactcactgtatagcagtagtagtagcagaaatagttcgtctctttggtcccacattaaggtgtagggtgcggttgttgcgtcgtggagaaaacgatgcttttttgctttgtaaatcatgttgtttagtaagtctaatgggtcatttgcattgtatagttgcagtactactagtatatcgttgatcagtgcgttcttatctgcttatcccttaatctggccttgggcgtttgcaaggggcaggttttacacaggcacagtgccagtgacagcgtaattaacgacttaatcacactgttttttctctcccgagtacttaattacactttgttagtgctaaactgctaattatttgtttcggccgacggcgactggccgcggaggaggaggtggttgccgacttgccgtcaactgagacggacgttttggcgggagtatcacgggagggcccacctgtcatcgagctgttcagggctaatcgccacgtttcgacggtaacccggacgtcaggttcggctcgctccacgacgaaacgcgcgacggacaaaggccacgtcagatggccctgtaggtcacaggcagcgcgggcccacctgtcatccgcgtggcccacgtgtcctcgacggcatcgatcggggcccaccacaattacaggtgggacccgcaggaggtcccatggcactgtttgcaagacattgttgccggcttcctaattttgttttctgcacgcttttaaaactgctaaatattaaatttttaataagtttttatacgaaaattgtttaaaaaattatattaatttattttttaaaaaattatagcaattattaatgtaccgctccgttttcatttttgggttgggaacatgttcatgcgaacacacctgttcacgaacagtatacagtacttggctgtagcgggcatcttgtcctggcatgtggggcccagtagcagtgacggggacagatcacgtgggcccacatgtcagtgtaccatgtcaaacctgcgcaccaactcctactctataaaggaaaaactcgtggtcgtcttcctcctcgagccattccacaaaattcggcaaaatccagtgctccagtcagtggcagtggcagtggccatggactccgccatctccacctcctcgtccttctcgcctctcaggttgtctcagaatcatgggagcatcatgagcggtagcaccagggctcaggtgctcccggtgggcaggcagcagcagcagccacccgccggcggcgccacccgcctccgcgccgtctcgccgtcgccgtcgccgacaccgcccgcgccgcagccggcggagacgttcgggttcgatgccctcaaggaggccttctccg

SEQ ID NO: 56818 - DNA, 1501 bp, Oryza sativa
  unsure (1)..(1501): unsure at all n locations
ccttttaatattgtataagtctaacttcattacaaactttgctccagtagtcgctcaccggaaaagaggatgaacttattagagttagagactttgagaagaagatggccgggacatgaatctcccatatcaaattgatacatatactaaaatccgactaaatttcactaaaatgttgaaaaacaagcaaacaacttgtgaggatgttattagttgggatatatatacaaaatacacacaataatttctttagttctaggataaacggtgaatattgcataaatcaaagttgaactaatcatcacaactatgagggaaaaaatggtcgaggagattaagtgattaaatcgtttgcaatccgtgacaaccctgaaagggacatgttaaactagtgctggatgccatcatggaaacaagataaacgtgtgctaggacatacaagctaacaaaagaataaaaggaaccatatggtttttaataaatatgctacatcattttatctctgtggatattatggatttttttaggtccataattcacaacaatagaagtaacaacccatatcatatgccccgatgcttgtctattgatgtggcaactatctctttgctttggttgattatcctagttattctgtactacgctgaacacaaatacatgatggtttttatgtgggcgtttattcattgagttctctatgatttggttcatttatagatctactgctcggtgacccttgacattctattgggcttattggctcacctttgatagattcaaatgctagctctttgtcccaagggttttatagtctgcattgctagcttatatgtgttttatctttgcactagaaaaatttctaggtacacctcttgttttgacccgttatcaatgtattttaagcgaagttaaatattaatatatgcactagtgaactatatctcaaccaattgacaacaaatttatggagggaacttttaagtgtgccacataaccgaaaatatgggtaagaagatatttaaggaagaaattgctagagctcaaatttaaatattgtaaactaatatacaacctcttgttaaacaaaacaaattaaattgtgcatggagtatggcgtcagcaatatatnnnnnnnnnnnnnnnnnnnnnccatgcaatttgccgatttaaaatttcagtagtaagtggccggataactgttggaccaaaattcggatatacaacgtgtatgtacttgataagcatactcatctctaagtagaagatcagcatatgcctattagcaagaagcatgtactactgtcttgggtttgattgtgacaattagttgcgttgtttatgtaaaatttgacaaattctgcgatatgattactagtactactccagtaggtttgacctctaggaatgggaatggagtactcagtgccgacgtgtttggtggttatccaagggaggctgatgcggccagtgacaagcgtctgatgtgtcggtctgagtgcgt

SEQ ID NO: 56819 - DNA, 1501 bp, Oryza sativa
ccaaattgcaatggaagttcaatgcactggtaggagccgaatctcttgctggatgtagtcatcactcatcacgtgacaaacaaggccttttttttcctttaaaaaagaaatcaagtatgctggtatctactactacctctttctttaaaagaccggccgtctgtatgggaagacacgtttcccccaccagcgaaaatgctttttccagtagtgtaatatgctagtatattgtaacggatgaaggccgtattattagagatgaactaaaagtattacagagaataatatattggatctggtggttacacactgaagatacaaatgtgttgcgcgtggtgggataagagaatgtaaggagaatttatagtagtagagataataaaagaaaaggagggaaattaacaggcaaaatcgaaaatgcacgtattaggccctgttgttcgatcggtggtttggtcaggccggcagcaaagcatacaattcaacgtgaattggcgatttgagactttcaggcgttccggcgacgcagcagtcgcagccagctggtactgctgcggatgctatatttttcgtcggtcaacgctaatgtagattgaaaaaatacggtcgtagaagccctatccctccggattgtatttgtacacagtacactctccatgaaaatatatagtctactcaagcttttggtatttgctccaatctcatacgaactacggagcaataagatatgcgaaacaaaattgaaaatatactttattttttcatattttgcgtttatatacctggctgtgattaatttgcaaaaatatacctaatccgcggaacggatgcgcgggagcgaggacgaaccgcagactgaggatgcgggagcggaacccgagccggtcacgcggaaccgggatgcgcgaccgagccggtcccgcactactggactgcgggaccgagtcggtaccgcgacgccattgcgcgggagcgatggagcccacgggatagcgagtcggtgccgcagaacagcggcgcgggaccgaggctgtcccgaggttccaacgcgcggaaccgaacaggccgcgtgttgttggagatgtattcttcccctaatttttccaactcatccgcgcgcacgcttttcaaactcctaaacggtgtactttttgtaaaaagtttctatataaaagttgtttaaaaaaatcatattaatccatttttgaaaaaaaatttacctaatacttaattaattatgtgctaatggcttgctccgttttccgtgcataggagattggatccaattcgggaaccgagatggctggcggcatgtgggagcgccggtcccgcacatccggcatgcgggagcgttgcagcgctcacccagcccgcgggaccggcgcggtaccgcgtccccggccagcgggaccggctggtttatcctcgctcccgcgcaaccgttccgcggattgggtatatttttgcaaattaatcacagccaggtatataaacgcaaaat

SEQ ID NO: 56820 - DNA, 1501 bp, Oryza sativa
tgcatgcacggactgatcatctggtggttgtttttttttttttttgggtcaccactcgaacaccagtatgtgacgatcgtcttttctctctctttcttcacaggatcctatcaatgtacgtcgtcttaatgcatcatggctttatcacaggatgctctccatttcttttcccatggatatgcgattcttttctgttctttcggtgagtacgtgccatgtttcatgtacatttgctcacaggttttctgcatcaatgataagcaccgtgcagcacatgacctaggccactttgtttctatggtaagcgggaaggattaatgcatgtaatgtatagagatgggactcgtttttttatttatcttttttttgcctttatatatgtagtccaaatgtagttcaatctttatatatagattgaactttcatattaaatctgttcgaaagagttagctactgcagcgctgcctgctgcgagcctgcgacagacaacagtagctcagcggataaatcagtagctacaacagatgaatggctaggatgtagtctagacctgtagccgagtagccgagtggctgcgctatcccgtgtagcctgaacagctacataacaaaattaccgaataacctcattgtatttggtgtgatctttatgggtagttgagattaactttgtaaaacaattaaggtatagaaccggacgatagcttatgtttggtggcaagataataatgtaggttgctttgatactcctatgtcattcaattttctagagtgggcacaaaacctttttccttgtttggttgagatgcgtttcattatgaatcttatggttgtaggcatctacataaaaaaaaagagcaatcgcgacaaatcatttttatcaattgaaacaaaaaaaaacgataaatagcgcacacgaaaatgacgagagggcccaacgacaacgacacggtatccgaacttgcaccaattccacctagcaggagctcagagaaagagtagtcgactagtcaagtggtggtggcgcggcggccgccactccctcccctcctctcttcctcggtgccgtcgccagctgtcaaggtccacacattaaaaagggtggggacccttccagctcatcagccccctgacgtgggcctccctttcgcgtccccgtccctcttccactctccaactctcaccgccacatacaccactcgtactcactgacatgtgggccctccaagggatggccccacgtgtccgcgtctaagggggaggaaccccgaccgtttcgtggtgggccccacccgctccacgccgttttgcggataaataccacatggagaccacacgtttcggtggagaggaagcagtgaaagattagcggcggtgcaagagaagaggagagagcgagacgtcgcctgcgatgacaccggcctcacccgccgccgacaccgtcatcgccgccgcagccgcagccgtagccaccgtccggagcgaggagggagagcgccaca

SEQ ID NO: 56821 - DNA, 1501 bp, Oryza sativa
agagaggagctctgtctacgttgcccctgagcttgagctcaagctccatctgtggccacctttgctagctgcgtgcttgagcttaacctccgccttccatgccccatgctcgagctccacttgcaccgtcgtggcgcctcaacagccctgctccgtagctactcttttttcttccatgtattgtgctcattgctcttgcaacagtagaggcagcatgatctgatctagtgcttgatctagtcataagctcctaatctagatgctcaagctcaagggaaacaacagatggacagctagactgctataggcaaactggaaagagaagtggagggagcgatagtggggatagggatggactggtcttgaggaggaagagagaaggggaagagggagagacacacatggtctggctgacatgtgggcctcttgtccaaattgcatgctcaagtaactatagttggttgaaagtgaaaatgtttgataacacctagttcattgtgaaacatgggtaagaaaacatagttcaagatgcaattcactctttaaaatatcatgattttgttttcttgaacatggtcaaagtcgcgatttcctttactacaccgctcgttctcgatggcaaaatactacattttttaggtttgatccaaggactaaaatactactagtgctgtatacataaggattaaggggtgaatatgcaacgactgtgactgtgaggcgtgtacttcaacagacagatttcacacaattttgtacagatacagtgtccaaatttatatgcacccatgtgagccataaccttatggcctagttaatttaattaacttgtgggctaccagtacagcagtaatatttttcttagctcggatgcattatcgagtttaatgcatccaaaaaataataattccattagtcaaacggcccttcgatcgcaccttatgctacattccttgatcgaattaatcataacctcccttgctgattatatacgctttgctttaatttgttttggaagatactatttgtttcttcacagagatcaattatatagagtatgtactctctacgtactaaaatataacaacttttaacactttgaatttttctcaaaatataataatgttttcatcaatatttccttatcaatcaatcacaacatctttctatttagtttatctaatttttgtataatattatccaattgtaaaacttttttatattctaaaacggagaaagcggtaactaaccaatacgtcacatttaatttttgatcgagatctaaccgctcgtcgttgaggtcaacgtagcacaccggctaacttttccggcctccataagacaacacatcagcatgtaccagtacccctccagaaaaagaaaagaccattctcgagatgacctgatacttaactgctactacatcatcgtcaccgatcagtcgtttggacttattgaagaatagttaagttaattcatctagtgattaaattagcttgac

SEQ ID NO: 56822 - DNA, 1501 bp, Oryza sativa
caagtgcaaatgaatgacatgcagagaggagttttgtgatcatgctggcatggagattgggcaccagactactggaatagcgcgcatcggcgcatggttacaattctttcaggaagacctaccagaaatatcacagggtaaagcagttaagattcttacaggatacataccgggaatattacatgattcataccaagttttttttttttcattttgagaactattcatactaagttaatgccaagaaacatacagtaaacttgtcatttgtcaagaaacatacatacagggccggaagaatgggtccaagctgatgtggatgcggttttgaaaagtccatggtttgttgtcgaacatatcatttgttcagttcccacttgtgggaaaagtcatcagtaaggttccttctgtacttgcaaaggtcaagattatttactacttaacttggaagaaagaggagaaaaacagtgttaattttatcttcttttctatctctttatcaattcactcatcttctgcaactgagcacataactgctttgtagcacgacttgaaaaggcacaactgattgaaaacaaatgtataccttgcaggactgaaatttgcgagaaaagaaaaccaatcactcagctgattgtaaattgctgtacatgataaatttacagaaaactctatggtgcatgattcttcttctccttcaggcccatcaagcacactggaggtcgctggttgatttcaatgcaaggaccggaatgttccatgtcaccatgtgccaccttatgcctcgccggagcatactggttgcccaagattcctagtcactggcagagcatatcagcatactgtcatggacggaccagcttggtagtgataggtacaacagattctttcctggatcatgctgacgacttgatgaaatatacaaagttcgagatctgccgtgatggagcactctcttgtgaatccaagaaaggacatcctgaaaggtcaaatcttttattcagccgtgctctaatttctttcttggcttttccctctgatgaattgccccgtatgaattcggatagtgccacaggggattaagatttaagacccaaatccttctcaaacctgaacagaaatctcaaagaatccccaaataacgaggctatgacaattgagagacacaagcagaagcaaggccgagctcacgatcaccggcgactcagagagccactcggcggtagacaaggattatgccggtgaaataggcggcggggagggcgaggcggaggaggtcgccggcggcggcgtcaacggcacggttgcccgtgaaggagccgttctcgagggcctcgataatcggtcccaggaagccggcgcagccgaccgcgaggcagagaagaagaagcgcggccgcgtcgaggtgggacgccatttgtgttaggtatgggcacaatctggagatcgagctaagaccgggaagaaattggacaaggtgcgtgcagcgatgcagaaaatg

SEQ ID NO: 56823 - DNA, 1501 bp, Oryza sativa
gttattatctaaccatccgtttcaaacacataaacccacttggctgagctgattttaaatttctagacttggttttagaattaattaagatatttcttcatcatgtcctttgcccattctttttacaaggtcagtaagaaagaaattaaataaaatctatctctaattatatattctaaaaacttactttaaaagtcaaagcattttgaattatattctgcagcaaagccaagttcagccaaataatgtagctttatcaaccgactagccgtcgcttgataacacacacaaaattttctgtgtggattgagctttagaatactcaaacatagcttttttaaaaaaattcccctgaagttgacactcagacgcttcacactgctatggattctacaattcaaattgctcttgagttcttccaaggtccgcttctttttgtgtggtcagagagctgaaaccaatgggggaattacggtgtgagcttcttagaccttgcatatacttgtcttaatcaaatcatcctcaacgaaataaattaatataacacatgtgtagtgaaacaaatcaagtcgttttagctgcgcgagacagagaaatggtgatttgaccccctttttcaatcccaacataatctcagaaaagttgtgaccggccatgtttattagtttgaggccatgaaagcgccaacgcagtgcgctttcacgatcttaaagatgacaagcgtaggggaattttatggtttttcttgttatactttcaatttttttaggctggaaagaacgtagaccagttcagaatcaactgatcaagatgtaccatgcagttcaacttcaacaccactgtgttactatttcaacatacaccatggccaaccatatgcagttcaacttcaagttcagtcatgctgattgataaatatatgcatggcattttttgtgttactcctctagttgagctttatcatgcataccatataggcagaattatccaaaagagtcgatgttgaacggtcataatctttccaattgatcggtaaaccattcctcaccatatccttgtggggtgcagatgatgactaaacttgaaacgccaccttcacccagcttgttgcaatcccctaccaaatgcttatctgaacttggcattatcttcttgcttagtcaccattttcttttttgcattcacagggcttgcctgccacatgtcattctcagtttgttcctgcaccagcttcaagtgatccatgcgacaaatcaccagtcatcaacgagagggaagcgtagatcgaaacaaaggattcaggtaagccgtcatgtccaagctttagcggctgcgtatccaagcaggaaagtgcagcatttgcacaccagacaagttcaccttccaatatacgcatgctgcacaaaaagaaaaggatgaaagaacaacctgctacattttgattccatcacgagtctttgcaaacatttgcagaaaaaaatagtgctacaacatgaacata

SEQ ID NO: 56824 - DNA, 1501 bp, Oryza sativa
ttgtttaaaaattcatataaatgtaaattttaaatttattttatctaatacttaattagttatgtgctaatgagtcactccattttggtgttaaggaaaagttctcaactggagctaccaaaggcagacttataccgagttcatccatggatgggcccatacacacagaaggcccaaaaagcaatacgtctgtacgctggctcggcccattagactaaccaccagacagaccaagtaaaccacagccttcgctacgaaggcaggcaaatccggtccaaaacccaaacccaacccaacgaccaaaccaccgaccggccgttccactgcgccattccttccttccccccacctcctcgtcgacgcggagatcgctcgctcgccggcgacggcgatggcggcatcggcggcggctgcggcggcggtgagccaggcgctgagggaccgcgacgtcctcgacgccgtcggcacctccgccgccgcgctttcgctcgcgggctcttccttcatcgtgctctgctacctcctcttccgcgagctccgcaagttctccttcaagctcgtctacttcctcgcggtctcggtgagcggctcagatctggaactacttggttttggggggttctgggttcgggaggctagcctcgtgatctgcgtaactgcgttgggttgcgatttggaattggggagcgcaaagtggggatctgagggcagtgcggtgttcatttcgcctccgattgagaaatattgggggttcacgccgtcagtttaaccaacggatgctctgtttttgctgcttatgcgtgcgagctgaagcagttctcgacaattttttttttgtaagatgtttgctatctgatcggcacttgaagtagcatagggcatgctccattttttttttagtgaaccgtgtgaggatgtttatgtcatagacccttacttcaatgtggcaagtgatgtccctataagtatccatgtaggcaattgctgggagatcacatttcgtgctactgtcttcttggattggaagtacagttggtttgttatctaattatcatgttggtttgttaatattattaattgctgcaagacaagctgatgtctctaatctcaatttcttcaagacatttggaaatttgtttgagagaaatgatatcacatttctattcaaggtgtttttctgacagcttctgtctaaattgcaggatatgttttgcagcttattcactattatggggtatgcttctgactgtgttattcaaattgtatttgataatgcacgtagttacttcctgacttaaataactgcaactaatgtaggagaaagtgtattactgtgaaggaaaaaacatattgttctttattttgttatttttggaactgttactcatgattacccctttttttgctgactttctattatgcgctagtgaaatattcttacacacatgcttttcatattgcaggggcccatcaaatgcattctactgttttgctcatgact

SEQ ID NO: 56825 - DNA, 1501 bp, Oryza sativa
gttgtcggaggaggagaagaagaaggcggcgccggaagaggattagaaggctgcgtcggcggagtcggaggaggtggaggagaagtcggcggctacgtcgtcggcggaggagaagaagacggcggcggcggctggcggaggagggggacgaggaggaggattaaaaaaaaaaaaactttgcttactgtcgcggtagcattttctgcatcgctgcacgcaccttgtccaatttcttcccggtcttagctcgatctccagattgtgcccatacctaacacaaatggcgtcccacctcgacgcggccgcgcttcttcttctctgcctcgcggtcggctgcgccggcttcctgggaccgattatcgaggccctcgagaacggctccttcacgggcaaccgtgccgttgacgccgccgccggcgacctcctccgcctcgccctccccgccgcctatttcaccggcataatccttgtctaccgccgagtggctctctgagtcgccggtgatcgtgagctcggccttgcttctgcttgtgtctctcaattgtcatagcctcgttatttggggattctttgagatttctgttcaggtttgagaaggatttgggtcttaaatcttaatcccctgtggcactatccgaattcatacggggcaattcatcagagggaaaagccaagaaagaaattagagcacggctgaataaaagatttgacctttcaggatgtcctttcttggattcacaagagagtgctccatcacggcagatctcgaactttgtatatttcatcaagtcgtcagcatgatccaggaaagaatctgttgtacctatcactaccaagctggtccgtccatgacagtatgctgatatgctctgccagtgactaggaatcttgggcaaccagtatgctccggcgaggcataaggtggcacatggtgacatggaacattccggtccttgcattgaaatcaaccagcgacctccagtgtgcttgatgggcctgaaggagaagaagaatcatgcaccatagagttttctgtaaatttatcatgtacagcaatttacaatcagctgagtgattggttttcttttctcgcaaatttcagtcctgcaaggtatacatttgttttcaatcagttgtgccttttcaagtcgtgctacaaagcagttatgtgctcagttgcagaagatgagtgaattgataaagagatagaaaagaagataaaattaacactgtttttctcctctttcttccaagttaagtagtaaataatcttgacctttgcaagtacagaaggaaccttactgatgacttttcccacaagtgggaactgaacaaatgatatgttcgacaacaaaccatggacttttcaaaaccgcatccacatcagcttggacccattcttccggccctgtatgtatgtttcttgacaaatgacaagtttactgtatgtttcttggcattaacttagtatgaatagttctcaaaatgaaaaaaaaaaaac

SEQ ID NO: 56826 - DNA, 1501 bp, Oryza sativa
gttagtgggtgattaaataaagataatggaattactaaaccttcatgcaacacaaatttcggaaccgtcgaacctgtgcaaatattcgtattggcctcattttcctcatgttcctatgggtcatgggctcatggtagctccaacaagacagcatcgacccccgaccagttatagttcttggttaggatcaaggtgaaagagggtaggagagacaaaagaagggagtttctcgagggtcagagagatggttgtgggtggcggagaatcccacgatgagcggtggacttggacaggcgcggcaaagcgggtggcaatgtcgatgcagcctcagggatgggctgacatcaacaacggagggcaaacacagagtgactaattaggtgacaatgactagcgatggtggatttagcgacgaagagccattgccagagagaggggagaaagttggccgagaggcctcactagcgtcattggcgctcttgggtaaggtcaggcgacggtaccagggaagaggcaggccacgaggagaagggttcttgtcacatcaatcttagtaaaatggtggcacgaggttgaggagagaggagttagggttgagagggcaccgtacaaatctcaaaacaatctaatttttttaagatttgggagagattactcttgtcttgttgcaagttttggatcaattattgtgtgtaacttttgaaaccagcttaataaatctattaatttttttgagaaacttgcttattgttggctaatatggttttacatatacaataataaatataatactactatgcgtatatctctaccattataaagattaaaaaagtttttgccggtattttggtacgtcatccatatttgaatcggtttttaagtttgttcgcttttagaaatacagatccatgtatgagttggattttaagttcgtttgcttttcgaaatacagatccgtatataagtcggctataaaaaactcgcatgttaatttaagatgatagtcggaatcctaattgcagctcatgattttttaaaataaatatttaagcgaatttccacaatgaatttaatcctagctcaaaccatataagaataataagactaaaataacattaactcgttgtaactcaaggatatttttccagggaaggaaaaaaaagaaaaagaagcaacaaagtcctttttgtggtacagtttgttggactccgggacaggtgtcagccaccccttcaaccgaaaaaggctcccctgagtcgtgacgtgcactcgaaagtcgaaagcgaaagaccagcccacgcccacggccagccacgggggaaccgtttcgactcgaatatacccatcgccgccatcactgatccgccgctccccatcttctccgcctccgcgatctcgccgccgccgccgccgcccccaagctccccactgctccccgccgacgcctcccccgaccaggagctccccgccgacgagcgagcgagcgagccgaggggaagga

SEQ ID NO: 56827 - DNA, 1501 bp, Oryza sativa
ccgagctcgccagatccgtcctcggtcggcagcgacgacgacgatggtagtggtccatctttccttcctcccttctctctggcgagctcgggtggtggcctcgccggcgacgaccgccgcccccttgcacggggccatgccctctccggcgatgctctcctctccccggcggcatcgggcggtggaagcgaggcagggttgggggcggcaggacgacgcggcccacgagtgtgggccccacctgcgaaacaaaggaggaatggagagccaaagttggcttcgcggtcttgggcaagccacgcggattgccgacgtggggacgaatattcggtttctaggggtgaggctgaatgccacatgggagcattgtgaatggcctaatcgcgatgcctgattaatttatggtacatgccgtaatcagttactagcaaactattttcttctctagtgtagtctgtaggccgatagaaccgccctcaaccaatcatctcttattataacccactaaattctaaatcttaacaggtaaaatgtcacatcattatccattaacaattattatttaagcatcatacaaacatgctatattatctataattttataatttattaaattttagagatataaaatacaagcatgttaaatcatcccacataattcacataatatttcagtatatatctccatcattttttaatgtttatattgtttaaggtatcttacacattatttttttgacttattatcatcatagtaaactcccacagcaatgcgcagggtttcacctagtcaatatggaaattgttggcgcctccgaaagtgcaagttattctcatgactcgtcattcaaaatacagtgtggacgacggacagattggaacgaagagggtggcaaaatcagaaggtttgcccgttatgctatatggccgacgagtatgcggatcatctactggcgaaatatagggccacactgacatacaattggataagtgggatgaccgttactcagtcaaacactggtggaacctagtgcttgagtcccctaataaccccgtctaccatttcgaactccggtgatcctagtatcttgggaagtatggtgcaagcgtaatgcaacaatcttccgccacaaagcctcaacgccggcctcaatcctagccaagagattaaggaggaagctggagcataggcgaaagtagaagcaactagactctaagagtttggaattttaggagatatcatctaaggtttctttttctgggtctatcattctttacaagctctgtatatatctttgtatatttttctcctactctatattgataggaggcaaagcttttgccactattggagaaaccatctttgctgggttggccaaaaactacaatggccccggtttgaatagaaaccgggactaaagatgattttttgtcccggttttaaactttataggccctagatgatctttagtctcggttcattttttgtccgaggctatac

SEQ ID NO: 56828 - DNA, 1501 bp, Oryza sativa
attttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccgatgcataagttttctggtctatttactctttttttcatccataggtaaaaaaaaatatcacattttaattctaattataccggctccaaaatatatatgcacgcactgtgtttgaatcctaatcacctgatctgttgattgatccttagtatccatctaggataaggaaagaatcaaagtaggagtacgtccacctatttggacttgtattctagaacttgatcagtgttgtccgtttgatctagcagttgttttctattcagacttctattatcaaagttaatctacaccatcaaagtctagtcccagtataatctaacagtctagatttttcttttttctctgattaacgtgggaatttctagcccccacagcgaacgtggtgactcctttcaaagctgttttaataatataactagctgagtggcccgcgcaattgcgcggctagcacccatataaaatttatatttttaatacctttactcaaagtttattaaatagttatctcgttgtcttaagactttgaaagaccaaaccttatcatcatcgtgtttctaattttatagtttttaaaagccacatcagttgctaccccttacttctgtcatatccttctttatttgcttgctcggtctaccactgtttctattcaatctctttggaacctttaaaaattggatcttatagtttttagagtttattgtcctgttgggttttatttttataatttctagaagtcccgtaaaacgctgccgccattatactcctctacggccatccactgcatcttctttttattgtcattgttattttaaaaatcgaacataattatcgttttgattcatttatttttactttctataagttccagcaaaacgtcggcgacgttgttgcagtactcctctacggcttgccagctaccgcctttctttattgtcattgagattttaagatcaaacataattatcattggggtttatttattttactttttagaagcccgaacctttaaaaattggaccttatattttttgagtttattgtctcattgggttttatttttttataatttttagaaatcccgtcaaaccctgccactattctcccttacaacctgtccgccacctaatttttattgtcattaggattataaaaatcgaagataactataattggaatttattttttttactttctagaaatctcaccaaccatcggtggctttgccattgtactcttgtacgacccacctgttgcctctcatttttattgtcattgaaattttaaaaatcaaatataattatcattggggtttatcttttttactttctaga

SEQ ID NO: 56829 - DNA, 176 bp, Oryza sativa
tttttttttcttatctggttttataatcccatatgttcaccgccgttatatcgatcgtgcgttttctcccccaatttgatttcaaaaatcaattccccactcctctctcatcattttctctatgattttcccttcgattcggctttaattgccggatttaatctctgttttatagt

SEQ ID NO: 56830 - DNA, 1501 bp, Oryza sativa
cgggtttcattttcaacccgtcacaggtgactagttacctgtgacgggtcgcagccggatggctcaccgatgaaagcatcctgtaggacccgtcaaaagtgacatttatcactgaccaacacttatgcccatcacagatatgctgttaaagctatgaggatctggcgtagtgcctcttgaaaaatttcctataattctatctctctcatcctattcctatgtttttcctatgatccaataaaatgtttattcatgtgtttttacaatcctctattttgcactttcattcctgttaaaattttttgttttttctaatcctacgtttttttcattcatactattcaggtccttagggtgtgtttagttcacgttaaaattagaagtttgattgaaattgtaacgatgtgacggaaaagttgaaagtttgtgtctaggaaagttttgatttgatgtgatgaaaaagttaaaagtttgaaaaaaagttttacaactaaactcggccttagactgcgaacatttcagcagcataaataatttggatagttggaatactgcatgcgttggagcgaccgggagggacggacgcgtacgagaggagtataatccaatagaaaaggtaatggtcatcacgacgccggccggactcgtactgtcgcacgcccatctctcgctcgcccaatcctccatccgccacggtccggtccagtcccactccggcgcggcgcattggtacttgcacatactcccatcgccgagctatcgcagatagaccacgcacgcacagggataagtcaactcatcacagggctttgtggcgcagcagtagccggagtagtatcacagattcacaggaccatctcgtctcgtctccctcctgtttgatccgccgcacgtcgcgtcacggcggaaagcagattggattggcgtcgctgcccaatcctgccgaaaccgcatgccaccacctggcaaaaaggatgtcgctgccaccaccccacctctaaatttttacatgcatatggacttttactcctacgcgagaaaatactcctactgcttcgggtgtgtttagttaacgttaaaattagaagtttagttaaaactgaaactatcagggttatgtataacacatatctaataggagttgattaaatctctacaggacccaccacatgccatatcctatgcggaaacaacctgtgaatataggaggagttccggataaggaaagacaaccataattctacatggaaacgacaaggacaactcggattgtatccatattggtttccctagttttacttggacaagaggacacctatgggtataaatacaagaccccctaggaggagaggacacaatcaacatacacggaataatagatcaagacacaagatcaatatacaagccaacatacaccaagataagccgccggatatcgacatcagagatatgcctggatcgaccctgtccggtacctacagaggtcggccgtagggatcta

SEQ ID NO: 56831 - DNA, 1501 bp, Oryza sativa
caattcaaccagatgttacttcccagttaaggccttgtttatggaataatttcgcaccacaataggtgcggaataaatccgaaaacgcttactatcgaacgtccgatacgtggagaaattccggacggtcccacagtcaaaagtcgcaacccatcctttcccaaccttatcctcattcctcctcatccagtcatccctaacctctcgcatcgacttcttctccgtgcagctcggccacggcgtcatcaggtggcgctagcgccgctgtagacggcggggctaccgtcacgggtggccggattctagccgttcagccaacaccgcgagaaagtggtcgacgccggttaggccttgagctcgccggcggcgggggcaccatggttgtccgttgtcaaagaggactcgagctcggcggcggtggtgtcaacgtcacaaggagatacggccagcgacggttagggccctgagctcgccggtggcggcggcactgcgaggaagcgggctggagcttgaggcgccgttgatggagatggccttgaactcgccgacgaaggtgaggatggtgggagcatcgagctagcaaggatttgttccatgctagttgctagtttctttatgttgcacacaagtgtttcttgatgttgcatttggtatttcttgatgttgcaattcatatttctggatgttgcatttggtacttgatgctgcagttgatttctttggatgttgcatatgtttttgctcttgaagtatgcgttttttagtgttcacatccgactgaaacattttcggtaaaataatgaaacattcttccatgaagaatggaacatcaaagaaacaactctgatgaaactttttttttggaacagtgaaacattgcaacaacttatggtgaaacatttatttggaacagtgaaacattgcaacatctcttagtgaaacattgcaacatctctttaatacgttgtggaacaccgtccggagatttgtaaaactgcggccgtctgatgtgtagtcgtccccgaataaatctcgtccaatccctcccacttggggattaaccaaacatgggctaaatggttctttcctaagtgttcaaatgcaatgtcactgcctttttccctcaaaaaaggaaaaaaaaatgtcactacccccatatagtatgaccaaattcaatcccctcgcccatgctactccctacacttccacaactcaagatcaaacacacacaagtccctaccgcacactaacctaacaaatcacgaactagcagactactagagagcagagccagagcaccatcaactactcaaactcgagcgaggagcggggaagggaaggtgggggggggggggggggcgctcacggcatccagagcgggaagagggtgacgcatctgctccagaagggctggagcacgtacttggccaccaccgagtggtcctgcccgctgtacctgtaccgcttcagcgtctccaccccgtgcgccccgatgtacccc

SEQ ID NO: 56832 - DNA, 1501 bp, Oryza sativa
acgataccactcacatcctaaggttgtttaagatagtggttttgcatatttgaaagcttaaatcagcaattttgaatggctaatatagcatgtttacatatcgtcgatcattgatcattaaattttaaattatactctagtgatgtcatattagtattataatattgtcaactgtttgtaaatgagagcaaaaatatgttgttaaaacgaaagatttaggtggagattttaacttatctaatgcatatgtcacctagcaaaacttattcaacatagataaaaaccactttgtaaaactatattaaggtgttatataaaaggtatgtttgggggttggatgtctgggcttcaaagttcagaggtgctagatgaactttcaatcaaagttttgggggtataccttttattgctatattataaaagaaattaacgatcaaagataacatgaagaccgtgtaaaagtctaatactctccatatcattctactccaggtaacacaaccatcagtttttaaaagcctggagtttagaaacatgtaaattatatgtaaattatatattataaaagtagtgctcatggtaaatctaaaaataaaatataaatcgtacgatgttaaattattgtaaaattataggaatcgatggtcaaagattaaaatgtttaacttggaacaaactagcaatttaaaacggactgagtatgttttatattttataatttagaagggatatcttagaactgatggatgctttaaaatgtagccacttaaaaaacttcagatgcaacatggacgagagcagatcattgactgcaatcaaacatggtgagcatgatacgatttatttactatatacatcttcaccactgattgacatggatcagttaaataaggttcccctactaactgtaaaaatctatgaaaacgaaacaagcgcaaaagtctaacgtgccagccacatctgcttattcattcggagatagaatttgtatgatccggtgtaatatttattacttctacttctggtcactgtatcgcatgatgccgtacacatcaacaatacccggaggaaacactggatcagttgctgctcttacagcgaccttcgccacggaggcaacactcactggaggggtcaacagtgggccaaccagcggcaatctcgtcaacggcttcgcactttggagaacctgcagtgcacagggagatcttcaaattaagtcttaaaaacaactttacatttggaataagagcaaaaataactgtgttgcaaggcttgcaaaaacagaatgaagagacttttaccatttgcataggagaaccaacaagtccaagaggtatttttacgctaccgacacggcgagttccatgaataaaaccaggcctcaaaatcactcctgaaaaatatgtaaaaaattgatataaaacttgggctagaaatacttattgagaggataattgtgtccaaagtcatctcaagtgccattgaattaaaatccaaa

SEQ ID NO: 56833 - DNA, 1501 bp, Oryza sativa
acgatgacgcctggctctagctgaggaaccaagaagacatgtagcacgccggaagacgcaaacaggacgaggtaaacgccccgtgtaatcctcccgttcacgccgccgccgccggcgttgtacaggcgggcgtagatgagcgcgacggcggtgttgaaggcacccatcgccgccgccgccacaagcagccgcaggagcatcagctggacagcggcgtctcgcgacggaggagctccaaccaaggtgttttcaccgaaccggtcgacgtgggtgaggaatccggcagcggcagcggcggcgacagccgccgctagcccgagggaggcagcggccgaagggcggcttgccatggtaccactgagagatttggtttcttgggataggaaagaggcgtgtggggaaactggaggggtgcggttgagcgagtggagagtttggggacttttatcggtggtcggtggtagggtttggaaattggaggaagaggaaggaggaggaggaggagggcgcttctgcaggatcatttaacgggagtttccacgcactttgctttgctgttttatcgcggagaaataataagatttttttatgcaagcaaatccatatccatattaaattctccaagttcatattgttggtatgttctctgttggatgggggcagttggctggatccggactgggatagtagcgcccattcctaaccagttctgaaaaggttcgcatgtgcttggaccaacagcttcaggatattaattagttaattgaaggcttaatactccgtcagtctcaaaatataaaaaactagaaccgggttagatattttctaatactacgaatattgacagatagtatgtccaaatttatagtaatataaaatctcccatcccatattaggtttttatactatgggtcatatactactattggagtactataaaggagaattcatcactcgaaggaatatcccctcatttcgtgcatgtcacctaaatagttataaaaataatccacatcctactattatagagatctgctaaagatgttttcgagtaatcattggcatgcaagggcgtggcttggcgtggcttgtgaggaagtttgtaccgtgcccagaacatgtcaaatccccatatttatcctctttgacctacttcctccgtcaaaaaaagacaaactctgattttcgtgcccaacgtttgaccgtccgtcttatttaaaaaaattataaaaaaaattaaaaagacaagtcacgcataaaatattaatcatgttttatcatctaacaacaataaaaatacgaattataaaaaaaaatcatataagacgaatagtcaaagttggacacggaaacctagagtttgtctttttttttttgacggagggagtattcgtttttaaagtaacagggctgcatgttttactcaaataaatattccctctgtccaaataagttaaatttctactcttaaaatttgaccaggtttatttaaaaatgtagc

SEQ ID NO: 56834 - DNA, 501 bp, Oryza sativa
tatcctcattaatgattaattaataacataattaatcaccaattaggataattaattactaaattattattagttaattgttaattaagtatttaatcactaatcaaattgagcctttggaccgtgtcgctatttgattccgaacggtctcgctcttctgttccgcgagaccgcgcggtctcgcgctttccccgcgcgataccgtccgcaacgtcacgcctatgtcattttcgtgtaatggttgtgcgagatcgacggtatatttctgtaaaaagttttgcatcccgaatatttctaagaaaaaattgaatgaatagtatatttttaaatttaattccatggtacaacaggtgtgtgtgtggtggggactggggagtgattggctgtctctctctgtgtccatttgctttactaaaatctaaatttgggaggaggagacttcacttctttcaggtcaaccccctgtcgcctcaagtgagcttccccttcgtccatttcaga

SEQ ID NO: 56835 - DNA, 523 bp, Oryza sativa
  unsure (1)..(523): unsure at all n locations
ctcatgaaaagaagttccgtatgaagtaagatgggttcttcagaagcataatccatggcagcatgtggtacaaagatgatccatttattctagcaccacaagcaacaaaggtattttatgtgttagacaccaagtgtcatccgaaatgtcgagttgttcataaattatctcatagacactagtggagtgtggctcataatgacaatgaggatatacccaatgctgtggtattgtcgtaccaaggagatcattgtcaaggtgtgcatgttcctccaactgaaggatgtgtagaaaacgaccagccagttagcgaaggtggtcttcgtgtgtaagatagtgtagttcatgacgtccgtatacaaagaggnnnnaagggcgtcatagatgagtaggagcgacagtatatatgaattggactgtgcaatatgtgagtgagtaatgaaggtcatccattccgtatataaagatgaatagtgatagcaattatgagtagaataagttgtggcaacgaatcagtcgggca

SEQ ID NO: 56836 - DNA, 478 bp, Oryza sativa
cagtagtccatcaatgaactatctaagttggctattcaatttcacaatgaaactggagcatttcccatttggtaagtcgacatgttcttgttcgctgtaatattgggttgtcaactgaagattcatattcatattttgagaaatctgagtgtttgtctaatttcagttgtcattactgcacataaatttgaaaatcaagacaacctcaaagtcaacatacaaatggaaatgtctccgcaattgttgaaagtcttgcaatagttttttgtgttgtgtttagactggcgtagctacttaaattgcatcaaaagcatcctgacaattaaatcgatgtgctattatggtcttttatcgcataatgttagtgcgctggattgtgttttcatgttttgttggaaattttgtctataacatggcaagggttttctgttgcaacataatcatttcagtatcgtgcagctgacaatggaaaacaatt

SEQ ID NO: 56837 - DNA, 191 bp, Oryza sativa
cgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggcca

SEQ ID NO: 56838 - DNA, 641 bp, Oryza sativa
agtccgcgtacatccattgccgatccatctacatgaaatgcaaaaaaaccgtaaaaatattcaacgaaagtgaaacccactaaacagtcatacaataatgacatatcattatacatacaataattataaaataatcccacaaattattctttttgtaattatttttgaagtttttaaactaatatttaatgtgttgtacttcttttaattttcaatttagtttgttttctattattttagattaattttcaatatattttcattctcaactattttataaaaactttttataaattgtaaataaacaaaatttctatacattcttcttccctacacaaattttctctctcatcaacttccaacaaagttttagagacaataatgtgtaccaaacatagcttcaaatgtaatatgacaacaaaaaaaatattggaggatgaagttgctaaccttttagacacctccaatttgtatatgatcaccaaaataaattcacaataaaatttggcaagacctcccctctgaagaattttgaagcttggctcggactggaggaagaagaagacatatataaagatcactactggccctcaccgtcgccgtcgtcgaaggtggagaacaatgccaagggacgccggcca

SEQ ID NO: 56839 - DNA, 1501 bp, Oryza sativa
ccattgggggagcagaggaccgctggacaccgggaaccacgcgtcgaacactttcgggcgtcaccaacagctagccgcctctgcttcgtccgcaccgcaccacgcgtcaccgcccttcgccgtctctccatcccggggtaaaacctcgagcctatagcatcctctacacctctaatatctagcgtcggctccagtttgtaggattaatgcctatggctgtgctgccccagccgccgttccgccgccgacgagctcaccgtggacaggccatccccggtgctcttcctcccatctttctggagaaatagaacgcccgtacgccgtatatgctcacgcactcatcaatttggtcggaaacccttcctgtcgtcctagccacttgtagccgagctcggctatggcgcagccatggcggccatgcgccccgtccctccaagcgccgccgcagccggtgggtggtcgccggagcttctccgcacctcccctggccgccgccgggtcgccctcggccggccttccgtgcgcgccgtgttcccctgctgctcccgctcggtcgagaggaagaagacgaaggttaaagacgaccttcagccgagccactgacaagctgtcccccactcctcctatttcctttagaaacttaatcctgtgaaaaagaaaatcaaagctttgaccccacatgtcagcagcggttagggataaggatatattttagattaaaaataaatgaattatgaacagtagcttttcacaatttctcggattaattcgaaattgaatctttaaactagtataacttgctcattttaactcggatttgagtgaaacttgaacctaatttcatctaaattcataagctttccaatggtatataactcactatttaataaaatatatttataattattaaataattaatatcaaatgattagattatggtcaacttaaaattatgctaataaataaaattggtattatacagtagagtagatgtaataatatttgtttctagcatgttttgtcacagtagcaaccatgtaaattaagtacagtgatgtctcaaatgaacggatgtatagcaagacactagcactatttacactatttaatgttcaattaaatccatgacttataaattatttacataaaagtttagcctcacattttgtaactaaaatataaacacatatggatgaatatctttagcttgattaggaggaatataacagagctagtgtgactagttatgttgtcggttgcctatattcagtaaatggttcaatattaatatactgttgcatacacataaccttttagataacctactagttgcatatattaaactaggtaataaatgaagaaccagtatattagctaaatactagtgctagttataaatcttgaccacacataattttaattttagttcaaccacacctgaggattgttcattattaatttataaagttatacaataacataatcagtaactataatatta

SEQ ID NO: 56840 - DNA, 1501 bp, Oryza sativa
atcaatctactaaatacctgatcacgggcggccgttgatttatctgaataatcaacacattgcaatttagacagccatgttggtcttctttgcatgtacacgtcggccaactaatgcatgcatacctaagcacgtactgagtccatacatatgcatgtgtacatgtcaggagcaagcatattagttggatctttgtcttgttgttttctcgataccttggtagatatccgtgatcaatgatccttggaacacatgatgtcgggatggatgttctcagtatgcgtcaggggtccaaaatttggatcctaatcggggtgtgagaatgatccgagtcccaaaagaatccagtgaatagatcgagatgttgattttggttcctcgatggccggtgttctgagcaggcagcggcattaccgaggttaccaaaaatcagttgatgatgtcgcttccgaagagatggagatcggagacctcctagttgataatatcaagtcactgttctccgcggcagcgatgtcttgaagtttggtcgatctcgagagatcgagttgttgacgacgatggttctgatctcatcgggagacatattttggtcgggttagatctccccacagcgaagtcatcgagtagcttgttgtcggagaattcgtcttttgaacctatctcgttgaaatcctagagcaccaaaatccccttacctggcacgccactgtcgacgtttgatgtctcaactacggtatttggacagtatggggatcgttggtgctaggatatacacgagactgaggtaaaagagatggagacgaggatttttatacaggttcgggcccttgagctgtcaggtaataaccctacatactgttggccggagccggagttgcttttattcaccataatcacaccagtacaatatgtggggtagcctatctaactgttgtcgacatattggtctgaagatctgactcgtagtcgacaacagggtagccttcctcctcgaatccgtgcccggcgagatcagagatagcgttttcgtctctcctgatggtatccggagacaccgtaggggaatagccatgcctatctctgaagtcgatatccggcgtcttgtcttagagtatgttggcttgtatgttgtggcttctatgttgattgtgttgggtgttgattgtctcgtcatggtgggtgttgatcgtgttgatcgtctcatcatggttgtccccctgtactcctaggggggcttgtatttataccgataggtgtccccttgtccaagtagaactagggaaaccaatatggatacaatccgagtagttcttgtcgtttccatgtagaactctggttgtctttccttatccggaactcctcctatatctgcaggttgtttccgtataggacatggtatatggtgggtcctgccgagatttagtcaactactattaggtatgtggtgtacataaccctgacatatagtatttctatacatctaaagtttatacaccta

SEQ ID NO: 56841 - DNA, 1501 bp, Oryza sativa; identical to SEQ ID NO: 56812

SEQ ID NO: 56842 - DNA, 715 bp, Oryza sativa
aattcctgcagccctgaagtctcctcctcccaaatttagattttagtaaagcaaatggacacagagagagacagccaatcactccccagtccccaccacacacacacctgttgtaccatggaattaaatttaaaaatatactattcattcaattttttcttagaaatattcgggatgcaaaactttttacagaaatataccgtcgatctcgcacaaccattacacgaaaatgacataggcgtgacgttgcggacggtatcgcgcggggaaagcgcgagaccgcgcggtctcgcggaacagaagagcgagaccgttcggaatcaaatagcgacacggtccaaaggctcaatttgattagtgattaaatacttaattaacaattaactaataataatttagtaattaattatcctaattggtgattaattatttattaattaatcattaatgaggataattaaccgctaattaaattgtcattgaacggtatcgctcatgcaatgagcgacagcgctcggtctcctttttcaatccgtgagaccacgcggtctcgcccttcccacacgcgatatcgtccgcgacgtcattgtcacgtcactttcgcgtaacgtttgtgcgagaccgatggtatatttatgtaaaaaattttacatccgaaatatttctgagaaaaaattgaatgaatagtatattttcaaatttaattcttgtacca

SEQ ID NO: 56843 - DNA, 1501 bp, Oryza sativa
  unsure (1)..(1501): unsure at all n locations
acgcggaatggacggaaccctgacggcgatggtatttttgggacaaaatcgtttgtacgattgtatttcttggagctcatatttgtcgatgatattttttggatttggatgcttgtcaatgacatattttagattatctctaactttatttgattgtcatcccgctgtctataacatgtgggccctcatgtgtctatgacatgtgggtccagtggtaaataatttagcactatttataagagtggcaaatagttaattattcgatggtagctaggtactagtaccgtactagcaatccggtgtgaacggcggcagggcacgagtatgagtatgagtatgagtacatgtttgaacggcatattttccgaatatgccacacgggttcctttcgcttgcgtggcccccgcccttcaaccggtgggctctgttgggcttttcgccgtgcccgagttgtccagccatgacccaatgccgcaaccgcaatgcgtgcactttgancnccatgagcaanganctntgtatgccttgagggtgtgtgtgcaaggagaatcccctctgctgtgcgacatggcgcttaaagtgcacgcattacgacgttccccagtgcacacaagatggataaaatacgagtaatgcatggttgtaacacgtgacatttgcttctctcttttttttttttttgaaactctagtgggacaaagattgtgatctccaaactatagtactgcaatacgaggccaacatgcagcaccagaaaagcaaaactgtatagtattgtagaaacggcatgggcacatgacaagaaactgtggctagccttgttcacaccaggcatcgtgataagaaaggacaaaactttcgttgagaaaatttcacttcacttcgcttttggcagaaaccatcctccatccaggaaacaagttgcaaaaatcatatggcaatcgaaccggccgtgttgctccgggcgagactctggtggctgtaactatagggtcttttttcttcgcgaaaagaaaatttttaggtgtcatatcggatgtttaacaaatgtcggaaggggttttcggacacgaatgaaaaaaattaattttataacttgtctaaaaaccacgagacgaatctgttaagtttaattaatccgtcattagcacatgagggttactgtagcacttatagctaatcatggactaattaggcccaaaagattcgtctcgcgatttctcccctaactgtacaattagtttttttaatctatatttattgctctatacatgtgtccaaaaatttgatacgatgtttttggaaaaaatttttagggaactaaaccatgcctatcaaacaatcactacaactttcgctaggctatgcctcttacgataacgagcccgaggagatgacagttgctgaaatgctgatggacggcaaaccacaatcaaggccctgtttatagcccaccccaaaattttacatcctattacatcgaacgtttaaacacatgtat

SEQ ID NO: 56844 - DNA, 1501 bp, Oryza sativa
tgaacccctcgaccggcttaatttataggtgttgattaacggcatattcttggcagcagcaggggcccagggggcattgctgatttgccgagcggccgtgctgatgcatactagcacatcttttccaccctgtggtcccagtatagaagatgtgaagattcggtactggagctggagctacgcgattgcaagtaaaaaaaaatggattgcaagtatccacataatacgctagcctcgtaggtttgcaagtatatatttggcagacccctaccaaaagttgaagatgtagaaatggattgctgatttgggttctcgatgtacacagagtgagagagatacataaggctctgtttctcctggattcatgtagttcgataggttcgaaggatcaaccgaaataatcgcgtaactcgttgccgatcacggagcggatgacaacgaagtccaaggatggatggcacgaattgaagagcgattgattgtgctgcatgtttcagtccaagctaggcgccacagaacggacaaaagtaagaaaatcgctacgtacaactcacgtctgaccagcacttagctgctaattgccctagccacatggagagaagttggtctgcgtgaagcgtaacgattggcagataaagttggattggatgggaatcggacgagggagtcgaacgtatagcaacactccagaagtaaagcagtaaaccgaaaaagttttgctatcacttgtatgaccgtctccacaagtggcgactggcacgacatggccactcgacagaaccgcacaacaaatgctgatcctttgcccctattccatgcgaagttgcgacttgcgagtctttgggcagggcatgcactactgacaagatgaaagaagaaaatcaaccgtaattcgggcgtgcactgctgcagaatagtccttgtgatcatgtccatgtgaccatgttcgttacgttctgaggcgtcgatagcgagcgatgctggtaatcgtgaccaatctcgttcacgtccaccttgttgacgcgcacgtacgtcgctatatatgacaacgtcctgctacatatagccttgctcactttcggactttgacgtatgtgaagagagcacgactaggagccactaatcatatggtttggtacatgagaggatatgcatgtttcactttgcacccaacatgtactgtactcatctagtcatcctactagtattttccatcggtgtccctttctcctgtgatctctcgctttgcacacaaacctcgcaacaaaacggtctcgctgtcgcctttcagcgcttcggcaaaggattggtcggttcatgaggctcgcttgcccatctcctttgctcttcctgtcgcctctctagtctctaatgtgcgattctcgccgaaccagcgacacgttttataggtgtttactcgatcaaggtgatttttttttcacccgatgtaggggcagagtgtgagtgtggttcagtcagcatatctccttttccagcgctt

SEQ ID NO: 56845 - DNA, 794 bp, Oryza sativa
taggtaggtcagtgggccatggactccagcatcgtcgagctagggagctcgtccaggaccaaaccgtcggcgtcttcgtcgaagtcgtaggaccgtcgctgttcaggcagtggcagcaggttgggctggtcgagtttcagggcgaacgatctcaccccttgctgttccatggcgtaccgaatccacgcgttggcgtgtgcgccgtggacggccggcacggcccgggcgcagcagccctcgtgcagctcgatggagatcgtgagctgctcaacgccggcgcggcgcgtggcgtggacgcggttgacgaaggcgacgaaccgttcgacatcctcctgccgcttcacgtcgcctgatgggttaattagatgagatagagagaagcgcaggctgggaacgcgcgcccggaggcaacgccaccgccgcgacacggcgcacgcgcgcgccacgtcggtggcgttgggcaggaggccgaggacgtgcgcgaggacgtcgtcgttgagctcgctgatcaggtcgccgccgtggcggcggcggaggtagtaccggtgatgcgtcgacgttgtctgtggtcgtcttctcttccccatgccaaacagaaggcgagatgtagctgcacgggtatatacttttttctttacggatatatataatttttttatggaaactgatcggatatattacctttttttaatgggaactgatcggatatataacgtgatatttctatatacatccctcatgcgcgcgaataggtttccctcgcgtgtgaaatcgaatcccagtatagatgacta

SEQ ID NO: 56846 - DNA, 1501 bp, Oryza sativa; identical to SEQ ID NO: 42821

SEQ ID NO: 56847 - DNA, 1501 bp, Oryza sativa
  unsure (1)..(1501): unsure at all n locations
gaattatcgactaactcatacacaccggcctaccagaatgcaaggctagtcctaaatagattaatcagcttaggccatcccatactagcacatgtggatgtacggtaaacataatgggtgatatgttcggtccttaatcgactcgggcgaatactccccctatcagtatgcaactaccaccatatgcataccacatgccgctcaagtctaaaaatcacatttcatctcattttatttcacaaatatccagcgaacacatcgctgcccatatcacataaaaaggttttccaaatagtataataagtgattccatagccatgtttttatttattactaagcaaggctaagcattagcattttataaaagcttaacttagctatatgagcacaataaaagtactctaattattcctaaggttcaaaacagcaagggagtgattttcaaaagggttcatgcaaattttttttttttttggtcatatctacaatccagtttcgatagttcgaattacgcatgcaacttttacaatcaaaacatttagcccgaaaacatgggattcaatgtgttcaaaggaagggcacacttgccttggttgatataagaccttcttgagatcagctataagaccaatcacctcaccggtaacgaattcaccgtctaaaagaaataacggtaacgataaatgccaaaacatgtaaaaatctaaaatgctctaaaatgcatgagtttactagtgtggttaggtactggtctaagatgaatttagatgaaagaatttatattttatcactttgcattagagagttataaattttcaagatgtaatactagcactagattaattaagctctaatagttcttaggtgcattttaggtctatgatttatgaattgttggcttgctgcagtgaaggggatgttctcaggtgttcaacaaaattggtttcacatttttgtagagttgggatgattttactatgaattttacaagctaagtgatttattatagtagttgttaactatttaaattttagacaagttttgggtactgaaagtgtcatattttattttataaaaactaaggtcatggttcttataacctaacaaactttgagatctcttcctttagactggtattaaattttatatgaattctagaagtttctataccatcttttaatttaattcattattcaaatntgagtgatgttnttggatatggtttcttctacagatttatctacagaacaaatgtatatgcttttatcaaactaacaaatttagttcatctcatttggagttaaaataaatcacttatgggttttatagtttctagatacactatactagttattttaccaattaaatagttggtgattattttaatacagaaagtatcaagttttagttcatgtaaattaagaacatggttttgtgagaatactggagcttggttcactccaaattaagttaagatgaattttatatgaattttctaagt

SEQ ID NO: 56848 - DNA, 1501 bp, Oryza sativa
tgtacgtgctacagatctccaagaactgctgcagatgagcattggcatcctcgttaggcttgccatagaatgggctagcctgcgccatcgtgatgaggttggacttcaagttgaaatccatgtctcccatgttgatttgcggcccaatggccatattgttagcagagagagcagcgaactcgcgaagggtcttgtcagccatagtcttgaaggttggttgcgctggtacggctggtttctttgtcggtagagttttctgtggagcaacgactcgcggcctgacgctctggaagaaagcttctggattttctttgaagttctccggcaagttgaaaccagtcatgcactacccagttttcacaacaaaagtaaaaacaatcaaggttagcctgcaaaggaaaatgattatacagaggtaaatataaaatattagttcaggtaatctctattatgaatcttccccggcaacggtgccagaaatgcttgttggtatttcttaacgacattactagaaatataattcccagcaatggcgcagaaatactcctggtatattatggctacagagtttatccgcaagcgcacagatataccattgtagcatttcacccgagagtattccaagggtatcgtatttattttatcccgtgggaagatcatgtagagagaacttgactaataatttatatgctacttgtgataattatattattaagcaggggttaagataatctaagggtagagtgacacacaagcattagccactcattctcataatatattatctaagctaagtggaaagaaaagagaaagataatctattcctatacttctaatatatatagtatacatatattctagttaaccgatatactagataataccctctatccgatgccctcctggtactttgagaagccacccctgactgacgacttccttacgacagcccatcatgaccatacaaccataccctccctagagaattaacttaggattctatataggcctggaggaatatccatactgagctgtcatcatcagcggcccacctctcaaccgcagcatataaccccaaataatgatatcccgtaatctagacaccacgtctaaactaccagatactactctaatatcatcgtcatgacatagagtaattgcataagcaaacattatacccgcaccaaagcatctcccagttaagctagccgtatattcagtataacatgaatataatgtaaagtaggcattcatatactcggaaagtatttcaataccataaatgtatacagaagagtattctaataaaagtacaaagcttacaaaagagaagagaaaagccactagagccatacccaaactcttccgaagacttccggactcctgatttctactctattcctattccaccagctagatactactgaactaaacttgagagaaatgagagagctcttgcttgaggtttgtgagtgaagtgagaaggtgaggggtttatata

SEQ ID NO: 56849 - DNA, 1501 bp, Oryza sativa; identical to SEQ ID NO: 42817

SEQ ID NO: 56850 - DNA, 1501 bp, Oryza sativa
cagcaagccaacaattcataaatcatagacctaaaatgcacctaagaactattagagcttaattaatctagtgctagtattacatcttgaaaatttataactctctaatgcaaagtgataaaatataaattctttcatctaaattcatcttagaccagtacctaaccacactagtaaactcatgcattttagagcattttagatttttacatgttttggcatttatcgttaccgttatttcttttagacggtgaattcgttaccggtgaggtgattggtcttatagctgatctcaagaaggtcttatatcaaccaaggcaagtgtgcccttcctttgaacacattgaatcccatgttttcgggctaaatgttttgattgtaaaagttgcatgcgtaattcgaactatcgaaactggattgtagatatgaccaaaaaaaaaaaaaatttgcatgaacccttttgaaaatcactcccttgctgttttgaaccttaggaataattagagtacttttattgtgctcatatagctaagttaagcttttataaaatgctaatgcttagccttgcttagtaataaataaaaacatggctatggaatcacttattatactatttggaaaacctttttatgtgatatgggcagcgatgtgttcgctggatatttgtgaaataaaatgagatgaaatgtgatttttagacttgagcggcatgtggtatgcatatggtggtagttgcatactgatagggggagtattcgcccgagtcgattaaggaccgaacatatcacccattatgtttaccgtacatccacatgtgctagtatgggatggcctaagctgattaatctatttaggactagccttgcattctggtaggccggtgtgtatgagttagtcgataattctgagaattttgtcgataacttagaggaactacccatgagtgtgtgtttgtgatgatcataggatgatacattccctatgtgtgtgtgtgtgttccgtgaggggtgtactgatccacctcacggcatgggcgtctaagtctgtccaatacaacggtattgtgccacgtggtgggttcccgtcgtgtccgccaccacggcattaagtttaaggcgtgggcccgccacttaacggttctagacatatttccaagtatacctaagatggaggaacacgtatcgtgctggtgcaaggctagattctaagtagtgtaaaggcttcgttatgacctctagaccgcactcaacgtatagagtgtggtggtgcatcgcgagcacaaaacaaactagagtgttgttcatatcttgtgggtaaagctgtacaaactctacagagttctaaaaactaatcgattagccgtgctcatggtcatgagcgacatgatgatgtgctatgggtataattttgtgatttctaaatgcttttgaaactaaaggaaaaagtacgaattacccccccgaactattgcggtcgtccgaattacccccctgaaccacaa

SEQ ID NO: 56851 - DNA, 1501 bp, Oryza sativa; identical to SEQ ID NO: 56809

SEQ ID NO: 56852 - DNA, 1501 bp, Oryza sativa
tagaggctcaagagaaaccgtgcgagcgacagcgagggggggctgcctccgcaccattggaatgatgaggccaccatgatcttttcctgggagcagcacagaggagttgtgtgagagttcctggaagattcggccatcatgatctcattttggttaatcttatcgagataagcatcttcttgcatctgaaaccaatcgggattgaatcgaaccacagtttcctttgatggatctcttcacaagtggtcatcatgagattgttaaactttctaccaagaaagatggagggggggggggggggggtcttatactcttaccacttgagatcgatgcaacttgatggcatggagtcctttcaccaactgggcatttttctagttaatcactctcaggtgaggtgatcctctcctgataattattgtgcctgccaaggcagataagaattttccccagttgattcatgaataatttggaatgattagtgtacccctctgacgcagcaatgtatacaacaggaggacaacatctgggttgcttcttcttcaagtgatgcccttgtacttttgccacacaggtccagaaaaaatgtgcaacttgcttgctggcactcgtgtatataatggctggctgtggtcaaggtgcatatggcttgagaagggtgacgcctgcatgacatgagcaagaatgcaatggtcaggggggaaacaaatagtatacgcaatgatcatgaaaagaaatactgcactagagatgttgcctgtcacattaccttgttctgaggttttggggaatgtacattaaggagtgcctgtcacaatgtagtaatcagctcatgtgaaaaccttatcacttgataaaacttcaaacacttgatataataatctatacagtaagtaattaatacaggcttaaagaaattgctgatagaaaatccaattcaatgaggtaatgactaatcaacaaaaaagtactgatacctaccagctgagatctaatataagccaacaatccttaaggccatcaattatatcacaggctgctggatgaacacttttatcatgcatgtactatggaatgattcaattattatttctgcccccctctgaaaaactaatatatatctctgcacactactgcagccaacgggtacatagcagtgcatcatgaatccatgatccaacaaatgtctcctcatagtatcattatttccctccaaagaagaaaagagaaatatatagaatataagcatcgcaaaatgtcgccctcgcttggctgccatcctcctacggatcagcactcagcactccttgacttgcacgtctctctctctctctctctctctctctctctctctctacatctcactctttcacacaatcacacacatatgctccctataagtagcactcgctcaccaagatcagcaagcttcccatttcaaattcatcaatatcccagccaagttgcatttgactgcagtttgtaagttgcacttgtagtt

SEQ ID NO: 56853 - DNA, 1501 bp, Oryza sativa
caaatacatataaaaaaatattttcaagtgacaataagcagaagagaacatgtgaacttattctgatcactgatgattctcacctatcctccgtgtgcacctacgtgcaatcagggtcacatttaccttctccgatccaacttctgcatggatattctgaaagcctgatattcagttaagtgtctgcgacttatattgacatatgaccctagggaaggtgactcaagttcaaataataatatattattatattgcatttctgacagtgaccaaattgaaatgtcatatgacaaacaaaggatactgccttgaatgactggcaacaagtactggtccagctgttaaggaagaaagaaacaatcaatacattttgcaagtatcagttatttaattcttcaaaactatgaaatcagtaagcttcaaatttaattcttgccttgttctcaattagaggttccagcaagtaactgttccatagaaatcttggttctgcctgtaaagaatgtaattatttcacctgtgcaatatagatttgaaaaggcacaggaattttttgtttacatgtttaatctgttgtgcttttaggcatttagcacgagcaacttttgacatagcagcactatgttgttgctttaagaagctactgtatacaagttcaaggcatagcttataaatttaaaattcaaaataaggaattgccccagtcttgaaagtaaaatacatatggtatatgattaaaaaaggagatatttacagaattattgtcacatatgacccattttgagcctttgtggaaaaggacagtgcaagatggatgtttcacagtataaaatgttaattcaacagtacttaactccccagtggaaaaaaagtactgtagtatgttactctgtaaaaatttagcactctttacatttttcatgcttaactactgaaagttttaacttaagccacagcatgctactttttggggacaagacaggtctttaaaacaaatgctattaaagctccaatgttcctagatgggatctatgttttcctagatggcaagataattgtgcagcaattactggactatagaagcagcagaagcaaaaataaaattccaggcgctcaaatggcaaacagtgttatacaaatcggctctaggtgccaggtagccacctgaattaggcattagatcattactagtggaaggtttcagttttatgtttccaagaatgccaaataagcaacaaaacatttagggtgcgtttggacaggaatcctaattcgcgcgtacacgcgacttctccaagtcgcgagcgtgccacatggcgggtcctcctacgaccaagcctgcgtgcttcttttttctttttttttccttttttttcggtaggcgcaacagccgtgtttctttctttcttttttttttggccgttaactaccacacgcgtctaagagtaggagtcaatatttgaaaactttcaagtcaagatttaaaaacttttaactcaga

SEQ ID NO: 56854 - DNA, 1501 bp, Oryza sativa
acgcaatttactgaactgttgactgctgatcgagcagcaagatagagaggatatgcatcacttaccatgcttgagtggcctctcttcctatgagacctcctgttagagctcgagctagtcaagttgctgctaccgccagcgacgcaatccccgtctagcagatggtactcatgcatgatccagttggttctgatgccttcagagggctctccaatggagaatagcagcgttttcttcaagccaacattgcggccgccgcttcttactgtttcatcaactccaatggggctccagtgcccattggatgaggtcctactttgtgttagatggcagaagaagtaccactggttcccagcttgcagtgctttgccttaaaattgcaatttctatcagcactcagcatgacttgtaagagaacaaattagtgaaatcatattgatcaatgcagttgcagacttaccattcagctcccatggattgtaccgatgcggaagcagcgtcgggatgatgtcagggtggcatgggaggagggagaccttgcgacggaggaaatggacgacgagctcttcatccgaggggaagaagtggaaacctggaggtaagtttgtagctcctcccatgctacaactacaagtgcaacttacaaactgcagtcaaatgcaacttggctgggatattgatgaatttgaaatgggaagcttgctgatcttggtgagcgagtgctacttatagggagcatatgtgtgtgattgtgtgaaagagtgagatgtagagagagagagagagagagagagagagagagagagacgtgcaagtcaaggagtgctgagtgctgatccgtaggaggatggcagccaagcgagggcgacattttgcgatgcttatattctatatatttctcttttcttctttggagggaaataatgatactatgaggagacatttgttggatcatggattcatgatgcactgctatgtacccgttggctgcagtagtgtgcagagatatatattagtttttcagaggggggcagaaataataattgaatcattccatagtacatgcatgataaaagtgttcatccagcagcctgtgatataattgatggccttaaggattgttggcttatattagatctcagctggtaggtatcagtacttttttgttgattagtcattacctcattgaattggattttctatcagcaatttctttaagcctgtattaattacttactgtatagattattatatcaagtgtttgaagttttatcaagtgataaggttttcacatgagctgattactacattgtgacaggcactccttaatgtacattccccaaaacctcagaacaaggtaatgtgacaggcaacatctctagtgcagtatttcttttcatgatcattgcgtatactatttgtttcccccctgaccattgcattcttgctcatgtcatgcaggcgtcacccttctcaagccatatgcaccttgaccacagcc

SEQ ID NO: 56855 - DNA, 1501 bp, Oryza sativa
  unsure (1)..(1501): unsure at all n locations
aagcaatgtggagcacgtctccctctattaccgcctgtcatctgggcccacgctaataccgatgtggatagcaaacattgctgatgcccttaggactagggatgcctcgtacgcggttttgcggttaagggatgcgattggaacttgaggatgcaaatttcccccagttccctgatcaatgatgggctgcttcaagtgggccgagcccatccggcccatacagctccctccctctatcccccttggctggctggcatacacagctacacacggaaacggccgccgaacaaagcgaacaactactagtcgtctcgtcgtgctgcgcactcgccccatcgacgagagatcgcctccgcctcgcacccgccggcgccggcgccgcctcctcctcctcctnctnctnctnctncccgccgtccaccggcgcgcctctttcccgccccgatcggctgccgccgccgcagctgctcgccgcctcgtttccgactcccaaggtgcgccgcgaagccgactccctccccctcgatctcctcccggaacgagccacacacggtctctcgtccttagatatggatcggacgccgcgagttcgtgattggccgccgatttcggtgcgcgcgcgcgcgtcgggttttttagaagccaccgccgccgccgcccgcttttccttttcgtttcccgtggcagtgagcgagctgtgcctacccttttttgtttgggagcaaaaggaagctgaattttcgcaaattttttgccgtaatgcgtccccttttaagtaatactgtttctggctactgtaatttctgcgatttgtcagttagctcgattcccagcttgcgcgatcctcatctgatctctctttctcccaaatcgtcaacctataggagcagtatccaggcattcggatccctcatggcccccgagatctccgctctgatgctagccgcagcttagggggtccgatggctgcctgtgctgctcctccatctacaggccgccttcgatccgcgcttccgcctcgcgaggagcctcgtttcggtggctggatgcagggctgcaggagatctccctctttaagtttcccgcagaatcatgtttccaccggtgcccccaacgatcttttgccctgcaccattacgcgcagcttgtttagccaccaatgcggccgtagccatctcgcagtcatgagggctgaaggttcacattatatattttttatttccatgaaggatgttagcctggagcttatttctataatttctttccataaaaattgtttgttatctatctctggttatttctaatgtctagggacatataagctgtgggtgtggctaatatgtttatcccttgtcatcccagtatcttgacactatccataatacatattatatagatcaaagccattaacctattagtttctggccctttgatttttcattacacttcagtttgctaattctattattatttatatcagggcattcctccatgggtgggg

SEQ ID NO: 56856 - DNA, 1501 bp, Oryza sativa
ggaagattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgat

SEQ ID NO: 56857 - DNA, 640 bp, Oryza sativa
gactgggaacgctgggaggaccgtggcgagcggcgccgtgctcgttgccgccgccctcctcggcgcggcggtggccgggttctgagaagatggcgttcgcttggggctttaggaacttggggggaggatttggggattctttgattttgtctagatttggttgctgtatgagagctcaagaagaaagtgcttcttctgtctgtagaagaaggggcttttaactatttaccactcttacgagtggtgcttaacgatttgccactagcccacgtgtcataaacacatgagggcccacatgtcattgacaaggtgtggtaaatcgttaattgacatgtcacaagagtggcaaatagttaaatttcccgtagaagaatgggggtaaatttataaattataaatgaatgatgaatctatctgatgaacctggttgcatcaagatctggttttagtctggtcttttatggttcagtggtttttcttcccgtcctgattaatcgccttacggtctcaaattacaacaaatcaaaatgaacaaggacgaagtgtgtagcaaaatcataacatatgtttagcaaaatccaagccaagcaacagtgtttccagcattttgtttaagctgttaggctgtttgcataacagc

SEQ ID NO: 56858 - DNA, 400 bp, Oryza sativa
ccgttggaggtgttctaatgtttgttgcctgtataaaaccttgaacgtgggagacggaatgtcctcttgcaagttgcaattttgtatgctgtacaaatatatttggttaagatcttgtttggttaatcccgaccacaagagaatcaagaggaatttgtatgggatttattcaatacctatttggttaatccatttaatcactcctttagtattaacctaacaagcctaacgcctaaggcctaagaagaaatacaatgctagccaggtaaaatatcatgctaaatcagtttgcccaaaaatcatgttattgcaataaacaatattctaccatttttttttgaagcgatgggtctgttcatatgatgcgactacacaatcatttacaaatatattgaaaaaa

SEQ ID NO: 56859 - DNA, 1501 bp, Oryza sativa
atgccgatgaggaaggcgaggaggaagaggaaggggtgattgatgacgtgatgatgatgaacgacataccacatttgcctcttgtcacatctttgacggtaaatcctttttctcccgaggacgagactttttctgatgtagacgagcatacaaagggactacctagagaactgttgacagttttttaaggagaaaacttgctcttcctcctagttttttaacgagccaattataaactgttgacagtttataattacaatataattttatatataagtataatgtaactcgtatataaatattaaaataatatatgtaacactatatctaaattatatagagatgataatgtagttacagttcagttacatagtagttacgatgtagttacaatgcagttacattgtagttacattgtaactatattgtaactaggatgtaactgaagtataactaaaatataactcatcaaacttctctaaaacatgcaacagatcaagtggctagcatgcacgccttccaggatggagctctctaagatatgaacgacgcttatcttgtggtaagtcccctcttactgaattgatctcgacgtctatttcgataaacttttgttagggttaatttgcattgctgcacactgcaaatgtgctaatttaacattacaacaatcaaacattatgaaattagcacagtttgtcagttcattaaaaaaaattaaacattacaagttttgatatgctaacaactctcggattttttttctctccttttaattgtataggagcagacgaaaccaacagatcctgctggtaatcaagccgattacctcagcgtctcgttaccacatctcgtggaaattgggataaatggcttccaaggaacaaagtgcgaagccaggctgatggaatggctacatagaagtgccccagttgttaacaagatttgcttttttgaaacttaagacgcggaaaggaatatgaagatttgctacctcgaattcctttctctgtgcttggtagatggacggcaacctggactcatcgtaactgtgtgggacgtttgtgtggacgccgacgtctgaagaagagagatataattatatctcgtgagtttccaagatgagaagtaaacaaaaatggaagcatcatgcttattaaaggaaaaaaatgtgcgtatttactattgggaagtaatttaactatttgtcactattagatttgacaactctctatatgccccttatctattcatacaaatttgtcactggagagagattgcttcttaatttttttttcattttttgcatacatgtcatgaggactactcatcatcgtcttcttcctctagccgccaacctcctacctctttcttccttctcccatgtatggttaaacttccgcaatccaaaaaagctctcacccaacaggcgacacccctgccttacgcctcttttcaaatctctctctaggaaaaaaagtgggaaaaatagagagatgga

SEQ ID NO: 56860 - DNA, 1501 bp, Oryza sativa
cttgacaagtaaggcaactaacttgtctataaagtttgtcacatgaaggaaaaatctcatagcaaatggctacaactacaccatatatggccttgctgagtgctcatctgaggtcacaagttttgaatgccagatttgttttgaggatcttaaccaggccataagggaaaaggtggaagaacgtcaacaatttggtataatttttcatgacaatcgggctaaatgcttgtgcggattagagtatactcagtggggggccttggccctctacatcgcgtgggggcaaatgcccctatcatttttatgtatacattaacctattctaactaagttgtagactgtcgacccccactcattttgcttcctgcatttgcccctatccaaaaggaaaaaaaaaccccaataagtaggtacggaccctaaggccccgttagatctcaacatggagataaattttggattcacgcaaaatgagaaaccttattagcacatgattaattaattaactattataaatttaaaaaatggatttatttgcttttttaaatcaacttctagaaactttttttttaaaaagcatcatttaacagtttgaaaagcatgctaacggaaaacgaggaagttgaaattggagttgaagaaatagaacagagcctaagtctttatatgttcaacagtacctttcgccaaaaggctataaaactaatccacgtgatttctaaaggaactcccattttttcctaaataaatttgctcctactagataaaacaaaaacaaatcaaatccctacatcatttcatatctggtacatatttttccaattaaaaaattattggagcacacattagaccaaactcgctcaatttcataggcttgcacaaagactatggtccatggacaagacgacacggtgaaaggcaggtgatgctcgcccgccatggaccatgtgtcggtaaaggggaagcaaggggcttggcactgaaggaccaaaaccgctggcgaagggtgattgacggcttcgtcatgatgggctgtgcgaggccatttgaagctacaaggagcccacatcgatctttgaagaatatatgatgaaatggttttggtgttggcatcccttaagacaaataaaggaagatggcatgaagacattcctattggtataattattttcctatttatatttgaggatagaatgccatactattaagaggtatgcaacgtcgatgtgtttttgtatgtctcggtgcttaaagtgacctatttgagagaaacccattaacctatcctttgagtgattttggaccttctttttggttgagttgggtaatcctctgagtgagctttccataaagtctaagatcgtaaaaaatggacttccgatcaaaaagttatggccattttgctctctggtgtttttcagaatgtccaaaaatattttgaaaagaccaaaaattttcgaaaattccgaaaatggctgcaaaactaagattgttttctgtt

SEQ ID NO: 56861 - DNA, 1501 bp, Oryza sativa
acgcccgaacctcatcaagatttagcacctccactggagctaagccaatctcctaggcattcgtgtgtcacgacaaaattttgcatcaaaagtggggtatctaaaatgcaatcatttagtatccaaattttccttaatttaggtttaattttggcagatttcgacctcctataaattttagagctaggtatgtgtagctctaaaaatttaaagtcgaagctagtagtacaataagattattagggtatgttgacggttgttaagtgcaaactttaaccatcaactcctgggtaaaagatttcaaacatattatcaaaacttagtggtacgaatttactactaaccacttctactagttttgacaaatatatgtatgcaggtcatttaaggagaaaatacacccgccatgcgatgaaaatgaacccctaaccaatcatacgctagtacaaggattggagggtgtcggtatttcttaacgtcatgactagaaatataattcccagtaatggcgcagaaatacttctgatatattatggttacagagttcatccacaagcgcacggatataccattgtagcatttcacccgagagtattccaagggtgtcgtatttattttattccgtgggaagatcatgtagagagaacttgactaatagtttatatattacttgtgataatcatattctaagcaggggttaaaataatccaagggtagagtgacacacaagcattagctactcattgtcataatatattatctaagctaagtgggaagaaaagagaaagaaaatctattcctatacttctaatatacatagtatacatacattctagttaaccgatatactagctaataccctctattcgatgccctcctggtacttcgagaaaccacccctgactgccgagtttcttacgacagcccgtcatgaccatacaaccggggctaaatacggaggaataccctccccagggaattaacttagtatatacatgtgcggaggaatacccgtactgagctgtcaccatcagcggcccacctctcatccacagcatataaccccaaataatgatatcccgtgatctagacaccacgcctaaactaccagatactactataatatcatcttcatgacaaagattaattgcataagcaaacattatacccgcaccaaatcatctcccagataaactagccgtatattcagtataatatgaacataatgtaaagtaggtactcatatactcggaaagtatttcaataccataaatgtatatagaagagtattctaataaaagtacaaagcttacaaaagaggaaaggaaagctactagagccatacccgaactcttccgaagacttccggactcctgatttctactctattcctattccaccagctagatactactaaactaaacttgagagaaatgagagagctcttgcttgaggtgtgtgttgaagtgaagagagtgaagcctttatatagaggtggtta

SEQ ID NO: 56862 - DNA, 524 bp, Oryza sativa
ccttgccacctgggcccagatgcaaaaagtaccagccaaatgctctttagggctgcgaaaattgcatttagcccagagggcagcaaagggctaaatgcaattttcacagacggcggcggacggcgccgtcgagccgccgtctaccacgtcagcttgccgccctccattagggcggtatggtctatttttgtaatttttttcgccaatagattatttctgtaaatattaaaagaaaaaaattaaaaaatgaaaaaaattcacgcaggttcactggttcagtgaaaaggaaaaaaaaatttcaacatggcctgttctaataacttcgtaaacatacaaaactttcctcgttttcaaactaataaatggttatcttatacgaaaattttctacataaaaattgttttgaaatatcagataaatttatttttctaagtttttaataattaaaacttaattaatcgcgtggctttctcattttgtgtgcccgcttttaatcttcatccttagaagattcgaatggggcc

SEQ ID NO: 56863 - DNA, 1501 bp, Oryza sativa
tgcataggagtaacgaggcagagttcgaccattgtgtgattggatccaaagtccaatcttagtccggtgaattggacggctctgtggggtcttcaactgcagcattatggacgcccttgtaagaagcgtccccatctggacgttgtctacaacagcatccacacctggacgtcctatgcaatagtgtccttcctattttcgtaaaaattgactttgctttattatatatttaatttctgcattattaattattatgaataaaaaattcggcctaatcaacatcacaacaagaacctctgaaataaaaaaaacacagtaataacaggtataagtaacaaaccacaacgaaccctaataagttcagataatagaaaaggtcttctcaagattcagtcatggcgatcgccgcaagcagggccaacgccaacgccaaccgaagccgccaccatcatcaaccgaggcggtgggaaaaaaattcctcccaatgctggcacgcacgcgcactcgctcgagaatccggcgggtgggactgaaaaaacaaaacaaaaaaaagcagatcgattttgtcatctgcggcgcaaagcgggtgtgcatttcttttcttttatccccacatccagtcaccgtgacgtggttcttgattcctcaggccgggcgattattctagctctagttgggatgattggattggatccccagccagcagcagcaagcaattcttggccatcggttgtgggtggctgttgattcatgcatcacgagcactcaataaagtatgcagatctgtgcgcccctctctgatttgttcatccaggcaaaagagtatcttgcttctgtgaggtgaggtgattgattgattgatcaatgggggtggattgctttcagggagatgtgtatatgttgtgtttgcagtagcccatggtttcttggcaattgttagttttctgatcacagtggttcaagttggttgcctttttttatggttataagcgatgtgctctgaacttctgatccagatttcgatccagttctgcctgcgattcttgagtttttatgtgttccatgtcagtgtctgaatttttgacaggcagttttcagggtgagcaggtgcgttcaggtttcaggtatcgttgtacagaaattgactcgaaactgctcatgactttttcaggatactaaagcgtgaagtgttgggggttagcttttgattgaagccatcgaaaattttccagtgaactttcaggccctgctgaaagaagaatctactgaaaggttggtctaatctactctctaaagtaatttagatcttctttatgaggagcccatcattggtccggtgatgattttaagatcgaagtttctaccctcatgattggaaactatcacagatggttcacaagacgaaactgtgtacttctgtttgcttatatatatctgcatacctcgcatcatgacagtgctggttttcaactcgtaattctttcagagggaagattcgtaa

SEQ ID NO: 56864 - DNA, 1501 bp, Oryza sativa
tggagggtaaaaacccctaagtgatcttataaatctttttttttgcgggggactattttatatatatatatagaaatcaactttctttctttctttctccttaatgaaatgaaatgtagtcctccaacattttcaataaaaaatatctttaagaataacattcctctaatcttttcagaatggatttgatcttctgtaagcctgtaactacccgggatctagttgattccatctatacaagttaattaagggcccgacttgaatttcttagttaggtctaatattctattccagttgaagtaagtgaggcctctcagatatattgattctatctttaactgcatcgttgtttagaatcatatcagcttagttaggactttctcggttaggtccgatattctgcctaagtttctatttctgtaatcatattgtagctttagattgatcgatatgtccatcatgtttgtgtagatctattagccaaataggttgtccttattatctttgatcttatactttcttggttaggtccgatttattacattgttgctaataagtttaattctagtaagccgatattttttatgcggtgttcataggagttctggccgatgagttatcattattgtggacttcagctatcagatgtatcgattagttaaccgatatacactttaatttacataaatggaacctatagtcaattcatcaaaaccttatcaaaatcagcttcataagttgatcgtctccctaagttgatgttcagcccctaagttgatgatcagctccttgatcattgatatatttccatccagttagttgcaggatcaaattaactggcacgcccgaacctcatcaagatttagcacctccactggagctaagccaatctcctaggcattcgtgtgtcacgacaaaattttgcatcaaaagtggggtatctaaaatgcaatcatttagtatccaaattttccttaatttaggtttaattttggcagatttcgacctcctataaattttagagctaggtatgtgtagctctaaaaatttaaagtcgaagctagtagtacaataagattattagggtatgttgacggttgttaagtgcaaactttaaccatcaactcctgggtaaaagatttcaaacatattatcaaaacttagtggtacgaatttactactaaccacttctactagttttgacaaatatatgtatgcaggtcatttaaggagaaaatacacccgccatgcgatgaaaatgaacccctaaccaatcatacgctagtacaaggattggagggtgtcggtatttcttaacgtcatgactagaaatataattcccagtaatggcgcagaaatacttctgatatattatggttacagagttcatccacaagcgcacggatataccattgtagcatttcacccgagagtattccaagggtgtcgtatttattttattccgtgggaagatcatgtagagagaacttgactaatagtt

SEQ ID NO: 56865 - DNA, 234 bp, Oryza sativa
ttatccttcttctcctaatattgaatgaattagcatgttttgatatgttccaagtcagctaataagtgtatcagttcattctggttcgtagttaaactttcttccaaggatcgcaactctcttaatctaggaggatttccacaaatgtggttcttgcaagtttgatggtgtttagtgtccatctcagttacttctattatgatgtttgctgatgattagctgtgttgggttacc

SEQ ID NO: 56866 - DNA, 511 bp, Oryza sativa
ctcaagtatagtacaacacacttgtagttttatttttagtatgttggcttagtagaaagtgagggaaagctccagaaggagtgctccaaaatatcagagttcctccaagaatttgatggagtgccggagtgttggcattcttctaacggagttctagagaaagccgggattgtttgccttcttctctcgcttgtacctcgatggatgcttcctttattaaagtaagtgtttgagtttctttatgttctttaactagtgttggtatttcttatgttcacggataaatccacaagagcacggaacactgttgtaacacttccccttagtgtattcgaagggtatcgaacacaaggaacatgtgtgtattatctatgatcaagattctatccaatgacaacaacctaagataaagtggctagagaggattcatatgtcttttaattagttaattaagataaaggtaagaatctatcaaatgcttcaggcaccggtcctcccatggtctgctagg

SEQ ID NO: 56867 - DNA, 990 bp, Oryza sativa
aggccttgtttagtttttaaattttttttcaaaaacatcatatcgaatcatcgggcatcgttatcgatctatcagctgcgcctccttccccgccgccggctgcgtgttatctcgatcaccccagcggcgacggcgacgacacgagagaagggaagcggcagcggctgcgacgcttgagaagggaggcagtggcggcgcgtgcgaccttggggtcggactgtcggagaggcccgggaggcgttggtagtggcggcacgggtgagctcgaggtcgaagatcccggtagcggtgaggtgagcgacctcgacagcatcgcgcccgccgtcgacgacccccgcctccctatcgacgcccgtgccgtttccgccttgctgccgccttcccaggcccatctttggcagccgccggccaccatcgtgatgccgtcctcctcctcttccgctagccccaccgatcggctacaggcagagaagactgagggagaggaggaaccgaggagagaagggggggatgacgtggtatcctgacgtgtggggcccacgctgactcagccgtcacatcggataaaaccaggatcaaaatcaccgaaggatctaaagtgacggttttgattagttaagagacgccggatatctgattttgcagtttaaggacgtttttttaactcgaacaagttcagggacctttggtgtactttttccacaaattataatggtctggacactattctcagtcggctccttaccattaggcctgcgccatcttaccttgccgcttcgcggcctattcattcggcccgcttggactcgccgggaatcagtattgggcctcgaattcagattaaccttggcttggcccaatttgcaaggcgatcggctctagaggtggccaaatgggccgggccaaacgggcggcccggggcacggccgaacctgtagcaggcacggcccggcacggcctgctacagtaacgggccgtgccgtgcttggg

SEQ ID NO: 56868 - DNA, 515 bp, Oryza sativa
ctactatggactagcaaatgccaaatgccaaattgccaatttttgctactagtgtttagatccaaaatggcaaaaagtgctacaaaatggcaaaaattttggaggatttaaacagggcctgataagctgaagagcaaatgatagagttgattaccatttccaatatattggttagctttattagttgttaatccgtaagttgcacagaattgttattgttgagattttcaatattaactcctcaataatatgataaagacatattatatatcattacgtgcacgcactttcccctataaacacacatacgtcgatgggtacgtcgtttatcactaaaataatagttggccataaatgagagaactcgtttcaagtctaggacttgaaaccgagtgtgctgtttacaccataagaaatctaactagttgaactacgcccactttactacaacttgctaaatattaatttagaatttcaaaattaattaaattaaatattcaactaatagtcaaaga

SEQ ID NO: 56869 - DNA, 268 bp, Oryza sativa
catagatcacatgcagaggaataagaaaccaaggaaagaagaagctgcatcaagcatgggggttttggaaaaggcaggggacaagaagaaagccatagttgtggaagaggattcagacaatgaaagtgctcaagcagaattggtgaagctcaaacagatggagatagatagggagctggctctgagagtacaactagaagaacagtttaaagtcaagcagattcaacttgataaagatgtagcaggagggatgatagagggtggaatc

SEQ ID NO: 56870 - DNA, 1201 bp, Oryza sativa
tccatggtgaataaggtgttctgcaacagtagtatgagtgattcaacatctcaacagcttacatcggatactacaatcgaggtaactaagtcttaggctctctcctgactctgtctttgtctgaacatcatccgaaattactggacacaattagcttcttgtgacaaatttccaggttacaattgatataccatttccatttcgagcattacctgttgaagccattgaatcaagtggcaggcagttcttgagcaactactccgagtcatgcttccacgatttttgaagcaggttagttaaatacatttttttgtttccagttaaaactttgttgcaaattctaacaccagtcaagacatcaagtgaaggcagctacttttatttctctcgtattaatttgacacctgatgtatcatagatagttcaccactatctgttttctattgttccatgttgaattttaggcttgcattcagctctatacctagattttatttccaacaaattaatcaatatttgaagtcccacgggtgctttagtttatagtttactttctatttgtacaatgatataactaagaaactaaatggtctgaaaaaaaagaatgatacatgatagtatgaataagatttatgttgagcaattgccaatgtgccggctagaactttactaggattatttgacatgagtagcagttcctatgattatcctaatatttatcttagagattatttgtcaactgagaaaattattttgctctcagcttgttaaagactaccaagcatgggcttcgggtgattcttcaaggaaaccacttggcactggtgaaatatgaagcttcgcagtgtctccattaggcattatagtcttttcttgttgcattagttattgcttgatggggtatagaaaagctgtttatacgtcgttttgctcacaaaatccatttgcttctttgtggtctttgcctgaagatgttctgtagtgtgtatggatttgtgccatgcgaccagtcacatacatttgtaggttgttcattcacaatgtgttgttgtaagattaacaatatccgaccaaaactcttctgcctccatacacattacaaattatggtcctgtgatataaggattgtctatgcaaggaaggggtcggatatggttttctgatattgagagcaatatgtgcggacaacgaaggtgactac

SEQ ID NO: 56871 - DNA, 1501 bp, Oryza sativa
tgagttacccctaaaccagcccagttctaccctgtaatggtctatatatggggggcatacgactatgctatacacactaccaaggctaccaagtacccagctagtatttctaaatgataaaggtaagcaatatgcactgacacatgtcgacaacctaactgcaaaaacacaaatttgctgatacacatgctccattcatagcaagtggagtacaccttgactaccccaaaaggaagcacatagtatatcagaaagcactcaagccaaactgtagttccacactgaccccccatgacactgaaagtctgaaccatattagttttagagcctagactgacaccaccaccatctcacaagtgatctcacggatcatatttgtcacaccttggcgagcaaagagcaggaggaggttgacgatgacaacacaaagctgctgcccccttctcccccttgtgatcgagttgtggttgtgacattgaagagacgagcacccaaaagaggagcaagaaattgaagttcgcactagtcgcggagtacctcagctcggatatcctcaagatgccgctggggaaagagcctagctcatgtggacgccgagggaaagtgcaacaaaagagagaaagccacgccaaagttggtggcatcaccagcctcgaaactcgaaagcgctaatgctcgccgcatatcctttggtagataccgttccctcttctcctgcacatctccctgaagattgcgtagttgctccctgaactacaccataattgcagagataagcaaagcttaattgcgtcttcaagtatttgctttgctctaactgatgatctgtgcacttggtttatgctaatgttactctgcaaacaggctcagagctgcttctttcagctcaactattttttgctctgttctactggtatgcactctgtactacatacaagtaatacgtgtgcaagaattattacagacatggctcatgagggtgaattcactgaattgtaatcattgagagtattgtggagcaggtttcagttaatggaaagctaatgtctgttgatgcaaaattgcactgatttaggtacaaaaggcacttttaactaaagaaatgatttcctgcagaaagcccctcaaatctcaaagaggcaccaatacttccaaataaaagcacccaatgggagcttcctcttctcccccctcttaagcccacgtatgctcaagggcagggcacactccacattatccatgcatatgcatcatgtaatccacaagatcttcttagcttatgtcatgcgataactaccatcatcttgttcttaattttggagtgtgtccgtgcaatgggtggccgtgcttcacacgcctatagagcgtgggctaatggtggccatggaggctagctaagctacttcttcttggggaggaatggctatgcatggcctccatagtcgacgacttttacctctactaaggtagggcaacttgtatcctttggcaattattcggt

SEQ ID NO: 56872 - DNA, 1501 bp, Oryza sativa
gggttatggccatagagtacttcgaatggtgtcttgttcaaagcagaatgaaagcaagtattataccaataccctgctaaatgtaaccaagtaacccacttaaaaggggctgcattagtgaaacaacggagaaacatttccaaacactggttaaccctcttagtttgcccatcggactgtgggtgataagcagaactaaggtgcagggcaatgccagatttcaagaaaagaaattcccacaatttgctagtaaaaattttgtctctatcagagatcagtactttaggcatcccatgaagtttgtagatgttcttcatatatgacactgcaacatctagggctgagaatgggtgtgacagaggaacaaagtgggcatacctggagaatttgtcaaccaccactagtatgcaattgtatctctctgattttggcaatccctcaataaaatccaatgagaccacttgccaggcaccttctggaatcggcaagggttgcagcagtcctggatatttagctaggtctggtttcgcttgctgacagatagtacaattctttacccactgctgaatcattttcttcatctgtggccaagcaaacagtgcttttactcgctgataagttactgggaaaccagaatgtccacctatagggctggcatgcaaggcagtgactagctgttgctgtaaggataaattatgcccaatccaaattttacccttgtaccgcaataccccttgcactaaatgaaaatgttccctggcagtaggatgcaatgccaattcagttaagagttgctgagcctgctcatcagtttcatacccttttaccactgctgttaaccaaaggggttggcattcggatacagcccacaattgatcatttgtctcttcatcccttcttgataatgcatctgcagctgcattagaggttccccttcgataacaaaccttatactgcagtcccatcaacttagtgaaagccttatgttgcaacggagtatgtaatctttggtcagtgatatgcattagattgtggtgatctgtgagtatgacaaactcatcatgctgcaaatatgatctccactgatcgactgccaataggatagccaggtattccttctcatatgtagacagccccctggtttttggacctaatgctttgctaacaaaggcaatagggtgcctgtcctgtgacaaaactgcccctattcccatatcacaggcatctgtttccacagtgaaagtttttgagaagtcaggcagtgccaaaactggggcactaaccaaagcttgcttcaaggcattgaaagcttcatccatttgtgctgtccatttaaagggcacccctttcttaagcagctgggtgagtggtttgttgatagttccaaagtttctcacaaacttcctgtaatatcctgccaaacctaggaagcccctcaactgcttgactgactgaggaattttccaatgcagcacatcagcaatcttagaaggatcagtgg

SEQ ID NO: 56873 - DNA, 1501 bp, Oryza sativa
caatatcatcaccaactgggtcatcatcttcttgcaaagcttctaaaagctcttccatgacatgtaactgtactgttgaggcacatttgtggtcccttccccacctttcaccacaagtgaaacacagccccttagattttctgtaagccttaagtgaggacaatctatcatctctgggagtaatcttagctgcttcaggggttttcttatcctcattcacaacaggtctcactggtagaggtgtcaaagaaacttgagcagtgttcctgaaattggacttcactggagtagagaactccaaccttcgagttcccagcattgcctcctcctgtaataaagccaaagagcaagcagtatccagatcttgggggcgttgcaccataattacagtgtgaatagcatcctttaaaccctctacgaacttagtgacgaagtacacaggcttcagttcactatcgtaagcaatcaattggtgcatcaagctatcaaacttatccacatattcagttacactaccagtctgtctaatgtgtatgtattgccttatcagctgttgatgcctatccctagaaaacttagcacaaactttctcacaaagttctacccaagtgactcctattaattgggacctaactgactgcaaccaaaatgaggcattcccagaaaaattgagggtggctatcctaacccaatgagcagggctgactccataagtatcaaagtaggcttcacagttttctctccacatttgggggttatctccatcaaattgtggacatggcataggaggtaaaccagtgcttgtgcccacagcactaccagtaaaagcagttcgcatggctggatcatggaaataaggagcaggtgtggagaacaagattgagttcgtaccattggccgggggtggtgattggggatgagacccaagcacctccgcccgtatttcagcagcattgcgggcgcccaattgggcggtaaggtcaggcttcggctccgccttgttcaggagttgaagctgatcgaactgaagctgcagatttccaacggtggtcgccagatcagtcaccttcttctcgagctgtggcttccacgaatccactgatgtcttgaggttcagcatatccgcgcgggagttcttctccagatccaccaacttggagtccgtctcggtcagcttcttcaggatcagatccagcttggcctcgttctccatgattttgaacgcttgcttggtttgataccttggcttttctagtttgacgcaacgggatccacttcccctgttcctaatccagcaaaccgagaggggcaagttaccttttcgcggatttcagctgcaagagccgatctccaatccccaatcggaacccttttgctgccggatcaagaattgggtgggatagtaggctctgataccaagttttgtcaattcctctcacagatcacaagaacagataggttatcgtcgactcgacccaaccggatcgagcgccgccgccgc

SEQ ID NO: 56874 - DNA, 1501 bp, Oryza sativa
atttgttgtcaaatttagtaaatatataaaaaatactgccaaaattttgccaatattaccattgctaaaatttggtaaggtttattttggctacaatctaagcggacctttggtttcttttccaaatcacatccgacactttttttttaccaaaaatcagtaagactaaatctcgaatagccatatatcttcaaatgtttcttccagcaaatattgagcagataaaattcctgatgtaaaatattttttatggatggagtgcgtgaaagaacagtacacatcctatcttactgtaaagttataacccactaattctaaaattcaacatgtaaacatgtcagctcaccatccactggcaataattatatacaaaacttatgtaagcatgcaacatcatatataattcattgaattctacaaatcaacaatcaatcatcttccttcacattatttttcacaatatttttaacatatatatccaccatttttaatacttaccatatatttatccatataatcatataatcacagtgcgggatatcatatttcatctagagtctcatacagactctactaaatttattctctcttaacataggctgagtttgagagagggggataaagaagattggagagatacgcaaaacgaggtgagccattagcgcatgattaattgagtattaactattttaaatttcaaaaatggactaatatgattttttaaaacaatttttctataattttttttttgcaaaaaatacaacgtttagtagtttgggaaacgtgcgcgcggaaaacgagtcacaatctccccaatctctccccaatgtcctttgaaagaacgcagccatagtgtgacaaaccagttttatttgttgttaacacctaaaataatttttacttttagcttaattattaaaaaaataaaaattatttagtaatttctacagtaaaacgcggggaatcatctagtttccttaataatggagataaatgaatcgatcctaatgatatccccatcggaagactgtcagcttcacactgctaatcaaatcaaacagccaacaagcatgaagaaaacttgatattttgcataagagtcataaacgaatgatatgcatgcacattcctatctagtagaaagctacggattattatcacgatcacagcacagccatcaagcagcacataagcatcgactatacagaggttggagagtaccaaaagcggctactcactggccgaagatcccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 56875 - DNA, 1501 bp, Oryza sativa
tctttgattagttttggatctggacaaagcgtcacatcttcatatagattaaactttttttagacggaaggatcctaataaggattggatgcttttctaggtggtgtcacatcttcctataaatttgtttttttatagagatcttaagaaggattaaatgtgacgtagtctagtacaacgaatttaaatatttatttttttacaaagagaatatccaaattatagtcaagaactagtttattttgtgatgaagtattcaagtagcactataccaccgtcccaaatatgcggatcacaaaattatgaaaacggactcacacaatgggagctccaccctttgggttcacatgataaatcggcccttcctaggaccctcaacggtgggacccaccagtcacctcaaatcatccatgaaagcagtggacgctctctttatttagctgccccccctccattccttccttcctccacctccgctttattctcgccaccaccaccactccgccgctgccgcctgcttttgcttctttccacttctgacttctccaagtccaaactccaaagttctcatcgttgcgcgtggcactgtggactctccactctccacgcccctactccgaggtgagcaacccaaaaccgaagttcatttcttctcttttcgtccagagaccaatcatagtcgtagctcacgaaacaatcgaaaaaaatatcttgttcctggggttctttggcaccactgcatgcacgggtttgtgctggatctttcgtttctttttagtcggtaagccaagctccaatccattcgatctgatcaactgcaagaagcgtagaatagggggaacaaaaaatctggatttttagccataactacagtaatttatctgaggaaatctcggtagctctattcatttagtttggtgaagtgtgcgaaggatttttgtattgataagggcttctgtttctcgcttgaatttgtttgcaggatacaccgtgagtaggcgtggtggtgcttgatctcaaatatcaaatatgtgtcctcccgttttcgtgcagtcgatctaacaccgttgtttcttgctaattcgttttcgttcccccggatcaaagaaactttattttacaacaacaaccacaacaacaaaaggatctttacatttccttttttaaatgatcttattaccttctctctcttatttttacagattttagaattaacctgtagcctctgtttgtttgtctgctccaatttctgcaggttcttgagtttgagttgggcaaggaggttgtgaacgtagcctgaacctgacctgagattgtgaacgtaattttggggggaaaggttgttctgtactgtctcttcaatctgtgagttcgtgacaggttcttgcaaaaaccaaaacatcatcagtgaaaaattgttcgtagcattttagctctagtatagatcgatcaatcgatcgttcgttcgttcgatcgttcgaggacgagagatttgctaaca

SEQ ID NO: 56876 - DNA, 689 bp, Oryza sativa
gattagattatagtaatctggcttatagattgtaataatctatcataataagctatatgtttgtttgaacttattcctaataattcagattataataatcctaagctgaatcatacatggcctaaatcgagactgatcttagttttactacatggctaaatttaattcccttaatacaaatattcaaactattttatcagaaaataattaatgcaaattatgaaaataatctattttatcagaaaataattaaaacaatcggtaactaaacaaaatttcccataagaccaggctcgtcttaattttctctctagctgggctttgggctagcatgaagtccatctataataataatggatctaacgcgcttacacccaaagtagaggtggttcgtctttgttagccttcagctcataattatctactaaaatttgaattttcaaatttaaattagagttggtttttaggtttttcaccttagtttattttttacattgaattttgaaccgcgaatacaaatttatctataaattattcctttttttatacgtcgttttatggcttatcagttttaggccaaacgatcacctgtgtttgtggtactacttcgtaccattgccactccactccaaactccagtgtcccaaagtccagagtagtcgcgctcacgcggctgtgataagttgtga

SEQ ID NO: 56877 - DNA, 1501 bp, Oryza sativa
cgcctttgagggcacatcacatctgcagctagatctaacgcatcatatataggacgcacaatagaatttggagtctcatccgtctgctgtcgcctgcaagaggtactcttccttgctccgagttgctagcgctatttacttgtttgctctgaattgctagatctaagtaacaagtatctaaatctcgatgagttgcctctcaacaaatcctcatctttctattctctcctctctgtactagtaactaattttgacttgataaatatattttgtcctctccgttgtaaccaattttgcctttttcttattttctcctctcacagtcacagtccgtctgtatgtatccgatgatggagtcgactttgggccactcgcggcgatttctgaatctgatcgtcggcatgtctggtgtcaaatcgctctgctgcatcgacctgatgcaccagccgttgttcaatccaacaacacctactacacagccaccaaacggcaacggatcgcaatccgtcccccagacaccagcggctttgatgatggagcagcttgtggttcctgcctcgagtttcagcttccaagcttcaccttcagcacccaactacgaccaacggaagattgagtgcttccccctgaccggtcgccaggtgatctgcgcggaccagttggggcgcaccttccactgcgacgcggagaggggccatgtcaggagcattccctgtctccacaagcccaagtcgatgcccttgtctctcttcgtacccaatcctgatgtcgacaatgacaaggaccttaatcgctaggactggggcagcagcctcttcgtcattgagaggttcccaaagtctgaggttagctatcaagtcgaggccttcgtctaccgccatcccagtccagcacgctactccaggacctggcactgcgagctccttcctcctccgccgtatctccatgaacccaacaagtacaatcgccgcctggagatatgctcctatgcagcacttggctcctcaagcatttgcatatccgtcaatggcatcagcacctaccgcctgaacatcgcaacccagacatgggaggaagttggcaagtggacccttcccttccacggcaaggttgagtatgtgcctgagcttaatctctggtttggcctctctgccgagtcccaccacttggctgctgctgacctctcctcgttggaattggactcccagccacagctactagtaggaccttggaaggagcttcacctgccggaggaatggaaggaatgcgaggattctcagcttgtcagtctgggctttggcaagttctgcgtcgcaaggttcttacaccctaatgataggattcacaaaggcgagctgggcgatgaggaattatctagccagaattgtatcactgtcttgactggtgtggaggtggtgccacgtgtcccgaatgccaacgtcaattcaaatagcagcggcagcgttagcagcaacggcatatcggaactccggatgatccc

SEQ ID NO: 56878 - DNA, 1501 bp, Oryza sativa
cctctctctctcgcgttcaaacgggcggatttgcccccgcaaatctcgccggcgccattgatggcggccggacctcccgcgccggtttcctcccttccccggccaccctctctcgacccggctctatttaaaccctccctgcacctcctccgtccgtttccgcctctcgccgcctttcctcctcgccggaatcgagctcgcgccgtcgctctctctcttcgccgtcgccgtcgagctccggtccgccgccgtcgtcgccccggaccacctcccacctcggcgccgcctccttcggcttcgccgcatcctcgccgacctcgtccacccctccgtttcggtcgccgaccgccggaacgccgtcgaccccgtcgacccgagccgcgccgccgccttccttcgctccggccgcctttttcgtcgtcgccgtcgacctagggtgagccgtggaccgccgcctcttttcccccttccctttccctctctcagccaccgtgcctatggccgccgccggcgaccataggggcgcgggcgccgcctcccgccggctgcgccggcttggccgtcctcgggcgcgccgagtggctgccgcgtggggcccggccgtcagccgctcgcgcccttaggtgcggctgacgcgtgggacccacggcgccggccggtgtgagcccgggtgcacccggtccaccgtggaccgtgaggctgctgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaagccatttttgtgctttgttcctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccattttataaagttattttgatttaaattattgcattatcgctttatttaaattcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatagttttaggctgggctcggggtgcatggttttgatagtagcaccttggccatataaggaccggt

SEQ ID NO: 56879 - DNA, 537 bp, Oryza sativa
agaacagagaacagaatgacccgggttttttttcctgggtcggccaaagaaaggcagatcaaatttcattaagaatagtttggaatgaaacaaggtaaatccatgaaattaagtttcgatttgaaatgttcctgttaatgaattttatatcttccaaacaagctaggttttgaaaatgtctccatgtttgtataacaacacctcccctacatatctctaaacatggttttatggtggtttcaattagtagatatttctaggatccttagggcacaagaacaaccccggccaccacagaaccatctcagatgtgcctgctccagtgctcacccctctgtctcactcctaatactacataatggctacagctctgaaccacaaacccatcaacttgtggacagcaacagatcagaccaaaaccaaaaagattactcggtctccattatcacggccaattagagtaggatatcatctaccgacggatcaataattgagtagtctatgtactattatacagagcagataagagcacaagca

SEQ ID NO: 56880 - DNA, 1501 bp, Oryza sativa
ccttccatgaaccttgatatattgttttggacacaaaacaaaggttttatgttgctcattattggcacgatttttttttgtttctgtgctatattttaattgtcatacttactggcgcctttagctgtgaagctcagtaatgtactttaaaatatctatggaggtatgatagctttgaagtactcatagtacctgacatttgaggatttaaccacagcagttccacatatttgaagattcaaccacagcagttccttgtaaatttcaacttatacttcctatgaaaaacatgttcatttatgcttgcgtttctatgtattcttcaatccttgtatccttatatttgactatatgttgaccgagttgcaaattacctatgcagatgctagatagatatgagcagcacacactgaaatgctcatcttgcaaaggggcatacaacgccttccagactctgcaaaaggtcttcatgggagcgacagtggcgttctgtgcaactgctgggattcctgcggatgttcagttcagattattgcttgccgctgctgctttggttagtgccgctgtagcgtacgcattttatacgctccagaagaattttgtatttgtagattacgtgcatgctgagattgattaaacaagcatgacatctgatctgagatctggtgaagcgacatcacacgatcatttgtgcaacgtaagctagggaatatagattgtcggtggatatagtctaatgttgcattgtaggcaataggtttgtaatttgtattagctcttcggagatgatgtacaaaagttgaaatgaaaaatgtaattttgctcatcatggcccaatgacttttgattgatgactgatgagttattctcaatgagtatagcttatttacattattgttgtagtaggtgcaattcatcttgctatcttgcaccgaggcacatttggttgtaaatctcaacataatttttggttgaactagtacaagaaaactctgttagagtgcgcttaacctttctaggtagtctgataatctgatttagctaaaaaccggagatggtgggtttttaactaaacccccttttccttgtgaatggagtatgtgattctcgtatgctccttaggtgatactatgtccctatttgcttcaaagtttcacatttcaaaaaccaaatattcaaactcccaactcgaaaattcaacggtacctccacctttcactcagatagtgaaagtttggactttcaccgggaataatgaacaaaacagtgggtacttcagaaaccattatccgtcacaaattttcttccagatgaacaagtcactttctcacgtagtagtgctacatacggtaccggcacagcggccaccgatgtgtatgcaacagtactagtatataccagcctctcaggattaaggcccacctttcagtgagcaaggaaattttctactaaggaggattccaatttttttttccctcaaggattccttggcccacctgat

SEQ ID NO: 56881 - DNA, 726 bp, Oryza sativa
tccattaggatatggactgtattttgtaaagcggactccttcccctatataaggagggtccgtgtgcctcttggggggcgatttttttttccagtttatacaatcaataacatactcggcggaatcatccccggacaggagtagggtattacttattgaataagaaggcctgaacctgtataaaattccttgtctccaaacccatccactttcctagcttgatagccaccctattttattattgccgaaatcttgtttggacaatatgttattttaattttaaataactttgtctatgccaattttgttcccaattatttctattcattcttcctctgaatattagcttgctccgatcaaccattgcagctagcaatagcatcggtgcaatgcgaaagccaagtataaaagcagcgatgaggcttgcacatgccgacatcaactgtcaaggagcctccatagcacaattcaccgaatcgttttggatggggttattgtcatcccacggtaagacggtttgtcacaccccaatccggcaccgccgcacaacggcacctgataggagcgtgtcgtaggaaaaacggcgcgaaccgcttcctacgaaaccgcgaactcggtaccagtcccaggacatagtgctggtacccacggtgacaaatatgaatcattgcaaatccttagaataaatagaggacttatttaccttaacttaggttgcagctcaga

SEQ ID NO: 56882 - DNA, 155 bp, Oryza sativa
ttagattgttgaaaacttgaaaacaaaactgtttgcaaaataacagccttccctttaagcctgcattaaccacctaagttcccctggcttgctgagtacgtaagtactcacccttgctctatataaatatatatatagttcctccgtcttgaaga

SEQ ID NO: 56883 - DNA, 249 bp, Oryza sativa
tcaatgctacatatttttgccaatggtcaaaagctttttttttgtgtgttttctcaatagtttttctttatttcctatgaaaacataagggtgtaaaggacatttaaatattaaatttgcatgcagagatgatgtggcatgtacacatggcatgtttagagggtctaaggactatattgaatcacacaatgaacttaaggtacttgtttggacaatacgaaatatcagggactaaattgatccttaagc

SEQ ID NO: 56884 - DNA, 652 bp, Oryza sativa
attcctgcagccccccagactgaagctgctgttgatataccataatatttggattgtactgcattgaacagggacaagatggatttcaagagcatattatgaggaaaaccatcaatacgttccaaaaaaaaaaaaccttcgagagacaaagttgtaaaaccaatattatatagaaagctaaagtgttatctgtctgaataaccctaaacttagaaacaataaaatgagccatactaaagaatcctcttaatattttatcctctgatcgcatgaacaaaattagggtgctatatggcataagtatgaaaaaagggttaactcaagtactaacactttcagttatttgacatatggtcgggaagcaagaaacgcataaatgtaatttgacatgctaatactacatacaccacaatttagtaaagcaatgcccttttaaaatttgacagcatcgttttagactaaacgcgacaaaagtgcataaatagatcatgtgtgaaacagatatgtatatgattgagtaactggagtatgttaagagtaactaaaatgcaatcttaaaaataaaatcatgttcaccttcaagccagggcagatggattcaaattcaatctttaagcttcataaaaatattgcccttcaaataattcctagg

SEQ ID NO: 56885 - DNA, 1501 bp, Oryza sativa; identical to SEQ ID NO: 49138

SEQ ID NO: 56886 - DNA, 1501 bp, Oryza sativa
cgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacctctgatcagagtataatctaatcggatagctgcaccctcaattatggataagccgagcaatgtacccaagttagtggtttaattcttaaaacttgctaagcaactaaaatttggaatggatggcttgggttggcttgggacgagccgaggcccagcttaaggctacctgtccggtccaactcatcgtgggccttaggccaagataggtttgtgtgggttcactgccttgtttaataatactgtgaagacttaggttcgagtttacaaagtagttttgagcaactattagtggttattaaatgccaattctatatcgccaacatatgcataaagtccagataataaaacatccaacatagtgataggtgttaagtctcacatattccacaagtgttggtgtatatttgtatgtatatgataaaccccgaaggtgggaggaaaagcaactaaaagtgaaggaggatgcatatccatacaaggaggagctttgaacttcatcaaaacattgaagaattagcccaaaattccgagaatcggataaggcaagcccagaaagagaaatgggccgaaggacaggccaagggagcccagccagggttcggccgtacccctggttcggccgaaccacaattacagtcgtccaagctggggtttggcgtggacgtcccggatgcatccctgatgacggttggagggcactttggacatttcctattcgctaaccgtcattaactgtcctatttaaggacctccctcacttcacacacacttccaagcttgagctgaattataagaggctctattgtactatattttatactagaatatgaagagagtagagtagaagaagtcggaagaattccgaagttgtcggtaatcttctcctatttcttttattttgtttattactctgatttcaactgaactatcttcctgagtaatttagatttatcttgtgagaattatctcttggttagttcctaatagcaaacgggattattgttcactataatcaagtaaaatatagtgattgctttggtgagttataaacactaaagtagatattaattgcttaaacgttgtgtttaggtaattgttatccaataattgatgcgtatcccacagtacatttgaggtaggtgtagaggtggtgacagccctctaga

SEQ ID NO: 56887 - DNA, 1501 bp, Oryza sativa
ctggccgatattgttgatatgcctcatcatgctgacaccgatgtgcttgccccccgagccgatgctgatgttgttcttcaatctaccccccgagctgacttttttgaataattaactcatcaactgttaccttgatcaaactttgtaatgtatccgccaaaactccagattgattaaacaatgcgcgatgaattgcttcatcaactgtatcttgaagtgtttcaaccatcggcttgcgagattgctacttcttggtattgacttcctcttcagacatgttgggtgcaaaacttgtgtcccaccgggcgtgccaaaaattgactcgaaaaacacacactggcttgggagatctgcttagctccagtgtaggtccaaaggttgacgatatgtgggtgtgcccgtcagtttgatcctgcaactgacaaaatatgcaaatagtatataatgagccgatcggctgacaagccgatggagcagttccagccgatagccgatattagtcgatgccgatagggttttgagctatcgacaatatgtccaatgaagataatgatataaaggcagtcggctgatgatgacgcaatataacaacaatataatcctttacaaaccaatcggctaacaatatgatatgatagaacaagtactgttccgatggttaaaccatacatcgactggaggtccgatgtcataaaatccacaaggttagataaatcaatgaaacctttgttgtcatccgctaaatccaacttatatgtatatgcaatccttataagccgatgccacgtccagataacttatcggctagcacaccaataaaacattagcatgaacctatcgacttagtaagatttatattatcaacaacaatctagtaggtcgaaactaaccgatgcagcacgagattgtatatgataatctcatactcgataagccgatagatctgtctaatgtgattgtagagtattgtgattgtagagatatatcggctaagacaaaagatcagacctaaccgagacagtcccaactaaaccgatgtgtctctaaacagaatgcaattagggatagaattgagatatcaggtaggcaaatatatcaaccaaaccagagcgatccaagagatcgaagcgatgcagtcttgaacaacaccaatgtagtcggtagattcaccagggccagcggaacgtaggacttaccccttcgccagagatggaaagccgatgcagccccgcgtcaggtgccaagttccgccggatggaagtaaaaacctcagtaaagaaggtggcgatacgcggagagtagttgtattgatcgagagattgatagattataatgaccccgggtgtacatatttatacacatgggtagatactagtctttgtaggacaagaaagaaactttcctaaagataacaggaaaacacgaagtccttatcggacactaaacacactttcctaaagacaaaaggaaactaacaaactattcctccttgagctcggac

SEQ ID NO: 56888 - DNA, 1501 bp, Oryza sativa
tatagaattggcatttaataaccactaatagttgctcaaaactactttgtaaactcgaacctaagtcttcacagtattattaaacaaggcagtgaacccacacaaacctatcttggcctaaggcccacgatgagttggaccggacaggtagccttaagctgggcctcggctcgtcccaagccaacccaagccatccattccaaattttagttgcttagcaagttttaagaattaaaccactaacttgggtacattgctcggcttatccataattgagggtgcagctatccgattagattatactctgatcagaggtgtacatctttacccataagacacgtcttcctcacgtgtcgccgcatgcaccataccaccatggtatacggacggaggaggtgacatagttcctaactcatcctagccatgaacaagagtaccgactgaacacccgcctacggacagggctccccggacaggtaggttatagttgagccccatggcatcaggacatccctcaggagtgaccacccggatgcccgtcctgtgccacgatatctcgactaccacgacatctgtatccgtgtccttttgttcatgtccaggttgagccccaaactaagccttacccattagacatgtggaagtacggtagtgctttgaaacagaagcccgaagaccgatccttatgatggccgaggtgctactatgaaaaccatgcaccccgagcgcaatctaaaacattttgggaattttgaatgacgaggagttgtatgtccaattccaacatatgtcgcaaattacgttgcgccgacgaggtccagggccacgcccatccactttgttcaaatatcaactgcatcgcaatcctcattccaactctctagcccgtgacatcttggtaccagattcttctggttccgatcccatggcctccacaaaagcccagctcgaaatcgccaaaaacctcacctcaaggctgcacaaatctctgatttgtcctggaagatgattgccttagaagcactcgtgccgctcgtatctattggcggtccttaaatcataatatatgactatcaatacctgcatataatggaataaaatatggtattcaacttagtggtagggtttattactaatcatttctattagtgttggtatatatttggatgcaggtgacaaactaacaaagttgagaggaaatatacatgaaggaggataatcaaacacatatacaaacttatggagttttggacccaaaaacccaattaaacacctccaaatggcccaatccaccatgccaatgggctaagggcctcaaaattagtgtccacgaggaaaaatgagccgaacggagccatcccgggttcggttgaaccaccagtttagccaaacccatttggaggccgttgatcgcctgattttacatcgatggccctgattacatcctaatggcggttccggggcattttggacatttggcataggctctaaccgtcatacc

SEQ ID NO: 56889 - DNA, 1501 bp, Oryza sativa
gcaacacaactttgcatttgctctgcctggttccctgagcatctgtcttctcatagtccaaggagcgtggtatgaatgttgagattattatacacttccccttagttgtctttttatttcctgcagaaggtcagtggacaacaaataccggagggaccacaaaaagttgaaaagattttatcatagcctcaagattagttgttcacattcatgctaaaaaggaattggattgaaaacttaatgagcatggatcccataaatttgccataattttatttttgtcattatttttactttttactcgagagaaaaatgtttttttttccgagagacatttcttttattcttgaaaacaatttttatcaaacttttatttaagaaaaactcatatagggctgagataaagttacataacatagcaaaggagcatttgacaataggtcacggcagctaaggcgggagtagaccttgcaaagcagggcgaaccgggcttccatggcgccatcgacggtgaccttgggcttcttgttcggcgcgatcgccctgcgccgccatcggagagctttcgccgactcagacccggcctcgaaggggatggagtggtaaaaccacttcgacatccagtggcgagccaacttgaacatggcggcgttgaccggccaaagatcagagtgctcggggcgaacattgaagttcacgctcccgaacgctgtcttcttcgtccctgcgggagtgaccaccgtcttcgagtttacgttgcgtaaaaaatggtgccgtaaaaaatggttcgaacccagcggtccggcacgcccagtcgaagatggcgattcggacgagagccgatgggcttagttgagggagctccacctaaaaaaggcgaaggatctccgaaaacaacacgttgcacggaaaccgaaggccgtctcgaagaacacggcgaagaccaccgtccggctatcgccgggcttcggcacaacagcctttcctgggggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaa

SEQ ID NO: 56890 - DNA, 1501 bp, Oryza sativa; identical to SEQ ID NO: 40191

SEQ ID NO: 56891 - DNA, 1501 bp, Oryza sativa
ccttttttatttggtcaggggtcaccacatgggcctctcgctgcctaagaaaggaaacatgctttttacaatgagggctagtctacagccggaagtgacatctgacaagcagagcacacgcctcctgccccgctcgcccgcttttcccggggacgcccatttcaaccttcatttaatggccagcgacttccttgccatgcttgcgctgaagcctggaatgaatctgaccgggactgacatacccactcctggagttggcatgccggctccggctagggacgagagccaggaagctctcatcattccgacgggacggggcgaggcgtgtgacaggccgcctgttgccacctaacccgcgatcttgacctgtctgtgaccggtcactcaccgcgaccggtcacggaccggataagcgtgcgctgcgccgcattaaacgcggcgtggcgcgctcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccttcgagcccgacccccccgagggggtcaggccacgagggtgaccgcggctacccaagcctctagtcacgatacccccggccccatgtcaccgacagtgttggaaacagtaaatgtattaatttaagatttttctttgggatccccctttacatgtccctagaggactatttataatcctattacaggttcacccctttagggtttaggctttacaggggaatttacatggttgcccttatgaaagggacgtttgcttgggtatacagtgtaatttggatacatgggcctctaatgggccgattggcgaacaggcctgagcggccgggatggccccttgagcctcctcaaagttgggcttgttattgcgaagtctccatccttcggcatacacccttcgcccaagacgcatttggtcttgccggataccagcacgactcttcggccttcgccatctttgcttcatagtcctcgctggttgcacggtttcggcaggtctggtcgaagggtctcatgacatactgccaacaagcccctcacgggcaagggtgagttaggagcttcggccgagaccgtgcaaaccatgtggtatggtatgaggcgccccctttcgaccgacgctcctgccgaaacctataatacagtcctacaggaaatgtgtacactttgtgcatatgtatttttacggttagtaaattttcctagctttcgccttttgcaaacggcgaagccgtccttatttttttccgtgggccgcaataaacagtgacaggcttcccttcatgggcttagcactgtgtagctcaatgaatgggaatttaccattttgcctaccctcgtgacacatggcggcttacgattgggtgggaaggcgaattgacgcttgggtgg

SEQ ID NO: 56892 - DNA, 1501 bp, Oryza sativa
ctgctttttgagctgtctgctcctcggggcgaattctatgaaccacctccttcatcagagcccatttatacaactggctatgaaattcgtcccgaactaattagtatggttagggaaaaacctttttttggctttgatctagaaaatctctaccatcatctgcgatacttttaacaagtttgctcatgccttaagattcgtggcatgagacaagaaactgtgcggtggaaattgttcccgttctctcttcaagagagagcaaagcaatggtacacctctaccgttggatgtgtaggcggtagctgggagaagttgcgagacagattttgtcttgccttctttccagttactcgtattactgccattcgagtagaaattctcagttttaagcagatcaaaaatgaatcaatcggtgcagcctggtccaaattcactaatttagtgtagtccggaccaaccctgtccttacccgagtatgtgctactccaacatttccatacgggtttggataaggagtctgcattctatctggacataaccgcttgaggatcgttcatgcacaaaacgccgtcagaaggaaggacaattttggatcgcattctagaaaatacttccttcatggcgcaatccaatgaaccctagccagaggcatccatgtccaagatagaggaacctctaacgatcgagccactcactgaaccatccacttctgctagctcgattgatgagaaggttcctaagcagccgactgtcgagaatgaagaaattcagactccggattatgccgcaattctgttcagggacggctttgacgaagactacggcaataccctgaactattttagaaagaggaaaccacccgttcctttgccacctcctaatcctatggaactcgggttcctacgagaaactgtacgggagttaacatccataatgagcgatgaatggctaagggaggcagaactttcatccaaagtaattcggataaataccgctccccgaatcattccttgccatctggaagggaacgacgtcggtattctctacagtccaactgtccgggccaatctcgtttcctagtcttttgcattcgcttatttaagcgataaggcaatgaccccgactaacaaattcttcaaacatccaaacggaaatatcattgaaggatttgggattgtacaagatgtgcctgtctgctttgaagacagggaggcgatcttggatttccacgtctttgaaattcaagatttcgacatcctaatcgggctgcccattgagcaacttctcattaacacaccccgattagatagcctcaaaataatactgggagggaatgaatttcagttccattctcacgagcaaggatcgccttgaccgattccctcccataaattgagtcagcggaggaggttagtgcagctccccactcacgagtctcccgaggcccttctggaagatgaggtccccgattttatcaaggaagaagcagatcccgttgaga

SEQ ID NO: 56893 - DNA, 1501 bp, Oryza sativa
ccattctcctccattttgagttcattctctgcaagaggttagtaaacctaatttacctgtgttgatgcaaacatgtgttgatgcaaaaattcaaattgatgaaaataaatatgcggatacataccaatttacctgttggcgagggtcgtgtcattttgggtccgacgtgcaagaccgtacctcctttcagtttagttcgcagattttccacccgtctccggaggtgatggagcgggcgtctttggcttttccttccacaccctctttggttttggtgcgggagatggcttcttctgagccggttgctctagcttcttggccggtgtactggattttactagcgtcttccaataacggttcctgggaaacgttgtttcctttttcaggaaattctgcatgaacttcaccatgctccacttcgaccacttgaatattctatggattttgcccacacttgatcctgactgtaacgttccgcctctcccaggccgggccgcttacatctgatagctctcataggtcatagaatgccctcacagactaacacaagtcttttctgcacactttgtcctcactcgtgtgcacccgggaagaatttcctgatcatgccggttcttatgttcttattaaccttctaaacctaggaaaatataattagagagagagagacctcctaaaactaacttgcgtaaaacttcttcgtttatttaaattattttatgacttttatttaaaacctatcttcagttatatcgtgatttgatacttccttttttaccatgatttcctttatttaaatttatttaaaaacccctttgtgaattgtagtccaagaaaccttcccaatgttgcccttgaacctaaaccaaagtaattccaattttattggaattaattgttagcccatcctttgatcttaaacctatcctttgactcttgatccaaatatccaaattcctccttttgacctagccaccaatttaatctctgtggcttgatttccttctcggcacaagaataatactattacaaatatatgaatgattgctcttgtgctaagaaatttattttcattccttttcattcaaaaatccaaatttcctttagtccataccatatgatactgggttaaaatcttattcctctatttctaataccttcttaaaatttatccaaaattagcaaagcttcctattcattttgggccaaagttccttcatctggcccagtcaggaataagtctatattacctcccttctccttcctctgtacatggatacgccgccaccaccgttgccgtggttcgcacgccgccgcccacggcttgcaccgctgccttgccaaccatgccacatcgacgccgtgccgtgctctccttctcccgccgcccaaccctactacagctgccactgttagatagatctccctccccttgagcccaacggctcaagggggccttgacccgcgccctgattgggggcgcccagcccaatggcttaga

SEQ ID NO: 56894 - DNA, 350 bp, Oryza sativa
gaattcaaatattttctatatatagtatttctatacatctaaagtttatagacctaaagtttataagtcaaaagtttatatacccgtttcaaatttgaatttgaattcaaatattttctatatatagtatgaatttaggtagatgcttcgctggttaattaggcaacattaggtggttttacaactctagactttgggaatactcttttcacctggacactatgtaattgttggactattgtggaattggattcacacctccccctctattcaaaatcctcaaaatggttttaggctgggctcggggtgcatggttttgacagtcacacctcggccatatagggaccggt

SEQ ID NO: 56895 - DNA, 1501 bp, Oryza sativa
cagtaaccactagggaccccctgtgccgattgatactccagaggccatcttggttatggcagtgttcagagtttggtacagatagctctagcagatactttccaaggggaaattgtttcttgtctacatgttgccagtttgcagtaggaccacaacttggaccatgaaaaaagaacttctcaagccacatcatgaggaaagctgcatgctcccttgcaaagatcggcctagtacccatgttcttggcaacatagcctgaccaaccgcctatgcttctgattttgaactcttgggtggattggatattcaagatggtcaggttagccgatgaggtcacatctaggccagtaatcattataacatccaaaagagttggagtcatcggtccttgagagaaaaggaaggtattcatggctgtggaccagaagtaagtggcagctaccatcatggactcatcttttgccatgtctgctgcagttaaagccaaggcttgggatatgccgatttcttcccagttggttaactttctagctgacatcctgttataccaagcgggccagctcttttcggccgatggctaagatttgaaggtgttcttccataggcttagatccggttagcaaatctaaaggggattcagttggtttcaccattgatgaactctgtggggtctgggttaccaattgggccaaggaaaaactggaactcatcggttatactagggactgcgacttgatgagagagatgctacagaaggaggaaaatcgaagattgagcagaagaaaaaccaatcttgcacggaaaagaaagaggattagccgatgggtacttacctcgacattctcagaggttgatgcgctcagaggactggcggtggttgacattgtcggcgatgaggagtggaatcacattagttacaattccagaggcccaagacaggtgacgcagcaccttatttatgtgattgcggccaaacgacatggaatttggcaatgaggctgtaaagagggctccgagagctttccatcaagcacttacgggccgaaaacagtggtcgtatgcagattcggtggccgtttgaagtcagcaatgtagcaggtggccgaatcggattccagcacttggaggacttgatcttgatatctccttgttcatccatgatgtgagcaatggttgtatccatagcactactgcaaaaacggcctgtagagacgttccgtaagagacggctaagcacgtcgtccctattaaagcccatctcccactttgcctcttacgtagatacgctaattacggacaggataatagaccgtctctacaatcacattaatcagcgctaaacaatttggtaggaatttttttttgctcgttccctccaaaaagatcaatctttccaactttttacctcattcatgcggattttttttatctcccttggaactcggaagtagttacgatattatctaagagaacaaacccctctccttctcttgtaaaatct

SEQ ID NO: 56896 - DNA, 962 bp, Oryza sativa
gtttcccttagctgctagctgttgtaaatatcctctacgatgaccaaattacagttgcacaaatatgcaaagttacatgccagtcacctatacattataaaataattagatgcaagcaggaaaaacaaaccatctgtgcattaaatttttttccccaatatacttgggttgctataacagataattaagaattaaatactttgtctgtaagcagaacacaaatcaaacatcagctgtgcaagtgtgcagaaacagtattgcaattaggattgctactgttgccaggattcgatggctgaggaatttgggcaataccaggaagaaaatcaccgatgaatctgcggcgtgtcgatgctgctgctgtggggcaaacgatgggtgtgtggctggcggatgacgcgggggccatgcatctctggcggcgccagcggcgctcagcctggaaggcacaggcggcgatgggtggacggtgggtgctaggcggcacaggcggcgttcaccccggacggcgcaggcggcgatggcgtgggtagtaggtgcgcagccctggcgtcgccggcggcgctgagcccagacggcacaggcggcggccatggggctcatacgcgagaggccgccgtcttcacggtggagctaatggaaagattggaacagattttacaagagaaggagaggggtttgttctcttagataatatcgtaactacttccgagttccaagggagataaaaaaaatccgcatgaatgaggtaaaaagttggaaagattgatctttttggagggaacgagcaaaaaaaaattcctaccaaattgtttagcgctgattaatgtgattgtagagacggtctattatcctgtccgtaattagcgtatctacgtaagaggcaaagtgggagatgggctttaatagggacgacgtgcttagccgtctcttacggaacgtctctacaggccgtttttgca

SEQ ID NO: 56897 - DNA, 511 bp, Oryza sativa
ttttttttgccaacacaagatcacctaatgatttgcggtgcattaaacagagtcgccaaaatcaataaatcaaaattggctagtgaaaccgatttcgagattaattcgctttcgtggaatcacacgactaatttacgagcaaattagtaaagaagataatatcgtacttacgtgacgacgaacgactagtttccgagcaaactagcaaaggataaccttctcgctttcatggagaagcacgaccgtttttcagcgcaaaacggcaaagattaaccaaattctagggttgctagaactcagccataaaaacaaaatagaaaagaactaaaaagtaaaagagatgaatattagattgaaattgggttcccttctattctaccgtggaccaatatatatagctaattgctctgatcttttggcatgtctactcggtcccacgcaatatgcaatgatggtttaccggaatatttgaaacaattcgatccaacaaactctttatcttctaactaga

SEQ ID NO: 56898 - DNA, 163 bp, Oryza sativa
aacaagaatatctggcaccattgccggggaattgttgcttatcattttcgaacccagttcatcctcgtatctcttttcattttttttattctacctttacccttgctatccagagaagtattccttttaaattcttctcgaccatggagcaatctcttttcga

SEQ ID NO: 56899 - DNA, 311 bp, Oryza sativa
gcagtctgttagcaaggagcatcaagagttcctcggccttgtcgacaaagaggtataatgtgaacttgtaaattgatattagagtgacaattattcatgcagttatcttccatttttattgcaaatacttgggagggctcaatccctcttggtctttgttgaatgcagattgaattatattatatactaatggaattccgccggcggtgtgaggcccactcagagtaggatttggagggtgcagaactgtttttgcattgccaatgaaaggaggaagccgcctcaaagagccttgtccccatccaccaaca

SEQ ID NO: 56900 - DNA, 1501 bp, Oryza sativa
gagaagtctttaatttacactcataaatgactctaaatgagatatggttcgccaaagaagaaataaaatgcttcataaaaaattgagctaccagtttaggttcctttatgcctacttttagccaacagttctttttttattcagacaagcatggaggtcacattttgtttccttaactgtggttcctgggctcgcctagacccgatatgcaatcgatgacattgtgcaaaaaagaaaaattaagaatgcagttggccgaaaaatgtagaataggtaattgggatgcttcaggctaaaatatccagatatctcagattaataacatacaagttgtaaactacataaaacctgccatcttttcagatgaaaagcgatttcaagaataaaaatggataatgttcaaaaaaaagaataaaaatggacctaatgatcttagtgaaaagaacaatcataaattcagaatgatctagattctagcattcactagtcaattatatccaaggatcaaatttgtacctggagggtggggagtcgatgatctcgttggcaaaaatagcagatgcagaaaaacaccagagtatgtgcatgttgtaggtgttgttctgctctgacaaggatacctgcgaatcaatgaaaacgaaagacaaaacagatgtcttcatcccaacaaataattgatgcactgtaatttacattttgaatctctccaattggagccgggatacgctgcttgctcttcttgttggcctcagcttgggagagtggtgcagcaccagtcgtcgccccggccaccgcggccggctcctctcgctgacgatcacttggttgaaggggagcaccactggccgtctaaatgcatcatgaaaacaatagcctctagcagcgggcctgactacattgaaaatcctacaaaatcaaagggtgtgtcagagcaaagacagaaagaaaacaaagcggaacaggagaaaggagatgactagatcgatggggttgatgccaggtgcacagaggagacgttgcaacatcactggcatccctttcttctccttctcccgtttctcttcgtgttgaaaagaagcaagtggccacatccggtgaggcgggcgtcggcgccgggagagtgatatggaggacgccgctccatcctctccgtcgccgccgccgcacctagtcgaggctgttgccgttgccgacgctcaactgctccaccgagccgccaaagcgaccgcctctgtctctcagatccaaaaaaataggatcgggattgattgtaactgaatggagaagtggttagacatctatatatgttgtgtaggtactgtccagtaaaaatattactcagaatatggatgcgacaaggggcttggggcttaggggggggggggggtgcggactggctggaggacaggagtgtgggtgtgttttagctatactacacccctgttgtagtatagtatctcccgatatacatatatatatatatatatatatatatatagga

SEQ ID NO: 56901 - DNA, 389 bp, Oryza sativa
agtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatatatatatgtatatcgggagatactatactacaacaggggtgtagtatagctaaaacacacccacactcctgtcctccagccagtccgcacccccccccccccctaagc

SEQ ID NO: 56902 - DNA, 1156 bp, Oryza sativa
ccccccccccccccggtgcccttttgctgtcgggcctaatgggccgcgccctagcgcccccgctgccccttgttttgccagcccaatgccgcacggtagtgggccgaatcctttagatttcggcccaccacccaatttaccatttaaatttagtttttaattttattttcagcagcaattacattttagtccctatgttttctataatttagtggaaacagttcatcagctcttcatattattatgtaatggtccaatagactacttatgttatgtgttaattaacataggtgtttattcaaataccctatttcactaaatttatttgttgtcttaataacatgccttttgcatattatttcaagacacgctctactttctcgttttattaatttacaaaattctataaattttgtactttgatttagcaaattctcttaattatgtacaacataattaatggaggatttaatgcatgttccacttcacattttgacttggaaattaatcacatgtcgatggaatcctatactttggtcatatcgaccataacttaggcagcgagtatctcgcccattatcaagtggtctacattttgagatgattacccgatggagtcctacaaattgatcgcactggtcataacctaggcagcgagcatttcacccatctcacagaggtctacatctcacgatgattacccacatgtgttattttccgagaatatgtttcgaaaaatgagattatttgaaatttggttgaacacaaggtagtggagtcctaaacaatggctgcggtatattcaccagaatatatttgcctggagaccatgttttaggcagcaagtataacttgcccactattaagagatctactctactgtttaattacttggagattatccacattgtgccacctaatttcgaattctaactcaaaattgtcaggtctattacctgcatttttcgaaagattacaaaatatgaagttttacattacgcattgagattacaaccttaatatcatgtttttattaatttacctctgtaaattgataatgttaaccatgattgtagggacatggcaacaaaagagttcgacgaactcgccctcgattggactaactatcctatctgggcttctgatattaaaatca

SEQ ID NO: 56903 - DNA, 1501 bp, Oryza sativa
gcatcagacaatcctcacacaacaactctgatggttatcaaccgtaagcacaattgatttgactacgaagtattattcttacaaagaaatcggataaatatggaactatcggtataaaataagcacaactgatttatcataagagttaaatactccaatggttctgaaacttatcttcagatcatctcaaaactctaaaaaagcatatttagaccccctgaacttgctaaatttacaatcaaaggtcgaaaagctcagttgaccatcctagtgccaatgtggcaggccaacacacagagacctgctgttggtccttaaacactagggcatcctccttgggcaagaaaactgtggatgagaatgagaaagagttgagaagcacatcagcacatgcacaaaatacatcgtccaaagtgaggacatttgctgccctgtgagccccatgccagcagagtcgatgttgctgtgccacattggtgttcaaatggtcaaaaacacggttttggacctcaatagcagtattagagttttgggtattttaatacatatccgagttcagtgatctggatgacatctaacaacaagtttaaggatccttagtatgttttactatcttattttaatagctcttctaaatattttagaacaaaaaataattagtggtcaaagttgtatttcgaaaaccatgtcgtctatcacaaagagtattcaataccatcatttttaaaaaataggctaaaatgtctcaaacacaatatacactagctaatatcccgcatattgaagtagagaatttagaaataattcaaagaaaactcgaagaaaataatttataaatcatgtacttgtagtgcctaaatggacaatattttattttgagctctatatagtacttgttgtgaaattgtaattgtacattagttatgtatcaagcaagagagatctcatatttgttactcttttagtgtcatggttgcattgagctttataataataataactacacttagtgagttgtaaaggcatatgacaaatggatgattgagatctaagcatgagattaatccaaaagctactattttctagactatttgtcttaatgtatattaagtttttcgttccaattatatgggctatatagattaagggataatcgtgctatagattagctattacattttttatgtaaattactaccagggctttgcccagtagttatatattaaaaataaaagagttatttacagagaaaacaagaaaacaaaaaccaaaaaaaccccttgaatactacaagccttgtaaccagctaagaatagctattacataattaaactctactattgcaaaccgataacaaagatatttttattatccttgaggaggtaccaactacatctaactattgatctgtaagggttaggatcggtacttataatttacaaattgatgagcgaatagcttacgcacgatatattcttgataatctcttatattatatgaa

SEQ ID NO: 56904 - DNA, 1501 bp, Oryza sativa
gttttaaaacgtttaattgcatgcactcaataacttcaaggaaacaaaaataatagagccctatcggttggcctaataagccaaaagaaaacaccaaaatttaaatttttgaacttgaagttgattttaagatattttcaacgcgattttttaagtgttgacttttaagtcgatacgaataaatgtgtaaaagttttacttgtaaattaatttttattccggcttattagggaatatggccacctatgaggctcatagacatcaagcgatctcggttaagatcattaattcagacaaacgcactagtattgcgagggttcggatgtatttaatcttgaaaacttctaatgtactaaccttcaacttgtacaataatgctaatgttttgatttgaccatcttatgagcaccaggtttctaaaagaagtacaataatgctaaatgttttgattttggagcatcatatgcacataaagttccaaaaaggatcatgagagagagagtaaatttgtgatggataattagcatttccatatagataaggtcaacctatccagaggtagatttcattccagtcctctgtaccgtgcacacatatttatttgctcctatgtaaattaatctacacaacgattaattaattgacattcaccatattaactaggctatgaagtcacgcattcgcgtgactctaaccaacctaatatacattgtcaaaaattgtaaaagaaaatcataaaatgttaactaaataaccaatcacaacattcaacctgttaattctctagtgacttgctcatttcaatcaatcgtaatcttctgtcatttaattttacctattttttaatacccatgttgaatcctaaacatcttacatattgggaaggcagtacaatgcaaccatttcgagaaatcaaagatatatcaaattgagggcttatatgtaaaatgaattttatagaaggatcaaattaaaaaattgcattgacatttggacccggtctctcctcaccgatttctcttatttggatttggaatctagaagtctcgtgaagatttgctaacacctgtgttttgtaatctatgttcatccaacggtgtatgtcatttcactgttagcatccaatggttaatactattttgaagacgtggcacatcctttgatgcattgtgggatttacacttgtacaaaaagatcagctaggccaggtatatagagtatgtttttttaatcatcgaatccgattggcaccttctgtgcctaacctccacaaattaactccgatgatttcataaggagattgagacataactaattgtgcatgcaagatactccatctattttacaaacagatgccagtttaggatgtacgcattttgcagtacctatagtacgtcactgccggttcaagttcaagtccggagcgtcgctcccaccccaagggcgaccggacagcgacacaaccccaccaccgccgctaccctcgctcttcccctccgcc

SEQ ID NO: 56905 - DNA, 1501 bp, Oryza sativa
tgtagtactcctaagccattctttgtactaccatgaatcattttatttactcagttctaaattctaatacatactaacatatgtccaactgtgcattagttacatgtgatcctaaacttcattaatcttaatgcttgctttacgatgtatttcggtaaaaattagaaattttaatattgttgtattgcatccccagatttatcgagtagctaattaacttaatttgatgccaagatatgtcattctaaatttatctttagattatttttttaaaaaagaacatttctttcataactaccagtatgcttcaattttagctacatttcatagaagtgcaatgatagtgtatgcttttatcataaaacaacaacttcgcttcaatgacaggtcttggcccactagtcatacacatacgcaatagtgatgatgttacaagttgggcccatatgtcagagacatgtaggggataaaagttgcagtttcttgataaaattgtttgctattatggatgttttgtgaaatactcacctaaacttgtagcagtgacgtaggggatgaagttgtagtttcttgataaaattgtttgctattacaaatgttttgtgaaatacccacctaaacttgtggcagttatagttttggccacatagttgtaatttgtggattttgttctaatctttatatattgttgttcaatgtaatcatagcctgatccagaaagaaaataatataattttgtctaattgtaatgagagaatacattatatataactgaatttgtccgagtttaataatttaccaccgatattttctctttctataatataccgacgactttatcaattattctataacaagtcattgggccgggccttcttttgaacagtgccaaaaataaccttatggacatacaaggtcaatttatctcattagagtttttcaaaaaatatgaaaattttcatgtggtctccttaaacaacatggacatttgtatataagttttaagttttttgcatttatattttttaaaatataatttatcagctatatgttatataaaatacttttttgtgttgttttttaaatgtttttcatacgctacataagatttttttatgctattatattttgtgtaagtaaattatctcccatataccacataaaaatattttttctaaaaaaattaaatataccagaaaaatcttgaaacttatataaaaaattatcacgttatgtaaggaggtctcgtagtttttttttataattttttgaacctcatatctctaatagtactttggggtttttttttaaaaggactagcctaatggtatatcttagaatatatattgataaagttactagtatattctagaaaaggataatatcagtagcaaatcgttgaattagaacaaacttagtggcatagagaattgaactataacaaacttagtggcatagagtaagggactctgtctttgataaaataatgtgtactactagc

SEQ ID NO: 56906 - DNA, 239 bp, Oryza sativa
tataatttttctgtgcatttggtttgatggagtgtgaatgtgtgatagcacgaaagccctatttcacccaaacgcccgagcaaagatagcacgcgggttcggaacttgaatgacaaacatggatgctgaaattgccctctgaactctgaaccagaaaaacaaaaacttggacaattctttgaaatcagacaaggatttgagtcttgtgaaggcaacagtgattctttatgttgggccaa

SEQ ID NO: 56907 - DNA, 287 bp, Oryza sativa
  unsure (1)..(287): unsure at all n locations
ctaggggnnattgtttgatacgtgccgaccctnnnnnnnnnnnnnnnnnnnnnnnnnnnnnnnnnttaattaaataactccctaatccacaatgctgtatagtacagtatcatgttatatnnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaga

SEQ ID NO: 56908 - DNA, 1501 bp, Oryza sativa
acttgacaactttgacgggctatgtcatatgacctatcacagatgatggttcattatatataactcggggaatttaactatttaccacttttacatttggcaattgttcaaatgcccctgttaggtttgcagttaacaatatgccattgaagagagaagattttctaattttttgccacttttcacattgtacactgcccacatgggcttgccagcatggaatgggaacctgaaatgaccagtatacccctactgccaacttcgtgttgtttttgatgggtgtaagcgaggcaggaaccaaagttaagtgaaaaaaaaaatgaaaaacaacacaattaagcctttcctagcgattggtccaggactgcgagtttatgctgcatgcacttgtgattctgcagctgcttctttcgctgcagctgctcttgttcctggtgtgtattcgcttgaagatcaactgcagcggcttgggcatcaatggcaccctttgctttcttccttcccacatttgtttttgtcttcttgtttctcttccagcaaaaaaattggttagcgtaagcaatacattgtgcaatagctaaaagaaaggcaatcatagctaaactaacctcttcctagttccagtcagttcacatcttgcactacccttcctgcctctgccgacgcggggagagcaggggtcgacggcgccgcgttgcccgtcaatggtggcaaatagttaaattatatataactcctatatgtgacgggtcattctgtttagcctaactttaactgggtttattgctacccgttagaggtgacggcctccgtgacaggttgctggtattcatcacagatagttcatcaacgttggccggatctgtagtaatgaagtgaaacaatttaaattttaaaatttgatcaacgagatgactgaaagagactctttccctcattcttagcctctgttaaataatctaaaaaaaaattatacgtacaaatgatatattctagtattagttttctccacaagactacaaccgattctgcttagggccattgttgcgtgaaaattaaatgatgaatcaatgatgtcatggtgggcggatcgggcaaattaaaatggctgaaaactgatgcttcgaactgctcgtgcatcacaagctagaatctgttagcacttgaccaaacagatactgttagcgtttgaacacgacgaccactcccagccccatatatattccacacttatgcttcagacaaaatacaccacacctatgcttcagacaatatacaccacacctatgcttcagataatatacaccacacctatgcttcagacaaacctatgcttcagacaatatacattgttcaaaacactatttattcggctgaatactattcagtttactgtttattcggctgattactattcaaaaacactattcagtttactgtttaaattactgttcaatactgttcacttcgagagatattttaactttaggatctttgcagg

SEQ ID NO: 56909 - DNA, 1501 bp, Oryza sativa
gactaattatttttatttttttttataaaatttgtaaataagatggactgtcaaacgtttgacataaaaacccatgactgtatttaaaatgcaacgaacttagtattacatatttatgttatatggattttatgtgtttataatacataggtttagtgatatcttgttaaacgtaacatataaaagtgaaaatggttaaatatctatctagtgttaacatttgtgccggtaggaatgaacgtaaaggatacaacaatgaaaatgtaacatttaccatcctggcccgtctagctcagtcggtagagcgcaaggctcttaaccttgtggtcgtgggttcgagccccacggtgggcgcctttcatttttattcttttaaatttgaagtacttttctgttttgccaccaattgatgtgtgtgtttagtttcacacacatacaaatcccttttactaggacagggttgacatggtgctttatgtttcgccctgattgacatgaatagaagccaaagcatgttaaacattgctcagcacctgggcaacttgctctctccctccatttaattccagctgcaaattttaatttccatgtaggaaggggaaatgtggttgtgccgctgatgcttaagccgatttttaatttctcaactgttttctcttcctgctgcctcgcaagccacaatgtttgatgtctctgtcaagtaacttaaccctcaaccacgctttccacatgggctgtgcctgtcccgttacatggcgagatagagagcggacatcaaatgccatggttgattttgccaaaaggctcgattggtgccatctctaagtaatctagatttgtgttccagtgatccagttcgagcacatcctaatcaggtgctaactttgccatgtttttttttcgaacgtgtaaaagaattacacgtcaatatattagaagaaaaatgttatatctacacaacacaatcagccagaccagcttatgatgctaggggaaaagagaaaaggtaaaataaaaagctaaagcttataaaactacggcggctaaaacaagactccaaacaacgggaaggggccgagccacgctacactcctaacaaatccccaaaagcggcaatcgctaattttgctatgcattgaagtagactcctcaatctcctctttttttagcggtttatacgaaaacaaggtgacataactccagtccattcagaatcagagatgcagtcccagttgccaacgaaccatcttaagacggaaagcagcaaaagctctcgtggtgaaaaaaaatccccaacactcgcggcggatctcgctgtcagctccagctcggctgctcctgctcttgctcgcccaggtcaacatccccatccaaaccccaaattcacaacgacacgcatgctccagcgactccgttccgcttctgctccccacatttaagcaaagcgagaaggagaggagaggagaggagctaccggcgacggcgatgggaagggaggcgg

SEQ ID NO: 56910 - DNA, 1501 bp, Oryza sativa
agggcaaagttaaacaatcgagcctttaatatgagcacttacaacaaattaatataaattctttagggcaagttaaaaaaccgagcccttaatgtgaacagaaaaactaagcaacgaaataacttcggatgggataatttaaaagatagtagatgtaccagtaagaaaatcacgttcatatcccacatgtgctactgctctatcaactactccctccagttttttttatatgacgctggttagtttaactttaactaaccagcgtcatacaaacaaaaatagaggtagtatcatccactcatcaccctagtatgtctcttgagcctaacgtaggacacaatgatgagctaatagcggtgcagctagtgacggcgaaacctgtcggcgttaacgatgcttcccttctctccctcacctccaaactacaccacctcttgctccccattcactctctcaccttgagcatgcgcatacggaggcacggtgatatcaatgttgttgtggagagctaatctgtcggatggcattgtgatggcagagtagggcatgggcgatggatctggaggcctaggtcctacactcctacccatcgttcgatactggcaacgaggacgctggactacgtcggtttccttcatctcaagtttatggcacggtggcaccaaatccggcaagctcctcactattccatcatgctgctcattagcatttgtgtacaggtacatcgtgcattgtcttcctcgaccaatacccataatgtatcaggcatgatacccatggtatcatggttgatattcatagtattaaatccgatgtctatgaatattaggcctgatacccctggtacctaggtgtcagccaagattggtacacgcatgtaccatagtacccaggtaccggacctgatacttgtgggtatcaagtcttggtatctcatatatatgatatcaagataaggggagccacgcacttcatcgccgctttgccagctgggaagacgcttgcctctagcatctcctgtccccttttctcttcattttctcttctcgactccatcctcttttctttgcagctgttgtggtgggagtcacctcggctgctactacggctatgatcatgccctactctgcctcctcctagtgtcctagccactagccccgatgttatcgtgtcatgctagaatcgttgtgcatccacactaggcaaagaatgtggggtcatggttacttcaatctataaaatccaatagtcgaatttgaaaggagtccaaatttagtatgattggttatgtaaagtttgtttcttgtactagagagttttctagggtgattaggacttctagtatgagtttggttcgtggctttaggctgcctaccttggggtataaatagagaggaagcgtgaggcttccctgtatcgcttttgagactaattgagttgatagttgagttaggtttcgagtttagtcgagatttttataaggagtgctggtggtgcactt

SEQ ID NO: 56911 - DNA, 1501 bp, Oryza sativa
accggttttaatagttgagggagtcattctacccggtgttctggttaaagggtatgaattagattcggcgtactttgaaggagtcaaactggactttttcctttagttgatagacgtgggctggtgacctcttctttttcgtggtgagtgggtcgcgatggcctcgcagcgacgcggcccacgtacgccactttgactcggcttcggtgtgccggcttgagactttggcttgacgacgtacgtccgtcgcctacgcggcgggatattccgccgcacctcgccaatatcctcctcctcctccctgcatggagatctccggagcttcggctgttggattcttgcgcacggcaccctgcttttcacggtttttgtgttccatgagtgtacgcagcgccataagacgaaactccagattgtcacagttagctgttgagaatatagaaaaactactggattttcttgtatcttctagcttcagtttaatttttaaattctataatacaaattttgtgagaatctagactatttagatagatgaagatttttttaaaaaattattcactccaacatatgcttacgtaatttttttcaaagatgtccagattcatagttttaggataggtctaatcccatcctaggttctaatatattgggacggagggagtattccctaagtcactgtttagtttccaaaaacttttcacgaaaacatcatatcgaatctttggacacatgtatagagcattaaatatagataaaaagaaaaactgattgtacagtttgcatataaatcgcgagacgaatcttttgagtctaattagtccatgattaaccataagtgctacagtaacccacatgtgctaatgacggcttaattaggctcaaaagattcgtctcgcggtttccagacaagttattaaattagtttttttcatttatgtccgaaaacaccttccagcatacggtcaaacgtccgatgtgatacccaaaaattttcatttcaccaaataaaaagaccctaaatgtgagtgacaatggcttctttttgtcatgataaaagtgcagtcgtcatcttttcatccctttctcatcatacgaagaaagtcaaatgctcgtgctttatttttaatccacccaaccagttaatccctaactatatgagcatggttccttgtaaaacatgggcataatactagtcatgcctttagtaaaatttaaaacttcaagcatataaacattatttcgtatattacattggacagaattatttgcttaaatttgtcttaaaaatttcttgtacttgatttttttaaaattgctcatcgagcaaaggtcctatttgcaagagtagcatcttctgcccgttggccgttaccaatttccctctaccagcaagactaccgctgcaagaagatccaactcaaacatcaacgcggcgagggttccgagatcgggaggcgaggccgcgccacgccgcgccgcgccgcgccgccggcgatgg

SEQ ID NO: 56912 - DNA, 1501 bp, Oryza sativa
aaacaaagggtatatatccaagtaatgtcttgataattttatttttgagttcgcccctggaaattaagggtatatacatccaagttacatattataatttttatataaaaatatatgtaccaagagattatttagctatctaattaatttttatactatgcatttggttgttagccagaaaattggaaagatggaaagggagggttagacggggagagagggagtacgtacatacatgtgcgcattttttttcgttttaaaacgtattacgtgaacttgtgttcggaggggggaacgtacagattttttttttggaagataaaatttaatggtgaaaattaataatctaataatttaaaatattgggtctaccgatttaaaggaaagtgtcacgtgacggtatagaagcatttgtaggagtgacatgtggcggcttaagagtatttgtatgaaatttaatggacttttagtaaaaaaaacactttgttccgatcacatagaaattctccatttatcgtaacaactcattatcactattataaaagttcattacctattaatagatgaaattgcatatgtgcaaataaaataagcctaatatatcattaatgcactacttagctaagtcttcatgtctcacttatttccaaatccatatataaatattctaaaagtatcactttctaccaactaataggataacaacctttaagttaaacatgaatgcctcactaataggtgatctattaccttgaaagttgggtacctcatcgatgtagctgtgtcccctcaagatcagcataaagcacaattttaattcctaatttactataacattctcatagagtactataacatacttgggccacctcaacttagccatttgtatgccacgtgatccaccaatttaaataaaaattgatagtgagattatatagtgccacatgacgatctaagagcatttgtaggagcaccgcatagcaacttagaattttttaggtagtttagtagactattagtatataatattttttcttgctgcggacagtactaccgaaactttatttccttttcaatcctactttttttaataggtactatgtatacatctgatctaatggtctaaacaggtgcaccaatttaaacgaaaatcgagggtgagactacacagtaccacgtggcggcctaggagcatttgtaagagctccatatggcgacttagaagtgtttgtaggatcacaaattagatatataattttaaaataattttaaaagatgaacatttatagatggttgatttgatatttatattatagatctagtttaacactacatgcaatatatttcatctttatattgtagatagttctattttaaaggccatcgattttttcagatggtactaagtacttatgttttactttagctctatctttatagtaagtacatgcatttttttcttccggcaaatattatgtacatgagaaaggtgttacatatt

SEQ ID NO: 56913 - DNA, 936 bp, Oryza sativa
acacttatatgttacgtcaactataggtgtgtagataaagaagtacctacacacacacaaacaaacaaacaaacacacacacacacacacaatgcatatataccaactagacagacacacacacacacacacacaaaatgcatatataccaactagtgtgctcttggtatataccaagccatcgtatgcccaactagtttacgaagataactcaaaatctacttttttgttatatagtcattggcaattgtgttattttcatcacaagacctaatatttttcatgagaaatatgaagaaattcaataccttcatcccttcaaggacatgacgtccttgtgtttaactatcatttctgatgtaacaaatgtatcacaaaactacactatgtttttacaattatgtgaaatacacatatgtacacacgactagtatatgtgtgaaatcaaggtgttgatttaatctatgtgatgaacaaattgtccaaggtaagtagtgttttcgctcggtgcgtagtgtagtcgacattgggtagccggtccgaccgggcgggtgccgcttggtcagaccggtgttgttggggcggtctgactgggtagcccgacggtcagaccgacaatctccggaagggagtcagttttgggttattttcatggaatttctagatggtttctattcatatgtgatactattctgtgctgatgtgagtcaagttagtgcaaacttatatttggatatgaagtttctttgttgtttatgtgcaagtgttgcttgaagccataggagtatagccggtgatcgatcgggattaggcttcggagaagttgaggcccatacggtcaaaatatcatgcgggatgctcacgctagataacaatgcttgtggaggtgaaggttttcatatggcatatacgttatgttatgtgcttatagaaaga

SEQ ID NO: 56914 - DNA, 1501 bp, Oryza sativa
cttatacatgtgggctggaacctactccttcggtctcataataaataaacattgtattatataggagtctattgtaactcactgtactggactacactatatttgtttattttctaatttacagtactgcaatacactatatttgtttattttatttggaacgaagggagtagcatcatatcaagcgccaatgaataatgtaggtgtcggatcctacataatatcacacagtgcaactgcattttcttctcatgtcctatctagtgatgaggtttttaattacttcatgcggcaggccaccaaactgcctctgcacttgtactacagccaattactacactcttttgccagcaattcatagtagtatgaaataattatttgcttgtgatttatattaattggttcctgtgaaattttccgatccaaatgagtattaattattatatatgattaaagtgtaattttgggagcaaataagattcgctaaaattatagttaagataacattaattattcagataaatatagactaagccatatctgtgattaagatgtagagcctcatcggtttgtccatatatatcccctaataaaccaaaacgatttattagggaataaaaaataatttatagttaaacttttatatttattcatagcgacttaaaagccaacgctaaaaagaaattttgttgaaaatatcttaaaataaactttaaaattaagtccaaaaattgaaattttggcttttgctttggcatattaattaggccaactgatggggctcgtagattcaacatcggttttcgttagctcgtttttcaagcggttaaatggtatgtttcatgcgaaaaccttttatataaaaattactctaaagtattagaaaattttgattttaagtttataataattagaacttaattaatcatatgtgaataactttctttgttttttttatcctaactatatcttctagtagaaacgaacaccatctcaattgatcagccagccgttgaggtgtctgaagaaaaaggaacaagctagctagctacaaacaaatttagcagctgcagacacaaatggaagatgctgcatgatatatgcattcagctacacagttgtggcgccaaagaaacggctagtcgattcatcagtaatgtcaatcaaatgtgtcaagcaagcatgcatgtgggcacagggaattgcagtggcgatatgatggcccaactaaaaacagaacgacgctgctgaatttgcattaacagatggtaagctgcctcattagttgattagctatctaattagttacatcgtcgtcaattagttgcacatcaactcgtagaaatcttctcacctaatccatgcaatctaattagcctgtaaattaacggcacaccactcaaatttttttaaaaaatatacttttttcattggatttacgtaaaaatacacgtttagaaaaaaaattgtagaagtataccattacagaacgaaagtgtga

SEQ ID NO: 56915 - DNA, 1501 bp, Oryza sativa
ttggagtcttgttttagccgccgtagttttataagctttagctttttattttaccttttctcttttcccctagcatcataagctggtctggctgattgtgttgtgtagatataacatttttcttctaatatattgacgtgtaattcttttacacgttcgaaaaaaaaacatggcaaagttagcacctgattaggatgtgctcgaactggatcactggaacacaaatctagattacttagagatggcaccaatcgagccttttggcaaaatcaaccatggcatttgatgtccgctctctatctcgccatgtaacgggacaggcacagcccatgtggaaagcgtggttgagggttaagttacttgacagagacatcaaacattgtggcttgcgaggcagcaggaagagaaaacagttgagaaattaaaaatcggcttaagcatcagcggcacaaccacatttccccttcctacatggaaattaaaatttgcagctggaattaaatggagggagagagcaagttgcccaggtgctgagcaatgtttaacatgctttggcttctattcatgtcaatcagggcgaaacataaagcaccatgtcaaccctgtcctagtaaaagggatttgtatgtgtgtgaaactaaacacacacatcaattggtggcaaaacagaaaagtacttcaaatttaaaagaataaaaatgaaaggcgcccaccgtggggctcgaacccacgaccacaaggttaagagccttgcgctctaccgactgagctagacgggccaggatggtaaatgttacattttcattgttgtatcctttacgttcattcctaccggcacaaatgttaacactagatagatatttaaccattttcacttttatatgttacgtttaacaagatatcactaaacctatgtattataaacacataaaatccatataacataaatatgtaatactaagttcgttgcattttaaatacagtcatgggtttttatgtcaaacgtttgacagtccatcttatttacaaattttataaaaaaaaataaaaataattagtcatatataaagtaatattcatgttttattatctaacaacaataaaaaaaattaattatattttttttaaaaaaaacggatgatcaacgttagatatagactgtaaaactatggtctgttgacaacttgacataggtaagtgaactgttaacaacgttcagtccaaactccaaatgaagacaagggtcgcgactctccaacatcctctctcctggtgaagtggtaattgccccggcacacgccgcttctccggttctcttcccccactccatactgctgctcttccccggctgcgttggggtttcaggttgccctcctcctcctctgcattctcgttctcatccctcccatttgattctaggcgatttcttttttcgaatttatatgtactattttttgggatttctcgggtatattctatagattttcatttttttaatctt

SEQ ID NO: 56916 - DNA, 1501 bp, Oryza sativa
gataattctcggatatttcggatacggatacgaatacggatattttctcccggatacgaatacgaatatagtatcagggtttccgtcggatacagataataattcggatatccggtgaacagtgctattcggatatccgcaggacccatgagacataccccatttctttctaactctataaccttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtctgatcatattcgattcttattcgtattcgagataatccgtatttttttccgtattcgagctatccgtattcgttttcgtatccggtaaaaaatatgaaaacgaatatggtatgagcaatatccgtccgtatccgctctgttttcatccctagtcctaatcaagtgtgtgtgaaactgttaattaactgtagtacaacacatcaagagaagtgaaccctgcacctagtatatatgtcaagtacaaaaaagatggagtaagttgttacaggcaaaaacagattagcgacgcatcaactctaacatgaactaaatgcatgcaatggttacttagtttaaacttgaatctgatagccatagacatatatattggatttattcatttccattgtctaaaaatgctgtattattatttatattttagacaatgaatatatatatccaatatatgtttctcgataatcaggacaaagttgtaaatttagggggcaaatgagattatctgaaatataaaataagatgacattattcaggtaatttttattttgaaacttcttaattttcttaccttttcgcgcttcactttgaatccattgtcctcaatattattgccatccatctctaggtaggctaggaacgacaataatgtggtggtcaaggctaggaggagatcattgtgatacaatgagtctaacattgacaaaaggagtaaatgggctccatttgggcatccaaagaggaaaatgtgggttagaggtttaacatgaaactttaataaagatgaggagtccaaattaagtccaaactaaaatttacacaaacaaaagaaattaactctcttttatggggcaagtcatggaaactcatagaagtgaaaaaaaaatccataatacaaagatgcctcgatcgataattaatcaggacaaaggtgtaaatttaggggcaacgattatctgaaatataaatattaagatgacattattcaggtaactgtacagtcggacagccgttgagatgtccgaagaaaaggaacaaattaaccagctataaacggtgaccaaaaagcttcagacacaaacgacggatccaagctcctggatgcgttcttgctgcaacg

SEQ ID NO: 56917 - DNA, 1501 bp, Oryza sativa
attttataatcccatctgttcgccgcacacctcctgaggtgaatcctagtgccgcgccgccgccatatcgatcgtgtgttttctcctccaatttgattgtaaaaatcgattccccactcctctctcatcattttctcaatgatttacccttcgattcagctttaattgctggatttaatatctattctgcagttgccgatgatgacagtgatcttccccggtcatttttatcccgagttttacgctctgattttggggaaaacggaaagagtagatcgagtggatcaaaaaccctcgaacaattttggttacccaagaaagatttggccggatttgatgggggagatttgctctggcaaacgtacgggcacgggattatcttcgggaggttgaagatggtagtcatattcgggaagttaaagatggtagggtcgaagagaagcagaccaaatggaggaaggtagcgggctagcctaggaggaaggcttttggccaaaaacccaggaaatattttcattaactttttttaattataatctatagcgatcccaatgttaagatttttattaactgtttcaattatagtgtatagtgatcccaatatttcaatttattacttagctcttaatatatcactgaaaaagagtctttacccgttacaacgcacgggcatcttttctattataagaaaaaagttacactcaccccccaaaaccgttctcgatccctcggccggtcacacatagccccggcctcacgtccccgccgcccgccatccttggaggagtccttgccgacgacccgggcttcaatggctcctccaacccgcccctccttctcgtcttctttgccagtgcctaggcttgacaccgcatcttccgacgaggagctcatcgtgaaggccttcttcaagtccgagaaggttcaccctggtcaggtcatactcattccacgagctcaaatctttagctattggttctacaacagttgaactgtttctgtatgagtcactaaatcttgttatgtttgttatatgtttctgtgattagacccagtcaagtggcgataaatagttggaacattgtgtagagacagccatgctgctagcgaagattggggcgaatgcaacggtcctctctgccaggcttctgcataacaccattgacaattcatttattgactatggtcacttctttcacatatttggtgttggggtcgccgatcttgttatgtttcagttaccttggattttgataattgttaccagtggattggttaaccaccaaacaattcaaggttcaatgctgaatttctgagtcagcgttgagatggaaaatcagtaaaaattgttcccaaaataagaatgcagaatttttatcacttagagaattgtgttgatggtcatcccgttatgaagcaagctgtagacaaattatacttgttacagacaacattggaatatatcagccaccgtgatcaaaatgttacccttcattgccca

SEQ ID NO: 56918 - DNA, 1501 bp, Oryza sativa
gggaaattggtaacggccaacgggcagaagatgctactcttgcaaataggacctttgctcgatgagcaattttaaaaaaatcaagtacaagaaatttttaagacaaatttaagcaaataattctgtccaatgtaatatacgaaataatgtttatatgcttgaagttttaaattttactaaaggcatgactagtattatgcccatgttttacaaggaaccatgctcatatagttagggattaactggttgggtggattaaaaataaagcacgagcatttgactttcttcgtatgatgagaaagggatgaaaagatgacgactgcacttttatcatgacaaaaagaagccattgtcactcacatttagggtctttttatttggtgaaatgaaaatttttgggtatcacatcggacgtttgaccgtatgctggaaggtgttttcggacataaatgaaaaaaactaatttaataacttgtctggaaaccgcgagacgaatcttttgagcctaattaagccgtcattagcacatgtgggttactgtagcacttatggttaatcatggactaattagactcaaaagattcgtctcgcgatttatatgcaaactgtacaatcagtttttctttttatctatatttaatgctctatacatgtgtccaaagattcgatatgatgttttcgtgaaaagtttttggaaactaaacagtgacttagggaatactccctccgtcccaatatattagaacctaggatgggattagacctatcctaaaactatgaatctggacatctttgaaaaaaattacgtaagcatatgttggagtgaataattttttaaaaaaatcttcatctatctaaatagtctagattctcacaaaatttgtattatagaatttaaaaattaaactgaagctagaagatacaagaaaatccagtagtttttctatattctcaacagctaactgtgacaatctggagtttcgtcttatggcgctgcgtacactcatggaacacaaaaaccgtgaaaagcagggtgccgtgcgcaagaatccaacagccgaagctccggagatctccatgcagggaggaggaggaggatattggcgaggtgcggcggaatatcccgccgcgtaggcgacggacgtacgtcgtcaagccaaagtctcaagccggcacaccgaagccgagtcaaagtggcgtacgtgggccgcgtcgctgcgaggccatcgcgacccactcaccacgaaaaagaagaggtcaccagcccacgtctatcaactaaaggaaaaagtccagtttgactccttcaaagtacgccgaatctaattcataccctttaaccagaacaccgggtagaatgactccctcaactattaaaaccggtataatttggctccctcaacggttttggagggcggtttcgctgacgtggcactttgactcggtccaaccggctgactcagccatatgggacccacatgtcaatgtcacattttcctct

SEQ ID NO: 56919 - DNA, 1501 bp, Oryza sativa
tatatgaatgttatatgacatggttgatattaagtgttttaccattaggcagcataaacaaccatgaccttgtgcataaatatatctctggcatggcgtgccaaaaattggcaaatgattctcagagttaaataaaatgtcaaaaaattcacaatgaatgaatattgtatttcaagcttagtctagatataaaatctatttttgatcttttaacctgaacaaagatatcaagttgcagaacagaactattacaacattcatgctatcattatgcttcaggaatctggactgattattgtaacaccaagcaaatcaaaatactcaattacctgcaatcatagtagcatatgtttttgcacaccataaaccaagctctagtcaagtcacaactaataacatctttttgttgtactgtatagacattgttcatatggtcattctccgggatttaaaactgtacgttatgtataatattatctcatatgtacacatcttgatctatcaaaaccttaaagttgagaattggatatcagactcaattttcgttgttccaggacataacagtacaatatatgtatacagtaaaattatttagaaaatgacaagccttctaaaaagaaaattatgactgcgcagcatggcagacgatataaatatgttaatgcagcatgacagacaatgacatggaaagtttgtgtgcttgactactatgaatcagagtgtgtcaaatgacttgaagcaacaaaattcagatgcttttatactaattgggcaatgaagggtaacattttgatcacggtggctgatatattccaatgttgtctgtaacaagtataatttgtctacagcttgcttcataacgggatgaccatcaacacaattctctaagtgataaaaattctgcattcttattttgggaacaatttttactgattttccatctcaacgctgactcagaaattcagcattgaaccttgaattgtttggtggttaaccaatccactggtaacaattatcaaaatccaaggtaactgaaacataacaagatcggcgaccccaacaccaaatatgtgaaagaagtgaccatagtcaataaatgaattgtcaatggtgttatgcagaagcctggcagagaggaccgttgcattcgccccaatcttcgctagcagcatggctgtctctacacaatgttccaactatttatcgccacttgactgggtctaatcacagaaacatataacaaacataacaagatttagtgactcatacagaaacagttcaactgttgtagaaccaatagctaaagatttgagctcgtggaatgagtatgacctgaccagggtgaaccttctcggacttgaagaaggccttcacgatgagctcctcgtcggaagatgcggtgtcaagcctaggcactggcaaagaagacgagaaggaggggcgggttggaggagccattgaagcccgggtcgtcggcaaggactcctccaaggatggcggg

SEQ ID NO: 56920 - DNA, 1501 bp, Oryza sativa
agatgtttttttttactgactacgacggaagctttttttttttaatagctcgttaactgatgtttgaaacgcatgcgtccaaatgcgaaacggaaagggacgacgtaccaaaatcccatggcaaaaacaagttaaacttttataatagtagaagataaacccttgtaactttgcatattacaatgatatccatagcagcgatctctcaccgtagatctgtgatcgtacggctgccggagggggagaaagctgtgccatgtggcagggctttttgcacccgaatccttccagaattcggtattagagattccactatacatgtttttttttatttttaaaccttttgaatttttaattttaaaacaaacctttctaagaacttatttccaagatctaaatcttttaaattctatacggtctaacatgataaaactgtgatgccagctgtggatgatgtgcagttttgtattaccacgttaggcgggctggtataaccaaaagattcatatataaaaataagtttgggagtattcatttttaaaaaaattaaaaaggtcaaaaagtaaaatctccaacacagaccagatataaaactttagcatgccagtctgaccggaaaaaaattctatggcaccgggtgccacctagcaagtatggcacccctgttggatttaagacacgtggctatacgaatctcgaaaccgtccctctcgtcttcttcccctaccgtgaaatctatgaatctaccatacaacgatgaagtgagttataccttgtctcttcttccatgaagaattatcaggactttcatttgcaccaaattaaatcaccttacacatgcgagaagtgaattatctgaactttctttttacaccgttacttgattaatcggagattaaatgacttgttggatgtagtatattaagttcggttgattaaactaattacctagcgttttggttccatgtattttcatagttcattggaagtaatggaggaacaattaatctgttttggatgaacaaggccggctgatggactactactactagtatcgcctgtgttgtaggacgagagcaacgcgtaccctcgattctgtgccggtggattagatcattaattaattagataggaagaagagacggaggagcggttccatgcggggaaattaggagaagcgtttcgaagcctgattccttgccggtgattagaggaagggaaggtagaagatgaagttgtaccgagatttgtgcgcggccacgtgtcttgaatccaacagggatgccatagtgagttactctaaggaattctttttttaagcaacgcttgcacagtacacatgacacactcgcacaacctggagtgtgcgacacatgctcaagaaagagagccaacaataaacttgtgaacatctccaggaggccagtttgataagccaaactcattacttactctaacagtttcttcatccgcacttttcattctgactctacgacactaa

SEQ ID NO: 56921 - DNA, 1501 bp, Oryza sativa
ggaaaggaggaggtccggcatggcgacgttgacgacgaggacgagggcctgtccgttcgcgggatgatgggctcgaagtggcgacgtcgatgacgagggcgagggcctccacgcatacctcctccacctcccacgccggccgcagccgcgcgctgccatcgccgacggcagcgacttgatggcggcggtgtcgagtcgaagatggccacagccgcgcgccgccattgccgaccgcacgaaggggacagggaggttggcgagctcgcgccgctacccgggagccgccgtcgccggccgcaccaccctccggccgcgcgcgtcgccacccgtgcgagagcagacaacgagaggaaggaaggaatgaaggaaaaaaagaaagagaagaggagggaaagagagtggtgctggcgtggcaccatgacatgtggggcccacgtgggtcccacggtgactcagccgccacgtggggcaaaaccggggttaaaactgccgagggatcttgtttgcactggttttgtaagttagaggatgcgttatatccggttttgcggttggggaacgattttgtaactcgataacaagttgagggaccttcggtgtactttttccattgcaaaaaggaaaaagtacaccgaaggtttctcaacttgtcattacaaaatcgtcccttaaccgcaaaaccagatatatgaccgtaaaatctaaacagagaggcctctccgtttaggcttaacgcgcgatgcccgtgccagccgtccattggcgcgcgggcgacgtggcgtgcatccggcgcgcgcgcttgtcccgaccgcgtgttgcttatccaaaccgagctgctccgctcgttccgaccgagaaagagagagagagagagagttgttttactatttaaaaattgtgggtggcgagagagagagagagaggcggaggcggcgacaatctccggcgaaatcgtcggcggaggcggtggagatgtcgctgcggcggcagtgtgggagggggaaggtgcggttgtttcgtcccgtcgcgccgacggcggaatcggcggtggaggcagcggaatctgcgtggaggcggcgttttttctctccacatcgtgcttgcagttgcggggggaagtgaaggctgcggcttaggtggttttctctccaccaaatctggcgcccgtgcggtaagttgcagcgtgcagagaggtggttgcggttttttttcagccggagagtggagtgatttttgtgtgtgatttttgtgctaggagaggtggagagattaggcagttttcactgtgcaaatttgtgtgccgggagaggtggagagattgtgcagttttcactgcgcatatgtgcgattttttgtgctccacaaacctctcggtttgttttctcccctataatagctctatcccctcatttcccctctctctctctctctccctcatccaggtgttagttcgtcctctccgtggagctcctctgcgtcctctcggcgagtgcaaagtttg

SEQ ID NO: 56922 - DNA, 1501 bp, Oryza sativa
gggtctaatcacagaaacatataacaaacataacaagatttagtgactcatacagaaacagttcaactgttgtagaaccaatagctaaagatttgagctcgtggaatgagtatgacctgaccagggtgaaccttctcggacttgaagaaggccttcacgatgagctcctcgtcggaagatgcggtgtcaagcctaggcactggcaaagaagacgagaaggaggggcgggttggaggagccattgaagcccgggtcgtcggcaaggactcctccaaggatggcgggcggcggggacgtgaggccggggctatgtgtgaccggccgagggatcgagaacggttttggggggtgagtgtaacttttttcttataatagaaaagatgcccgtgcgttgtaacgggtaaagactctttttcagtgatatattaagagctaagtaataaattgaaatattgggatcactatacactataattgaaacagttaataaaaatcttaacattgggatcgctatagattataattaaaaaaagttaatgaaaatatttcctgggtttttggccaaaagccttcctcctaggctagcccgctaccttcctccatttggtctgcttctcttcgaccctaccatctttaacttcccgaatatgactaccatcttcaacctcccgaagataatcccgtgcccgtacgtttgccagagcaaatctcccccatcaaatccggccaaatctttcttgggtaaccaaaattgttcgagggtttttgatccactcgatctactctttccgttttccccaaaatcagagcgtaaaactcgggataaaaatgaccggggaagatcactgtcatcatcggcaactgcagaatagatattaaatccagcaattaaagctgaatcgaagggtaaatcattgagaaaatgatgagagaggagtggggaatcgatttttacaatcaaattggaggagaaaacacacgatcgatatggcggcggcgcggcactaggattcacctcaggaggtgtgcggcgaacagatgggattataaaatcggatgagacaaacaaaaagcgcatgggagaaaaaaccggcgataaaaaagattgacgaaaaaaactaaaagcacccgagagagacgcggtgaatagatcggattaaaaaaaaggtaaaaaaccaaaagccttagcgtgggtgcataaaaaactcttatgcgtgaaaaaaaaagaaaaaaataccggtgccaaaaaaaccaagtggattttttttaactgggaggattttttttctttttctatagaagtagaacaagagatgtttttttttactgactacgacggaagctttttttttttaatagctcgttaactgatgtttgaaacgcatgcgtccaaatgcgaaacggaaagggacgacgtaccaaaatcccatggcaaaaacaagttaaacttttataatagtagaagataaacccttgtaactttgcatattacaatgatatc

SEQ ID NO: 56923 - DNA, 1501 bp, Oryza sativa
cacaatgttccaactatttatcgccacttgactgggtctaatcacagaaacatataacaaacataacaagatttagtgactcatacagaaacagttcaactgttgtagaaccaatagctaaagatttgagctcgtggaatgagtatgacctgaccagggtgaaccttctcggacttgaagaaggccttcacgatgagctcctcgtcggaagatgcggtgtcaagcctaggcactggcaaagaagacgagaaggaggggcgggttggaggagccattgaagcccgggtcgtcggcaaggactcctccaaggatggcgggcggcggggacgtgaggccggggctatgtgtgaccggccgagggatcgagaacggttttggggggtgagtgtaacttttttcttataatagaaaagatgcccgtgcgttgtaacgggtaaagactctttttcagtgatatattaagagctaagtaataaattgaaatattgggatcactatacactataattgaaacagttaataaaaatcttaacattgggatcgctatagattataattaaaaaaagttaatgaaaatatttcctgggtttttggccaaaagccttcctcctaggctagcccgctaccttcctccatttggtctgcttctcttcgaccctaccatctttaacttcccgaatatgactaccatcttcaacctcccgaagataatcccgtgcccgtacgtttgccagagcaaatctcccccatcaaatccggccaaatctttcttgggtaaccaaaattgttcgagggtttttgatccactcgatctactctttccgttttccccaaaatcagagcgtaaaactcgggataaaaatgaccggggaagatcactgtcatcatcggcaactgcagaatagatattaaatccagcaattaaagctgaatcgaagggtaaatcattgagaaaatgatgagagaggagtggggaatcgatttttacaatcaaattggaggagaaaacacacgatcgatatggcggcggcgcggcactaggattcacctcaggaggtgtgcggcgaacagatgggattataaaatcggatgagacaaacaaaaagcgcatgggagaaaaaaccggcgataaaaaagattgacgaaaaaaactaaaagcacccgagagagacgcggtgaatagatcggattaaaaaaaaggtaaaaaaccaaaagccttagcgtgggtgcataaaaaactcttatgcgtgaaaaaaaaagaaaaaaataccggtgccaaaaaaaccaagtggattttttttaactgggaggattttttttctttttctatagaagtagaacaagagatgtttttttttactgactacgacggaagctttttttttttaatagctcgttaactgatgtttgaaacgcatgcgtccaaatgcgaaacggaaagggacgacgtaccaaaatcccatggcaaaaacaagttaaacttttataatagtagaagata

SEQ ID NO: 56924 - DNA, 1501 bp, Oryza sativa
atgccctctctttatcttctcatcactagtacaatgccatactaaacgattgtatctatatgtcaatccagttcaacaaatttctgcagtggcgagagcgatttgctgcagaatatgatcatggatagctgtcgaagtcctactgcaaacaatttacccaacagaagagaagccaaccagtaatggtatacatcagcggtttacatgtttatgtcttgaaagccatctttaactcctgcgtgatggatgcaatcaaatcaaacctttacaaaggcgcaattaacagaaaatttgatctaaaaaagttaaagaacaaacataaatattgagatgccatcaatatattgtgccacaaaagggggggcctggccttcagttcctgccaagctagtggagagggttagaaggtagctatcaccttatgatgcatagaacaaattaatatttatcatcaacggcttctgacaatgcacatatatctgatgaacaggttgaacacagaacactagtgattaaacgggtccatgcatcgcatggctttcattaggaggttgcaaggtcccatctaattactagctagatataacatgatactgtactatacagcattgtggattagggagttatttaattaatcagcatatatagctgatataacttcactggttggtggagtacacttcattcagttgttcagagatcatatcgttggccaatgcagtatcattatttatgtttgtttctgatcttatatagcaggacaggatagagttattgttgtaaattaaaccgagacaaaactctccgttacaaacagtacgtcaaaacttggcaagtacgcagtgtagattgcacttgaaaaccaacagattgtttggtcgggaggtgctattaacactttgcctaattaattgcctgcaatgtaggtaaacatgtactaaatagaacagtacatgcaaattaagctggaggttacagtacttagcttatttacttcctacaagcttacatttacttgttttaacctagcaatagttattaatctatgatatgatgatgcatggccaacatcggagatatgaatgtgccctaatcagcgatcgctttgagaagctggccttcaatttgatccgtgcaattatcacgtggggacaagaaaattcggtagggagccacctgtacaaagtttggtgagggccacgtctactgctagctcaaagagcgtcgtcaacgcacaattatgtgaagattgcagcgcctacaagttataccatccaaaaaggaacaaatttggtatctgctccagtttgtaaaatttctacctctgtttttggctagttggctgaaacatatggtgtaaattttatagcactacgtatatagttttaaaaactgtcgagttaagtggtgcaatcccacttatacaaattcaggatttctataattattacgccacatttgctcgctaaatttcagtcaatttttctctctgtgattgttc

SEQ ID NO: 56925 - DNA, 1501 bp, Oryza sativa
ataggtccagtgggggtgcgcacgtagggggaggggagcgatcgattttttttcccatccccccgggcgaccgagaacgagcattgtcggaattattcatatttaccaatttagctatttagtgatgattacaacacggagttgaaagaaattaggaagttcattttatatatggctagggtcagaaatatcgaaacggcatcgctttttcagaaacaagactaggtcggtcaagaatttccttcgccaattctatccccatctttaaaatagtgcatagaaatccgacttctatatctaaaacactttccatctcattttgtagttgtgtccattttcaaaggttacacgattggatacactttccatctcataactgagatacacagaaaaagaaacaaaccgaaaaggaaacactgtaactcatatataacgtgcaactcttcccaaaaaagaaatttgaatatgtctgcttagttgtagtggattcagcattttgtcgattagactgtagcccaattaactaaagaagtagttagtggtaccgcccttgagctatacagaaagcggaaagcagtctgtactttgcaaagcaaaatctagctcctctcctctcacacctctccttcctccaggccggccgccttcagtacaacctctctgttaactcgagcaatgcatgcgtgcatctatgtagcctatcgcatcgaaaagtaagtgctaccacccaagccacaaatcaatcattaacaaaaggaagagccctttgctttcttgtacctgatttgatcagaaatcttaaactaaatcatcacaactaaaaagataacagtgtgtcacactcgcattacgcgtaatcgcaaaacaaacaataatatatagactacttcattaccttattattgagggaagtttctcattagaaacaaaaaatcttaatcagatggcgaagcgatccgatcctacaccgctattggtcgttgcatggccagcttggatcacagtcagccccacaccagaagtggccaagtggaatctcagatatgttgtgccaatatatattttttttttgcagccaaattagctgcgaaagggatcgagagaaggtagctagctaagtgtacgtagctgctagtgcctcccatcgccatcgatgagtgatgcgtgcatgcgatgcaattggggcgaggcgaggagttggattccacttcggttgttggttagtagctagatcaatatatcgggtggagcattagaaaaaggcacacatgaacacgctataaaaaagacacatataagtcggcacaataggtgtcgaaacagataaaaccgacacctataatgtttttcctgcccaaacgcgcatccacgggacacctcggctagaactagcatctttataaagagataggtgtcggttttaactaaaaaccaacatctatatataataccagcatcggttttttaaagaaccgacacctatatttatattataggtgtc

SEQ ID NO: 56926 - DNA, 1501 bp, Oryza sativa
ccgatgaccaggctagtgaggcgactacacttgggatgctgtgttggctgacattgtttttttttcttagatcaggctgacatagtagctgatgacaggggaaaaaaattgaaaaaggtaatggctttgcctcttgtacttcatccgtttaaagttataagactttttagcattactcatatttatatagatgttaataaatctaggcacacatatatgtttagattcttaacacatatatgaatgtggacaatactagaaagtcttataatataaaacgagggaagtatattaatagagcagaagtttacaagcccaaaaaacactatgtaccggacatggcgtgtaaaggaaaaaccatgtccgcaaaaggagatagggaaaattgatatgccgaagctcatatatatacatagttagttagaaagaaaacaacgggtgtctgtgtaaagcgagagccaaagctacggtgagaactacggttgataaggtgtggaaaaataaatgaaatgattaaaactaatttacgggtaaaccttttatgtctattttcttagatttaaaagtcaatgctgaaaaataaattaaaataagaacacctcaaaatcaatttaaaatttaagttttattattaacattttagctgtggctgacaagccaacaaacaaatgatggagcttacgctctcttgtcctgcattaaccctcctgttcaaggcttcttttttttttcactatgaacacacgcacgtaaaccctacctatgagcatcttcgaaaactaggccgataaatcctgaagagattgacgaagtcaccataggcgtctcgctgtcgacgggcacgtcgcctaccactgaaagcacaatgccgttaaatcgcctaccactgaaagcacaacaccgttaaatcctgaaaaattcactcccatggggagtcgaacccaggacctcaggtgctactgaggctcttgtaaccactagtctataggccctttcgcgaatttagctgtcttttatttgtcagattaagcgcatatttgattcgttgctgaaataaatgaatccaaatgtttagtaaagagggttaacatttttggtagacacatttgtcagattaagaccatttttggtaaatctaaaggttggtaatccaaatgttaacaaggtcaaaaatgtggaggtgttggtttaagaccttaccaaaattatttggtttggttttggttcattgctttacaaaaatttggtcaaaccaaaatttgataagttttgttttggcaacaaatgaaacatgcattacatttttgcattgaattagtatatacaacttaatatcaaagctaaaggtcgagtataaatcttggctgacgcaattgaatgtaaaacttatttttcagtttttccatgacacaaggttcatcgtgagagggagcatttggtggggccaatatggtttaaagccaaatcttgcattaccaatatattggcattttaccaagat

SEQ ID NO: 56927 - DNA, 1501 bp, Oryza sativa
accactaagtttgtggtcgtcagtggttgttaaaggctccgtcgttaatagttttaacgaccaaacgatctttacccgtcgttatttcattaacgatggtgctttttttttgctatcgttatcttattaacgaccgtgttcttttgccatcgttaattctaattaacgaccatgatattgtgtcatcgttagttatttgacgacagtagtattgcgccattgttaatttttaaccacctccgttaacatccaatttttaatcaccacatggtacacaacacggtacactattgttgatagtagagaaacataattgcaatctgcaccggctcttggaattaacatccatgtttatcaccatatggatataacatttacattatgttctgaccaatcgtagacaatcaaccacatttattcattgcaatacataataaaaatttgttcaccgcatccagctaaataattaagtcattcaaacagaaccaacatctcgatgtctatcaaaattaaacactcgatctataagtatgtgcttggaggtgcagtggacaaattcctttgttatacgatgatgatcccatcaacattcgcaggtattgtcttcagatgcaccagtctcatatgtctcaccattgatcctatacaacttacaaaaatgatattaactgtttaacaagctatggcacttcatacataaaattcattaaggcacatgagtttatctcttatgatgtctttctaatgacacatcacttccattccattcagtgtaaaaaatttgatataatgttgagaagagccaatatttgcagacatgttgtgtgcacatttgatattattcatagaataattgcatgaccatggagaaaataaagtgcaatagaataatttgcataaatgaagactggtaaaatttaaacctaaaaggtgatgttcaaataattgcttatgttttgtagtagtaatataaatgaatatcttattccgaaaagaaactgaacttaccagaaattttgtttaaggaatgaggaatgctttgtcaccatctagtttcatatgattcctgtaaatttagagagctttactacatttatattttgcaatgatataaaaggagtaattaacctgaagaaaactaacaaataaataaaaggagtaattaacccacaatgtacagtagctcgtaccaatttagatagtgtgtcagcaatagctttacagatatggaaatagctcttgtgttgcatccaacttgttgtggccttgcgggcaaaaaatcaagcccatcaatgactgatcttgtaggaactaatgaaaacttggaatactacctgactataatttagtcaggccaatggagtgtattcatcttggttcctactaaaatagatttgaactgaaactgtcaaaatatataaccaatagaataatttgagaacaaaatgatgctcccattatttgcgtccaatatgtaacatgaattttgatgaatggagaa

SEQ ID NO: 56928 - DNA, 1501 bp, Oryza sativa
agaaaaagtagagcatacaccatccccatgatgagcaattcagcttcaaaaggtgggaatggtagagactagaggagagcagtggaggggctaaacgttgaccactagactgaagaagacaccgtcattaggtagccgctaattcactttcggtgtcagtgatgtaacgaattagtggccgaaatcagcatcacattatagacaacaacaaagttgatgccaaattttggaaactacgtccatatttgtaaataaaaataaataaagttgaatggataacatgcatcagatgcatatatggttagtgttggatggacaacatacatcggatacatatatggttggtcaaattgaaccaaattcttgttttgggttgcttgttttcttgtgacctggcccctacgtttatgatggattttcatatgtctaatgtatacgacaagaaatttgagatacgctctgttttggcattttatttgttcatattaattaactgatcatttgctaaactcttgatttcaacaagcaagattttggtgcgtggtttccttcaaaattctagcattcctatcttgatcggcagatcattgaatagacaatttatgcagatttatcctttttaattaggcttcagacacgaatgttatatgcatgttttactgattgagtcctacaaactaagaaatgtgccatacaggtaccagtaaaatttgtgaaatcaatgtcttgattattgtttttatatgaacaatagtcatatgatttgattatattggttttgatgatggtgatttattagatgatgtgattttgctctctataagagggtggccagatcatatagggagaatcattgttaaactgctggtatactagcggtcaggccggccggcccaacgaccaaactggcagactctgtgtcgaagttggttttaggttgattttttgatttacgatgattgcttcatgtttatgacctttagataatttttgtgctaatattgagtcaaggtgataaagaacttgtgcttagatatagttttttggtttgttcatgtgtaaggctgcgttcggtaggacatgttaccaactcctcctccttgttttcgcgcacacacttttcaagctactgaacagtgagtttttttacaaaaattttctataagaaagttgcttaaaaaatcatatcaatccattttttaaaaaatagcaaatacttaattaatcacatgctaatcgttgctccgttttttttgtgccggtgacgcagcctaagtggctcttgaggccttgagagagtattgatgatgacttgtgggaagttgatttccgaatgatcacgagatcatgcggggcatgtgtggtagctagagaacaatgcacgagattctaaaaatttcatatggatacaagagggattgtgtgagtatgaaaagtggattcaaatttaaatggagtccaaatttagtaagattagagtttaaattgtaataggataaga

SEQ ID NO: 56929 - DNA, 165 bp, Oryza sativa
  unsure (1)..(165): unsure at all n locations
ggtgcatgagaactgctaccccctggcnnnnnnnnnnnnnnnnnnnnnnnnnnnnnnnnnnnnnnnnnnnnnnnnnnnnnncctgctgcagccacgaccattcaaggagcaaattaaagccagttaaaaatctctcatcaaacccagacaatgctgttctgtaga

SEQ ID NO: 56930 - DNA, 1501 bp, Oryza sativa
aagcgccagagttgtcggctttcttctctcacttgtaccttggcggatgcttcttttaaagtaagtattcgagacttctttatggtatataatttacctgcttaagtgagattcccattgttaggggtttgtgcttagtattattattaagtgctctagtactatgactctgggtaaagaaggaagtttctgcgctaggctagagtaataatcaataacttagatgtggtgtctaagttagtggttacctttgtttgttgtgtgctccacggaaagtgaggtaagtggcaggtggtgatatccctgtccgttctttgtatccctccacgttcaggtacatcataaagccgtaggctggactcagtttggtagatcagaggagagccaatgcctgaagcaatcaattgggtttacctttaacttaaatatattaaattaacctataggaatcctcgctagtcttagcctaccattctttttgaacgactcacaccaaacagtgcggagttctattgatagagcaggaaaaaaaatccaagattacaaccctgggaggtcgtaaccaggaaaacgaaaaaagtataccaccacccacacaccgacagcgccaacatatagacctaggagaagactagcatcggactggccgccactaagcgtgaccgaccgccgctaggccaacaatggaacacagccgagatcgcccaaaacccgacccttacaaccaacacaaaaccctactctatccaaatctttgggattgagggagagagggtgagagagaagaatggaaccgctttccccctaggccctccaacgtggccaacttgcagaagctaggccgccaccacaagaggatatgaatctagagtgagcttgtattaatttcttgggaggtttcggcaaggggatgcctagacgacgtctccaaggagagaagcgacgaaacatcgccgccgccatccatcaaggtcttcaagagaaccgagaccaagctttcacccgacagccacacttgagggggtgagacagcacgacaacgccctcaggaggggagtgacgctcgaacgccatcgttgccggtccggccaaggccgggttgggtttcacccgccgtcctccgtctgccgatctaccactgatgtaccattgccccaccgccatctaaccctccgccggcgcgtgggcaccactgcaccggcgcccctcgccgtccagtctccgcacactgccaacggtcgcgtcctcccgctgcaccagtgtcacgccctgaagtttcccctttcttctttctttaaaagttggttgaataaatcgtccgaagaaattatcttaattaacctagagctaaatccctaattaataaatgcaattgataattggaattagcattgtgggatttttcttgggttccacatgtcgcaattgattaacaggatttttagtggaatttttagagccctataagtaattttaaccaattaaaattcgcaaagtgcaa

SEQ ID NO: 56931 - DNA, 1501 bp, Oryza sativa
acaaccacattgaccatggagtttggcaccatattttgaacccaaggggtgagatgctccactggtagcttgatattctgtggcatttcaacaaatgcaagagctgatgattcattgctttcgtaagacgtttcgtgtactagatcattttcattcatctcaaacaatgaaacgccgccaatatgagtgagcacatacacctcttttttcttcatggcccaacgtattgggcgatgagcgacgcgaattcgtgacacccactttatgatacgttggcttgtgcccttcctttctgtgaaaaatgaggctgaaatgggcttggtgctggatggaacatcatttacatatgttggacttgagatagagctggcatccagagaagttgttatgggcacagagctaggcaatgccgtggacacagccatcagcaaactagtaccatgtccgttgcatattgacaaacacctcacaggcgccaccgacattatgtcattggggcatgattgcatgtacttgacatccaggaagcaacagccattgtaaatgcagcacccatggagtgcttctctagctcgtgttgcatcttggcacagccggaacagaatgaaagcctcaacttgaattgttccctggttatacacacgcacttcctctgcaccatatggactgaatacctgaagaagaacctctgcggtcactggatagagcacatggctcatcgtgacgtgaaggacacttgctgtggttggctccttgttacttggcatttcatcgaacaccttctgggaatcaacactggaggttgcccctggacttgaaactgataccaaggaatccaccggggtagcaggtaccgaggaaggggatagagagcccatagcatgatccaatctggcccctaactcatcgagcttcgccaaaatgcggccatacatggcctccttcctctgttggtccagcgagtcactggcgacggtctccatcagcatgataaccactatcttcactcgtctcttcgtagatcgaaccttggttggaatcacggcgctcaagctgaacaccaacccttcctttggctttaccgatcaggctgaaatagaacggatcataatggctctgataccaaattgttatgatccaagctcgtgagggatcgaatcacacaaactagcagcagaatacactgataactcgagaaaatttgggaagaaattggggaatcgggtgaagaacagaaagggggcaaaggaagaagaagaacagcaggaggaaatcagattcaattcatttcattcactcaatctctcaatacatgtttcttgccttatatcatggcggtaagactgaattgtgggacccaatcctatctttagggccactcgtcattcacccaacattggatacatttatctagtatgggtatgacataactgtgtatacagatttatatagctaaattttaggacagaggtagtatgaagagactatatttcatccagct

SEQ ID NO: 56932 - DNA, 1501 bp, Oryza sativa
ccccctttgcagtatcatggtgatacttcggggcatggcgacatgtgtggaatcgtgtcttgtgggtacagttgtatacctctggccagagtaaaactattcgaatagccgtgcccgcggttatgaccgatcaaccagattcaccgtgattagtctcacccctagtttagtttgatgaactggtgtagttcaggtggttggttgggccagttgcaacgtggtgtagcgttggacagtgattggttaatcttgcttaatctactacatatgtttttactgctttcaactactgtttttaaatgcctgctttattgcaaatgaaccctaagcctcctttggatatatcctgcatcatacctcctcttccggtatgacttgctgagtacagtgggtagtactcagtcttgctctcttttcccccacaccagagctgaagatcttcctagttggagctgtcttgtcgaagttggtttcgtcgctgccatcaaggattgcctgtggagtggagtcgccccgctgcagaagtcaagcttccaagtttagctcgcttttatcttttccgctgcatttgtaatcttttctatttttataagacgtggatctgtatgtcaacaattgtcgtttgtgtaccctggctggtcctagacagggatttaatgcacattcagcttagaaattctggttcgtgaatttctgggcgtgacaagttggtatcagagccaaccttgcccataagacaagccaactggaaacctaagagccctctcaaccccttttcatctgcatatgttctttgcactaggattagtttcgggaaaatttggggttttggctctttggtttgagggagaaatcttggtcgttcattcggatcggatctttaaagttagctcagtctagggttttagaaaaattttatttggagtttattcaacagtaagtcggggatttatcgggtgatatgcactaagtcgtgtctatgttcgatggggcaattttatgcgtatcattatgactatgcatctattttatgcattaatttattgtttagtcagttgcattagtgtctttatctgggttcatgaaaaatgttctatgcataataatcaccatgctcagttatttgtttgagtcatttgttgctttgttcaatttggatttgagcatgaattggttcctatcccttgtccatcttaggtgtcagacctgttcctcgatcgcaagtgtcggtccgagcttcagagtcgccgcccttagctgtatcatcttcttagttttgtttgcttgctagtttctgtgcttaggttagttgcttgtgggttagtcgacggtcgatatcatgtgtcagtggtatggctgccttcagtaggagttgtttgcttccttttcagtgtttttatcaagattaagataattgcacttaaatttataagaaagattagtttctaagcccctgtttttcttccttttctcatatttctacctatccccctccagatgg

SEQ ID NO: 56933 - DNA, 1501 bp, Oryza sativa
cgcactggatcagcgggccgctgagctcgaagcgcgggcgaaggagctggacgcgagagcgcacagcggcggagcggctgcgggccaaggcgacctagccgcccgcctcgcagccgccgaacacaccatcgccgagctgcagggcgcgctggactcgtccgccggggaggtcgaggccctccgtttggcgagcgaagtagggcccggcatgcttcgggacgccgtctcccgtctagaccgcgccgggcggcaagcgggcctctggggcgggcggcacgcgaagtacgccgccaaccaggcgggcctcgcccagcgcctctcagagatgaccggggccctcgagcggctccccgaggagctcgaggagacgatcaagtcatcctcgagggacctcgcccggggggcggtggagctcgtactggcaagctaccaggccagggaccctgacttctccccgtgggcagcgctggaagagtttcctcccggaaccgaggacggcgcgcgcgcgaaggtccgggacgccaccgaccatatcgtccacagcttcgagggtacggcccctcggctcgcgttcgcgctcgactccgacgaggagggcggtgacgacggtgcggacgacagcgacgacgaggccgacgtcccgggcgcgtcggagtgagcccccaggcccccgccaatcttaataacttttgcttcttcttccgtggccttcgggcccccttcttgtatagactgatttaatctgtaatcaagtaaagaggaaatttccgcgtcagttctgtttgttgtgtgtatgagacgagaatggtttgtgccgcggtccttctgtgtcttggcttgaacaagggctcgtgcccaggtcccagcctcaaacggcgcgggtcgaggctagtgcctggggagatcctcgtgtcgagactggccaggccgggagcgcggtgaccgagggttatggatgacccgattgtgggcctttgccgattccccctcggagttcaccatgccccagggcacggctcggttctgggccccgtttggcgattttagccggcccgggccgccgagggcaaggtcgagcacgagcgtgctaattcaagccaagattcttcaaaaggaaatgatggcacagacacagtcctcaggaaatcaaaaatgcttttattgaaatacggaagagaaaaaaggtaagtatatgcatgtggtagcccccggccaatcctgcacgcccggggggggtgcggggttggcccgagcccgagacatgatgcccgatccccactaggggtagaagcgacgaaggtgttcgatgttccacgggttaggcagctctgtgccgtcgcccgtggccagccgaacggagcccggccgggggacgtcgatcactcgatacggaccctcccacattggtgagagcttgctcagtccagcacgcgtttggacgcggcgtaggatgaggtcgtcgacgcagagtgatcgggcccggacgtggcgctgatggtag

SEQ ID NO: 56934 - DNA, 248 bp, Oryza sativa
cgcctggcgcgaatatgtgccctgaaagttcgtgttgaactgctggcacaaatcctcccaagagtggaccgacgggggtggcaagttcattagccaaccccgcgcctgacctttcagggcaatggggaaaaaattcgccatgaccctgtcgtcacccccggcggcctcgatcccggtcgtgtagatctggagaaactcggcgggattgacgcttccgtcatatttttcggtgatggtgggccggaacc

SEQ ID NO: 56935 - DNA, 558 bp, Oryza sativa
ccggcttcggccaacaggatgtagggttattacctgacaattcaggggcccgaacctgtataaaaatccttgcctccgtctcttttacctcagtctcgtgtatatcctagtaccaacgatccccataccatgcaaataccggaatcgcgacatcaaacgtcgacagtggcgcgctaggtagggggattttggtgcttcaagatttcgacaagatgagtttaaaagatggattctccgacaacaagctactcgacgacttcggctatggggagatctaacctgaccggagtatgccccctgacaagatcggaatcagcgccgttaacttgtcgatccggcgagatcgaccgagctacaagatatcgtcgccggggataacgatggtttgatgtttcccaccgggaagcctcggccaggtcaaccgatgactacatcgaatccgattttcaatagcggacaatgatggactccggagaaatcaactgctcgtcagctcggatcaatctcgcatcacgcgacatgatcgggcaaccgcgaggactacaaagcctgacgtca

SEQ ID NO: 56936 - DNA, 1501 bp, Oryza sativa
gatttccccctttgcagtatcatggtgatacttcggggcatggcgacatgtgtggaatcgtgtcttgtgggtacagttatacacctctggccagagtaaaactattcgaatagccgtgcctgcggttatgggcgatcaaccaaattcaccgtgattagtctcaccctagtttagcttaatgaactggtgtagttcaggtggttggttgggcctattgcaacgtggtgtagcgttggacagtgattagttaatattgattaattactacagctcttttactgctttcaactattgcttttaaatgctagcttgatgcaaaagaacccctagcctcctttggttatatcctgcatcatacctcctcttccggtatgacttgctgagtacagtgggtagtactcagtcttgctctcttttcccccacaccagagttgaagttcttctcagttggagccgtctcagagagattggtttcgtcgctgccgttaaggattgcttgtggaatggagtcgccccgcttctgaagtcaagcttccgagtttagttcgttttatcttttccgctacatttgtaaacttttatatttttgtaagacgtggatctgtatgtcaacaatggtcgtttgtgtaccctggctggtcctggacagggatttaatgcacattcagcttagaaattctgattcgtgaatatctgggcatgacaagttggtatcagagccgagcctgaccgtaggacaagccaactggaaacctaagagccctctgaaccccttttcatatgcatatgcctttttcacctggatttgtttcgggaaaattttgggttttgcctctttggtttgtgggaaaaatcttggtagttcatttggatcggatctttaaaattagctcagtctagggttttagtaaaattttatttggagtttattcgacagtcagtcgggaatctatcaggtgatatgcattaggtcgtgtctatgttcgatggggcaattttatgcgcattattttctatgcatctaatttatgcattaatttattgtttaatcagttgcattagtgtctttatctgggttcatgaaaaatgttctatgcataaaaatcagtcatgctaggttatttatttgagtcatttgttgctttgtttaatttggaatttagcatgaattggttcttatcccttgtctactttagatgttagtcctatccctcgattgcaagcgccgctccgagcttcagagtcgccgcccttagttttatcgtcttcttagttttgtttgcttgctagtttccgtgcttaagtttgttgcttgtgggttagttggcggtcgatatcatgtgtgagtggtatggctgacttaattaagagttgcgtgcctctttttcagtgttttaatcaagattaagataattgcacttaaatttataagaaagattagtttctgagccccctatttttcttccttttctcatatttctacctatcctccttcagatgg

SEQ ID NO: 56937 - DNA, 1501 bp, Oryza sativa
cctctttcttctttagctagaaaataataaaataatgaacgtggtgtctaatagcaaataaccatgttttgatggtgtctttttttttctaaatattgacttctatcgtatccaccaacaaaatttaccttaatcttatagggttaaaacacatgaatataaatttggtgtgtttggatgcttcacgggaaataaatgtaggaattttaaagaaattgtgtgtgccagagatagggtagaggaaggaagagagtgcatcggacaaaagaggtatgagctcatgtttattttcctatgaaacaggggcaaacccaaaccatcggaattttggcatctctatgcctttgatccgaagggtctatagaaatttttttttgaggatttcagttctccacaaatcctttgaaaattcttcgatccaaaatagccctacatgtgttcttagcgatataaaaactaataatggaaactaaactgcaaaaaaacttcaaaataggtttcaaataggttgcgaaaaaccaatgaactaaattatgttttaaaatctaaattttagctacggtagatataagacaacaagcaatcgaggagaggcacgtctcatttttatagttaggggctgatcggaactgttggctgctacagccgtcacggctgtggccgttttcagctgctgctgctgctttttagctctcgtagccgcagcggttgcagcaggaagcgctaccgatcacactcttagactcaaatagggaacggtttcctattcaaagtacagtgccggtttgaagaacctcgtttcctatgtatttttacaggggtttacttgcagtaaactttgcttgagtgctcttacctttagaaaggcaggaaagatcaagtatgtgtggtatagaacactagttcttgttgtatcctaggacataacccttcgaagggggttaaatctcactcaaaagtcgctcaccttcaaattgttttgatatcacatatgtgaagccttggatcatcaggttatatataagcaattttaccatccaacatttggtacctcgaggtaccacatttcacacacaattttcatacctcaaggtattactccctccgttccataatataagggattttgacttttttgcttgcactatttgaccactcatcttattcaaaaaatttatgcaaatataaaaaaagtaagtagtttggataataaagtaagtcacaaataaaataaataataattttatttttttaataagacgagtggtcaaacaatacaagcaaaaagcctaaatcccttatattataggacggagggagtactaactaccactaattaagtacctcaaggtaccacatttcacacacaattttggtacctcaaaggtactactaagtacctcgagctaccaaattttacactagaaagtatgtggaggtaccaaaaattcgtagtatctcgaggtattaaatgttggatgataagattgctcagctatat

SEQ ID NO: 56938 - DNA, 1501 bp, Oryza sativa
ccatggatactcgcataaagtctcatacaaccaatagaaattggcaatgagacctatcatgggcaatgtctcttttagacaacaaaactcattggcagtcaaccaggagttgaatggaattaatgaactagaagttgaaatgaagaactcaacctgaatgattgataagcattgaagatagaatcaatgaacgcatttcaggagtttggatcgggcacttgcataatagtacatgaagatgtactaggtcccgaaccaacataaaagaatagaataagccagaaaagaattgaaaaaaacaaacacattcgttttgaatttgagtttgatttgaaatatttggccggatccaaatcatgctgacgcttgcaactaaaggcatgcgacagatagaagtctagtacatcagtccaactgcacttagaaatgttcatgatgcatggctttggaatagtcaattatcgccaaaatgggacggaattcctaaacacgagtgtcatagcagcacatgaatacttggctaattgaactaaaccgaactaagcattattgaactgttcagagcctcggcatggttttgagagatggttacgcgcgacatcaatcgcgatttgaaaactatctcaacccccacaatttatgaaagtaaaacagcatatgtcgcacatatgcaatgagttatgtgagaagcaaactcactaagcatatgaacccccaagctcttctatgtacatgaattgcatagaagcgatgaactaagtcatgtggaagtcttgcagattcatctgctaactcattactgacatctttacttgaataggtgtgtccgagaaatcagaataatgagacttagagaaatgcaaaaatcagggggagaatttcgccgactcattttagaatcttgatatggaaaatcaagtacccaaaatcaatctagaaaggttgaacgaagaattgggtggattgtactctttttcccttggataagttttcccagcagtttcttatcaaggtttttaacgaggcaattcgtgcgatattgcaagcgtatgctatgtactctttctccaaatttttcccactgggtttttgtggagttttgacgaggcataggcatcatgcggtgagtgcccaagggggagtgttaagaaaccgatgggcttgggcccatgaaggcccagcccatatacactaattgggcccacaccgaaaccttccatatatggaggaaggctatataagaaggagaggggtgctcatattgtacacttgtgcttgaggatgatagaatgatgaatgagaagagagtctcacccctatatcttgtgtctccacttttgtagaattacgggacccttttggactacttcgtgtagcaagagggttgcgtaataatttcctccctcaaatccgcttgattcaaatggctaattccaaaattgattggggggaattaatcccctttccctcctctctctttcccccttaattcccccttgaa

SEQ ID NO: 56939 - DNA, 1501 bp, Oryza sativa
gagtactgtggttgtactcattcttactctatcttcccctcccttcagtaagagaagctttggagaagaagtcttagttggagtcctggcttatacccagttgagcgcctgtgaagatggagccgtaggcccgctagtccgctgctgtttatttttgtttgttaggcctaaattgcctttgtaataatgtaaatattatcgatataataaagatgtgccttttgtatcatgtttgtgtggtgtaccccggcttttcctgggacggggattaatacactagcgttctggaaaaggtatttttttcgggtgcgacaaccgctgcgttattgctgtagtcgtacctcgaccatctgagtttgcggtgcgagagattactccgacaacaaccttttctcgagtagtccagccatggccggtgctatgaaatatgtcgtcggtcttcgttggcaggttgggcgcgacgactctgtatttttcgagatcgttctcgataatacggtatactcgaccacaacctactcgagtgctcaattgttcctgaaaaatattttctagaaggcaagacatatagcagataatattgagtacgtactcaaaaaactacatggatcttctagcattatcaggatataatgagcatttctaaatatcaggcattatgtaaaccgtaaacaagcatgatttatacggaaggaaatagagcgagcccccagcgttagaccgtagtcgatttaacatcggggacactcgcgtaacagatattgtataaaaaatatgctctaggtaaacataataaattatagatctgataatgctgtatgatctaaattggtacgataaattgcatataaaatattgagtaccttttagatacatgccggatatatctacgaaattagtagattaattagattaattaatctactaattaccttaattagccttggtggccgatctctgttggtgttttcgggtgattaaccaacgtatcatggctctgtacataccaacatatatttattcgcatacgtacaggtgctcgagacgtgtacgtgtactgtatatatatatgtgtatggtcacggtacaatatttactcatgccacgtgacgtcaggctttgtagtcctcgcggttgcccgatcatgtcgcgtgatgcgagattgatccgagctgacgagcagttgatttctccggagtccatcattgtccgctattgaaaatcggattcgatgtagtcatcggttgacctggccgaggcttcccggtgggaaacatcaaaccatcgttatccccggcgacgatatcttgtagctcggtcgatctcgccggatcgacaagttaacggcgctgattccgatcttgtcagggggcatactccggtcaggttagatctccccatagccgaagtcgtcgagtagcttgttgtcggagaatccatcttttaaactcatcttgtcgaaatcttgaagcaccaaaatccccctacctagcgcgccact

SEQ ID NO: 56940 - DNA, 1501 bp, Oryza sativa
  unsure (1)..(1501): unsure at all n locations
tgtacggtgaagaaccaccggaacagctggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcaggaccagccccgccattgcgaaagagaggaagaagatggaccgccccgggtagtgtggcgccgggcgtccctcggccagcgcgaccacctcccggccggtggcggattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacggagagttagagcacaagtggcaaaggcaaggggaagagtggcgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggaagatgtgcggccgtggcgtttgagatggggcagatcgtgcgcgcattaactgcgctcgccaaccgcgaaaaacgccatcatcgtgtccccgggcgaaacaaacctgctcgagtaatgtagcggtcttgaagaggccgctcattattgtcgatcggtttttcccttgccaatgcgcgcgatttgcgaccgttgggttttcgcccgcctgtggggaccggccccacctgtcaccgggcctaaggagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtaagaaaggtaangaagaaaagtaagttaaaattaaatttgttttatgttttagccattttcacactgccgtctcccacgcattcgtttttttctttcaatttttcccttgagagaaataagagggacaccagatttttgcagaggacaaggtttggttggatttaaaccatgacattcacaagacaaggttaaaacaagagtggattaaattcgtccattacattataaatgtgcaaaattagaaaaataacattactattagcgatattggttgggtgccactaaaattttgtaaaattaaaaccataccatcgccgtcacattttctatcatcatattgaccaaaatacccttacatgtgggacccaccataagttccaacctagggaggtgacacgtcgtcgtctttcacctcagctcagccatt

SEQ ID NO: 56941 - DNA, 1501 bp, Oryza sativa
acccaatagaaccagtgcttaaacttgtcacatcacatatacaatatcactcatagaaactagctaatgtataattaaactacaatatattcaggaatcacttggagcattgggtagtacattttctaaataagctcatgtacagtaggcgaccaaaaccttatacgttgttgcacacatacacatatactgtacaacccattatagctatacgctgtagtattaaattgcttgattgcatgtattaaaatttaagagaatatatgatcaacatgtatggtggataaatactaattatagaccttgatctaatatgatctaagttcaattgtaaattaggattattcattgtaaaattatgtgatgggataatctgtaatattattagcctcacaagtgtaacatatagagcatggataattattaacctttcataatttattgtgacaaataaaatatgttcataataatacaaatgattcactgtaattatttgattgatcctaaatccatccgacaaaagaacctctagtatataaccgttctatttagatagatgcatatatagccataatccttccataaccactagctagactaaaccccatattagcaagatgtgtatctcatttatactacgatggctagctccaaataaaccaccgtgacaacagaaagattaagaaactttagcccttagcatgattggaatcccctagcaagcaataatagtatgagcaaccctaggtacgaccctaacaagtacattttgttgtgcatatttgattgttgtttgaatattggtttttctcgcgtatcatagactttgtgtatcggttagtcgtgaggcaatgtctgcaacttccaggaggtgaaggttgatcgagattatatcgagaataaggactatcctgagcaggcaagtcatcactattccttgaacatgttgatcccaattgtgaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacataatttgtgaaaggagaaataaaattaaacaattgttttcgacttgggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtag

SEQ ID NO: 56942 - DNA, 436 bp, Oryza sativa
aaaaattgggatctgtcttgtggttcaagggaaaaatcttggtcgctcgtttaagtgagatttgtcaaaacaagtcagtccagggttttagtaaaactgttgagatttattcgttagtcatttgggatttgggtcctagctcaggaacatgggttgcaaggtatttatgctcttattgttattattagtatgtatctaatttccccattattttatcgttatgtgggtctgtcttctttattcgctctcatgcaaaatgatctatgcataaaatttcgctcttattcgattctcttatttgagtcttttattgctttatttaaatttggatttgagcatgcattgatcctagtcctttgccttctctagatggccggccacccccccaaccaccgaggagaaggcatgatcgactttgtggcagagttggcacgta

SEQ ID NO: 56943 - DNA, 534 bp, Oryza sativa
attgcgacccgttgggttttcgcccgcctgtggggaccggcccccctgtcacgggcctaagagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtcggcccgctcccatttcggccccgagggctggggcgccccgaccccctgtggttttggcgccacgtgtgtgggttaggtgagcacaccgggctcacctaaccgcatttatagcaggttgacgagcgcgccacgccgcatttactgcggcgcagcgcacgcttatccggaccgtgaccagtcgcggtgtgtgaccggtcacagaccggtaagatcgcgggttaggtggcaacaggcggcctgtcacacgcctcgccccatcccgtcagaa

SEQ ID NO: 56944 - DNA, 1501 bp, Oryza sativa
tgaagcctgcattaaacacttatttccctggctttgctgagtacttccgtactcacccttgctctatataaatgatccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattagcaggttaatttggagcgtcacgggctagttccggtcgggactagttcggggcgtgacattgaggagataccatgaggtaccaaattttacactaattttgagtacctcatggtacctcatagtacctagatactaagaggtaccaaatttacaataagaggtaccaaatttacaataagaaaagtggtacctcatggtacctccttaagtaccgtaaaattgctcttatgtttaggatcaaatagacatatgtacatgacaagagtactttcttccttattagtactcctaatttaaattaatttctactagatgctatacggatatacggccatctagcttagctgctggaagcctggaataattatacatcactgtagctgttttataactgtgacgtacgaaaacaaggaaaatatatacttcagtcacgtacatgtgacactcatacgtattcctctctttaacaggctgttcttggtggcttgcaataaatttggtgcttaattaattcgatctttcatgtggatcatatgcatatccacacatatgtaattaagcaaccctttttctttgtgtgatcagattcaaagaaaacacacaaaaaataccttttcgtgccaaagtcacgatttgaagcagcaacatatattatatggtactccctccgtttcaaaatgtttgacgccattgactttttagcatatgtttgaccgttcgtcttattcaaaaaatttaagtaattattaattgttttcctatcatttgattcattgttaaatatatttttatgtaggcatataattttacatatttcataattttttttgaacaagacgaacggtcaaacatgtgctaaaaagtcaacggtgtcaaatattgaaacggagagagtacttaattaaagtatgcaataacttaatgatatgtgttggataaattgatgcatttgtgcatcactagctcgaaaacgtggaaattattgcatcgccacccacctcgtctactgtaccagcagcaattgccaacatttttttttctctattatggttttttcctctgctggaaaataaatctgtcaggattacgggttaggcatactctttacccttcgatatacgttacatattgata

SEQ ID NO: 56945 - DNA, 315 bp, Oryza sativa
cttaggatatcgatataactttcgatgaatatatttaatcattactcgcatagcatagccacatatattaggcgtgttcggaaggccaggccacaatcgtggcagcagcagccacatgttagtctgatgcttgcagcactgttgccgttggctacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagc

SEQ ID NO: 56946 - DNA, 1501 bp, Oryza sativa
ccttcatctcgatcacgcaaatggatcggaaatttgaccgtcgggtacacgtgcggactccgactcggatccgcactcgtgtctatttatcgagggactgtttacacccaaatttggcacctaagattaaaataggaaagattgcaaaatttggaagtctaccggtttcctccgagtgggccggtctgaccgccgtgtgttgggcggttagaccgccggttcagggccggtcagaccggcggtgtgtggccggtctgaccggtaggtccaagtccgactgtgtttcgtcgggtttcgaggtttccttgctcgggaaggcatgtttcaggtttcctttagtttctaccccgagttggacatggaggaaggcctgtagagggcaagaccaacccctatataagggacatggccggttcattgtaaaaatctaatctacaatcaatcaatcgaatcgtttttcatactgcttttagttttctcttagtttgtccatctttgtcggtttgcgccgtaaaccgtccgccgccgctgcgagagtgcgacatgtcgcgaccgagaaaattgccttttcccgaacgctagtgtattaatccccgtctcaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcccaactcgtcccaagccaacccaggccaacaattccacattttagttgttgagcaaattttaataattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctaga

SEQ ID NO: 56947 - DNA, 1501 bp, Oryza sativa
ataggaaaacaattaataattacttaaattttttgaataagacgaacggtcaaacatatgctaaaaagtcaatggcgtcaaacattttgaaacggagggagtaccatataatatatgttgctgcttcaaatcgtgactttggcacgaaaaggtattttttgtgtgttttctttgaatctgatcacacaaagaaaaagggttgcttaattacatatgtgtggatatgcatatgatccacatgaaagatcgaattaattaagcaccaaatttattgcaagccaccaagaacagcctgttaaagagaggaatacgtatgagtgtcacatgtacgtgactgaagtatatattttccttgttttcgtacgtcacagttataaaacagctacagtgatgtataattattccaggcttccagcagctaagctagatggccgtatatccgtatagcatctagtagaaattaatttaaattaggagtactaataaggaagaaagtactcttgtcatgtacatatgtctatttgatcctaaacataagagcaattttacggtacttaaggaggtaccatgaggtaccacttttcttattgtaaatttggtacctcttattgtaaatttggtacctcttagtatctaggtactatgaggtaccatgaggtactcaaaattagtgtaaaatttggtacctcatggtatctcctcaatgtcacgccccgaactagtcccgaccggaactagcccgtgacgctccaaattaacctgctaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggatcatttatatagagcaagggtgagtacggaagtactcagcaaagccagggaaataagtgtttaatgcaggcttcaaggagaggctgttgttttcgcaatttattttatttgaactcttttctaaaaagtctaagtgagtgcttctcaaacgacacggatgagacagtgcgcctcgtccggtcggagtatgtgcaatgtatcagtctttagatcttgaaacagggttggcacccggccaacagcttttcaaacggccacccgggcctagctgatcccgtcagctgctgatttttttttcaaatatcgaacccagattcacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 56948 - DNA, 404 bp, Oryza sativa
atactctacttttctacccgtacacactgtgcagcagctggtccatggtttcataccatgcatgacgcaccctttactaggggcatgccatgcatgaccatgatgcatactatgacgcgcatttgacatcattagcgagcctgtcttaaactaatcaggcaggcaattagcgtcaccaacatatgcatggcgcattactcagcattatattgttgttctagtggctgttaattatggcttctacacctcaatctatctctcctctcaccacacacatggaggtcctgcatacataggcatattttcatgcagggcatcaattcccttcctccatgataagcaaagcaaagcaaacccaacccaacccaaccccaaagactgcacactgcacccccatcatgcat

SEQ ID NO: 56949 - DNA, 1501 bp, Oryza sativa
gactcctcgcaaagatcggcaaagtgatgttaaatatagttttgatgtggccaagtgtgataagatttttgattatcttttacaagaaagacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaatacaattaatttcaataataaaaaggtgttgattcggccggagcaagccgaatctactaaaggaaaaggagtaatcattggtgaaccaagaccaaagatgatagtgccaaataagccggaggttggtgtttggaaggaaaataagagtgaagcttcaacttctaaagcccctaggaagaccaaagtgacttttgatatgcttttggagaaatatgagaagcaaggtggtgagagaattcgcaacaaaggaaaaagaccaagatcacctcctaggaagcgatttggtcattcaccaagacggtcgcattcacctccatatcatcatccacaagacatgtcatggggttcttatccaatgccgccgccgggttatccttatccttattacatgccatggggggcgacgctgccaatgttcaatcatatgcctccaatgcaattcaaccaagggtggggaggaccgaggaggccaattcatgagcgtttgtcttcaccaaacaatagccggttttatggtaagaatcgggctaatgaagaaaagagggaaggaaagcgcgtcaaggtggaggcaaggacttcagaagtaattaccatcaaagtggggtctcatgatgtgccaataccttttggagatggagttggagtatcctcaaacaaaaaatccgaagccgaaaccagctcctcgcagtcggccggtctgaccaggccttctggccggtctaaccgcaaccatgcgaccggtctgaccgggccatcaggccggtctgaccgccgacccgacagcagtccgaccgacgcctcaggccggtctaaccgtgcgccaagtgtcggtctgaccggcgcgtctggccggtctgaccggtggtctacgtccggtctgaccgggctccagcgccgttttgacaggggaattgcaaagggctatgtgagggcttcatcgtcttcaaacaagattaataggggacattatttacctcctggaacagagtcgaatcctaggtggatgcctaaggatttgacggctactcaaaagagaaggttgcaacgtcttcgggcttaagagataagagagataaagggttcaatgagttgcgaccgccatcggtatggaggcgtaaatccatagagaaggaaaagccggttgttgtagaggagaaggaggagcaatcggttgataaaggtgaatcatatccaaaagaagaca

SEQ ID NO: 56950 - DNA, 868 bp, Oryza sativa
ctcggcacgctcgcgcggaaaacaacgggcggaaaggatggccatggggaccggacaacgcggacggcgcaacaacacggctcggacgggaaaccacgcggcgcgcgcgagcaacggcgcgcggggccggctttgcgagcggggggggctcgcgcgagagaagggggcgctcggcgcgggcgactcccgcgcacgcgcgcgcggcgcgcggcggaaccggaggggagcggaaagagaggcgctcggcgcggctctcacacgcgcgagcagcgagggggggaaaacgcgccgggggggcaatcgagagagagagagagagagagagagagagagagagggagacgcccgggagagagagggccggggaagagatcatgagatggcacgggcactagacaacaatcaaagaaacaactttcgcaattagggtttttaggagataattttcccgctaggcgccacgacggaacgggcgctacactcaaggaccgtaaaattgttttaaacgtaacactagacaacaatcaaagaaacaactttcgcaattagggtttttaggagataattttcccgctaggcgccacgacggaacgggcgctacactcaaggaccgtaaaattgttttaaacgtaattaaactggatcgaaagccaccatggaatataattcagggggaaaagaggcattttcaaagtttttatatggattatcctagaaccgagttgatggttcattcatcacaggacttcagttagcgtgaattttaggttggactctattttatttccaacgcttcaaattggaaccttttctaacatgttgtgttttgctttggatctttttcataatatttcctttattttccagg

SEQ ID NO: 56951 - DNA, 1501 bp, Oryza sativa
tggctgagctggtagagctgactgagctacattcattagtgaacttggagtcggattgaggctgtgctgctcactgttgttgtgactgccactatggtagttcttgtcgaagctacccgggtggtagggacggtgctgctggataatcatggtggaaggtccaccctgatgtcccatcgtgaggcgaggcttctgactaatcccctgggaagtcctgaactgaactgccttccttttacggttcattttgttgcactgctcttcctgacggatggctttgtccaccaacttctgaaagtcctcataatgttgggagatcaactggttggtcaattcatcatcaagacccgacaaaaacttctcctgcctctcggcatcagtgcgcacgtcctcaggggcatagcgcgtgagacggttgaactcgtgtagatactctataactgttctggttccttgctgcaaagaacggaactctctcttcttttgtgccacaattccctcgggaacctgtgccttattaaaactctgacaaaactctatccaagtaacctctgtcccagctggacgggtcaccatgtagttgtcccaccaaacagaagcgggaccttgcagttgcagctggtgtgtagcaaaagcaaccttctcttggtcgttgcattgcaaaaggttcagcttcttctcaatagcacgaagccagtcattggcctcgattgggttggtggtacttgagaaagtgggcggcttgacacggagaaattctaacagtttggactaaggaggtggaggaccaaactacaggttctgctgctgctgctgtgcttgctgctgcacctgctgcaacacctgatggtactgttgttgcatctgttgcatcatcattgttatcatctgagtctgattgtccaacacctgagcaatcgtagggttctcgagtggtggagatgaactgctatcagatgcaccgctggcacgtggtccattgatctgctcttcactgccactgaccttgttggattgagaaccattccttgtcttcaccatctgaagggggatatgtagaaataagagaaagggagaaaaacagatggcttagaaactaatctttcttataaacttaagtgcaattatcttaatcttgattaaaacaccgaaaagaaaggaaacaactcctaattaagacaaccataccactgacacatgatatcgaccgccgactaacccacaagcaagaaacctaaacacggaaactagcaagcaaacaaaactaagaagacgataaagctaaggacagcgactctgaagctcggagcggcgcttgcaatcgagggataagactgacatctaaagtagacaagggataagaaccaattaatgctcaagtccaaattagacaaagcaacaaatgactcaaataaataaccgagcctgatgatttttttatgcatagaacatttttcatgaacctagataaagacactaatgcaactgactaaacaataaa

SEQ ID NO: 56952 - DNA, 1501 bp, Oryza sativa
acatgcatttctgttacagaatacatctagcgaatccttgaactcccaattacgacgagctgttcttttgttaaattataagatctagtttttacgtacgtgttcttgtgttagtctagtaattgtccgtttagtttcagagtgctaggttaacagtttggaatatctagttttgtctcgttagtttcttttcataatcagtgctatatcttcccatcattagatcaatcctacttggcctctactgaagtgattatggagtagacaatttcagggaaaattggaattttattacttagctgttgacacacatgcatgcgcttggctgattgcatagtgtgcatgatctccagttctccatgagagggaattgttggcaaattgctcctatggttaaaacgaggaatgcgattcaaccatatggagggacagaggcaaggggaatttatcaccctgttctcttcatttccttcctgggatatcttttgaaaattttttcctaaaagaagataggttaatgatccatcacctggtagatttacaaaaatgggacccagccttacatttttgagatatgcaggttttattttcttcctgtcatttgcatgcttttatcttgggccctaccttataaacatgatgcctcctgctctgttgggtccatgttactcctgtttataattgatgccatttttttaaccctaaaaccaatgatatgaatgccattggaaggaagctagtcatgaatggttttgattgttgaagggtgagaaattcacaatttcaagaaaggtgactctcaactgccagatcatacaagaatgcttgtgggggttcggtcaaataatgggtggatatattatttttgtgttcttttgggagcatagaagaatagatatggcaagagatcagaagttctagtggtatgcctttttctatatttttgtttgcctgtggtagagcgcctcaccagtgggcatggcaagactaggaagaaggatgagagggggagagggttttttttttagataatggaatataacatcccggcctttactcaagagagctacaaccaattattacagagggggagaggggttaaattgcccataggggcaaatatgaataattccattgttagagcagcaaaagaaaaaagatttacattgtttataatggcattttttttaatgaaacagcactctttagagtggcaaatgatcaattgtccttgtctcaattgttaatgttcagaatggatttcagtcaccacagtggcaagtactgaaacactagattttgaatgaaatgttttggatgtagttgtatggaaaattttgttctgcttttctttgttgtttgactgtgacactaagctataacattacatacatgtgtttctagactgggaaatggcagtggacatttgaggataagccaataaacatttactatgaggaacatgagcatgagactgctgagaacgtgaagaacattctta

SEQ ID NO: 56953 - DNA, 361 bp, Oryza sativa
aagctaattgacaccaaaatcaagtaaacattaaccaaatagatttattttattttgtgcttcactagaaaaattagccgacaaatctgagcccatgacaaaaaaaaatgtgtagcctttgtaaggctaaacagaaggagagcatagctcttgtactccgcatcattcatccctatgagctacccatgatccatttctacacaaaaaggaatgatcaattgctcattaaccctctaataatatggaaactcatatcaatcactcctccagcaacgcataatccagagaaatacgcactagggcgcatcactcgtagcaaaggcgacaataccatttcctaattcatgattacatctctaga

SEQ ID NO: 56954 - DNA, 1501 bp, Oryza sativa
ttccccctttgcagtatcatggtgatacttcggggcatggcgacatgtgtaggatcgtgtcttgtgggtacagttgtacacctctggccagagtaaaactattcgaatagtcgtgcccgcggttatgggcgatcaaccagattcatcgtgattagtctcacccctagtttagcttaatgaactggtgtagttcaggtggttggttgggcctgttgcaacgtggtgtagcgttggacagtgattggttaatattgattaattactacagctcttttactgctttcaactactgcttttaaatgctagcttgatgcaaaagaacccctagcctcctttggttatatcctgcatcatacctcctcttccggtatgacttgctgagtacagtgggtagtactcagtcttgctctcttttcccccacaccagagctgaagatcctcctagttggagctgtcttgttgaggttggtttcgtcgctgccgtcaagggatgcctgtggagtggagtcgccccgctgctgaagtcaagctccccagttagcttgttttatcttttccgctgcatttgtaatcttttatatttttgtaagacgtggatctgtatgtcaacaattgttgtttgtgtaccctggctggtcctggaccgggatttaatgcacattcagcttagaaattctggttcgtgaatttctgggtgtgacaagttggtattagagccgaccttgaccgtaggacaagccaactggaaacctaagagccctttgatccccttttcatctgcatatgctctttgcacttggatttgtttcggaaaaaatttggtgttttgcctctttggtttgtgggaaaaatcttggtcgttcattcggatcggatctttaaaattagcttagtctagggttttagtaaaattttatttggagtttattcgtcagtcagtcgggaaactattgggtgatatgcatttggtcgtgtctatgttcgatagggcaattttatgcgcatcattatagctatgcatctattttatgcattaatttattgtttagtcagttgcattagtgtctttatctaggttcatgaaaaatgttctatgcataaaaaaatcatcaggctcggttatttatttgagtcatttgttgctttgtctaatttggacttgagcattaattggttcttatcccttgtctactttagatgtcagtcttatccctcgattgcaagcgccgctccgagcttcagagtcgctgtccttagctttatcgtcttcttagttttgtttgcttgctagtttccgtgtttaggtttcttgcttgtgggttagtcggcggtcgatatcatgtgtcagtggtatggttgtcttaattaggagttgtttcctttcttttcggtgttttaatcaagattaagataattgcacttaagtttataagaaagattagtttctaagccatctgtttttctccctttctcttatttctacatatcccccttcagatgg

SEQ ID NO: 56955 - DNA, 1501 bp, Oryza sativa
aggctaccaaccaacgattgattacacgctgcaaaaaccgaaaggtgtatccttgcatcgtatcctactctcatctgagcagttcactccaccaacattggaaagatgagtgcaagctgcggtatatagaagggaaaaaatccagattattctataccatatagcgttaaggttttatttggtacaattctcgttctcagatcatgctgaaattagaatttgtaagttaaattatagtggtttaaaattttatattgttctatgaaacaaaaacaaagcaatacattcaaatattatcactgtaatcgcatatccaaattcgtggatttctagagttaaaaacgcctagctcatacaaatcttcgatatgaagctgctagccctaaattaatcgttgaggcatgcacctggcactttggcagccgagttggactccactaaaaattagagaagaaatcttcccaatggctgccgaacaagtaccacaatctttgtgatttagctttcccccgtgcacatttggtacacgagcaccatcaatcaatcgagccagccgagtcggtttctctttctcccccgtgccaagctaccaaagcggcttcacgcaagaaaggaataacctgatgtggtgtggctccgatcacggcgccggcgccgccccagtcaccggtggttgttaaacctgtttttttaagcactaccacacctactaaattttttttactaaatttatactaacaatcatctcaaccgtttaatttagatagataaaagttataaaaactctaaagacactcatagcatgccaatgtcagtattagtaagaactaagctctgtcttaaattataagtcttatattttttaacacggtcttcaataccatataacagatataaaattagtataacatgaaagtacttcaaaatatgatatagtgatataacatgcataagtaaacttagtatagacatagtttatatggttattagccaaaagttattaagtttgatattttttagaaatgggacgccctataatttagaaatgggacgccctataatttggaatgcagacttttctcctttttcctttttttttctttttttgccgagtcatcagccagccagcctccccctccgcgtgagacccccaacctcagcgacgcgaccggcggtctcacgcgaaagcggactcgccaccacccgatccgatcccccgcgcgcaccgcgagagccgctcgtgcgtggcgttcgtcggttggttgggttcctttctttttgttggttttttcgcggtgttttcactgcgtttttcgccccgtggcgcacgtctttgctgcaacggcgaagggcgtgtgttttgtttttgtttttgtttagttttgccgcgttcgtcagaggagaggtttaggtgcgaccaaccagacctgaggctgcggctgcgcgctacgatacacgacggacgcggtctttctttgaagccctgcccagaggggagtac

SEQ ID NO: 56956 - DNA, 585 bp, Oryza sativa
ttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtcctt

SEQ ID NO: 56957 - DNA, 741 bp, Oryza sativa
aaggggggtaggtttgtcaccccatgaagtttcccccttcttctttcttaaaaatttgttgaataaatcgtccgaagaaaatggtttaatttacccaagagttgaatcctaaattaataaatgcaattaataattggaattggcatggtgggatttttcttgagatccacatgtcacaatatattaacaggatttttagtggaatttttagagtcttggaaataattttaatcaattaaaaatgagcaagtgcaatattttaaatcccaggaaaatccttttccttttttctcttttcttttcctttctttttctcttgatgggccgttggaccagtccacctcgcctcaccctgcgctcgggctcccctcgttgggccggcccgtttccccttccctctcccttcgggacgccgacaggtgggccccacctgtcggggtcgtccccttcctccaaccgccgccgccgaaaccgccgcgcccacctcctccgctcctcccacgcccactccgcgtccacatgcgcccgtgcccacgtcgtcgcccacgccccgctttcccgcccgcgcgcgcgctcgcaagggacgggattcgaatttgaatcccccctctctctctccccactcccccacgtcgcgggccaaatcgaccaccctcccgaccacgtccgcccgtcccgtgcctataaaattgctcctcgcgtccccctctctcgtttttcgctctcgccgcgctccccagt

SEQ ID NO: 56958 - DNA, 1501 bp, Oryza sativa
ggcatagtatggtttcatttgcataaatagcatttaataaacatttcagaatttaataaaacagttaagtaataattgaacaatattaatccaacgctatacaacataccctgttgcataggcccaaccattctgaacaaccatcccggctgcacagttctatctccaaaccaggaatgtaccattccaaacaaggagctaatcaaattattaccagttatagcatcttttattatgatgagaagtgtgaaactaatcacgaaagacattgttagacccgcccataaccgcgggcacagctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctccaccacttctcagtctggtgccccgcaatgaaccatgttatacaaaaggtaaagccgttgcccatgctagcttgtgattggcacggttaatgtttcacaaccgaaactcgtgaaccggttcttaattgtcatgagcacgaccatcaaaaccatatgctcacaacccaccattatcaagttttagttggcaaattaattaattaaccaatcacgatcaaccatcgtgagcttccattaagccatcattaaataatagtgagtcacaaattatcccaatagtgtgctaatgtttctaagcatggctaagcaatcatatttaatatctagttgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaagggaattattgcgtcagcggctagggttcgcggtggactgggtgcacggcggcggttcacgagattgggcggccgagatcgatccatccaaaacggacggccaagatccatcggtccaccgcggctcacggatggacgatgacga

SEQ ID NO: 56959 - DNA, 817 bp, Oryza sativa
cctcctcgctctagctgggagggggtaaccaccgcgccaccccgggctcgaccccactcggggggagccacgtgggtttggggccggcccgaccccaagctgggagggggcagccgccgcaacaccccgggctcgtcccccctcggggggagccatgtgggtttgagggcggcctcctccctctagctgagagggggtagctgccgtgccaccctgggctcgacccccctcggggggagccacgtgggtttgagggcggcccgaccccaagctgagagggggcagccgccgcaacaccccgggctcgacccccctcggggcgagccacgtgggtttgagggcggcctcctccctctaactgggaggggtagcgacgtgataccctcgggcccatatcaccaacagatagtgagaaaaaagttccaacaaggctctgataccagattattagcaacctaacttgtatctcactcaaacactcaagaacacacgaatttctcaccaaatctgacaggattgacgatgacctcgcgcatgatcagcttcacaacctccggattgatggggtggtctctagccgccaagcacctaagcttcttctcctcctcggtttatatatccacaaattaatagtagtattctaagtcaaatattacagaaatatttagattctaagtctcataattaagaaacaactttgatgaattactaccattcatctacgaaacgaaatatcgactaatttttccttacaaaatgtcaacatattgtaggtactccctatagtattgaccctcctaatcccctccctctcagg

SEQ ID NO: 56960 - DNA, 1501 bp, Oryza sativa
tttacacatgtccagtaaattacaaattgtaacatggtaaaacagctcataaaccacagagtccacacggtacagtacttacagtaccctagctagaaaatcagagtgtaataaatcagcatttcctctcaagaggaaacatctacctcagaatgcacagatttctactacatctgaagatgaactgtgttcatgtaactttgcctctgtctgtcaccacatggatgcaactgctgaagttgtagtactacggtatgcgaataaagaagcaataagggctttgcccgagcaaagatgagctgaatgcatcatcctcagttcttgctggattgtttgtgtgtgtatgtaccagatggtccatccactgcactgagatccacagttattgatcacttgtgtcctcttggtgaagatgaacagtgtgccctgtgctcctcttttttctgattgccacatgaggcaaactaatggcggccataaccggtcctaacaaccaaagtactgactgcaaacgctgcattctgctgctgcgtactataccacagctgagagagagagagagagacaaatcataactcgcaaagcgataagaaggaaactgctgctggggacctgggtgtttgctggccgccgccattatcagcaggaaatgcgagagtgaggctcagcatcgcagcagacaaaggtggatgcagatggaacaagatgcaaacaggctgtgcggggtatgcgagtttagagctcaacagcgaaagcttggatgtattatcgcttacaccatatgtctcaaaatatagcaatctagtatgaaatatgacacatcctactattgccaatatgtgtacatgtctcgtatccggattcgtaggactgggatgatctagtacaagattactacattttaggatggatgtagtatcattttatcaactttttgtgagcggtgagttgagtaagatgatgataacaaaccgtgtcaatcttgtttccggagaaaatcgattcgagaaatccaaaaactggttggatggcaaacaacttgtcaccgatcagtccaacttaacgatgttgacaacgaaatttctatccaggttactactatactatacgtctataccatgcccgattttacacggaaatatcacttaactaaaagcgatcacgatattcacataaagaagaagccaaatttcccgtccaactttgcattggacaaaattattcagatcaggtttcagtgcaagtgttcaactggacgtgacatttgccatcttttttcaaaaaaaataaattaatttgacttcttgttcagcagcctagatgaaatttgcgacacttgacatttgcagtgggatttgaagtgacacgacagcagccagacggcccacgtagatcctgggccatcccgatccggcccattaccgcatcaagcgaatcttagccgtccgtgctaggtcaagcctcccccggaggcagccatttatacccccatccgcgccgc

SEQ ID NO: 56961 - DNA, 1501 bp, Oryza sativa
  unsure (1)..(1501): unsure at all n locations
attgtgaagaaagtcttgaaaatacagaaaaccaaggacaagtcagcctcaaagtagacaactcttggaagtggaagcaaggcgatgtgctataaacaaggaaaacatttttgttgatggtgatgatcaatggtctagcctcttctagctgaatgttttagtataactgtctgagtttggagtacttgaaatccgtctaccattgtgatgcacttgatgtcaaatgttgctgagacatatttgatccgctcttttgttcacttctctgaattgcgaatgaattttacttacttgagctggtgttttgtttctactctgtctgtctgattgtttgtgcttctgtttcccctgaggacaatgaacgtatggtacgatatgatccatgcatttggataggcaaatctgcagtcgtaagccctcatattacgtttatcagccttctgtccttggtcagacttaagacgtatacagtactatatggtgtattttatagttgattaaactgatgtattgttgttgtcacagaagcgtcgattatttgattattttacgacttgggccgagtttagttacaaactttttctttaaacttctaattttttcatcgcattaaaatttttctacacacacaaacttttaactttttcgtcacatcgttccaatttcaatcaaacttctaatttttgcgtgaactaaacacacgtcaaaattaagtttgactaaaattgaaagtttgaagaaaaagttgaaagtttatgtgtaggaaagttttgatgtgatggaaaagttgaagtttgaagaaaaagttgggaactaaaccagccttgaaagtgaacatctacactaaattaatcaaaatttaaccttgtatttccaaaaaaaaatatttcattcactataataattcaaccctgtaaaaaaatatttcattcactatattaacaaactataataattcaaccctgtaaaaaaaatatttcattcactatattcaaaaaaaatatttatgtcaagaatgggattcgaacccatgccctttcggaccagtacctgaaactggcgccttagaccaactcggccatcttgactttgcatttatggcgtcatttaaatcttatgtaattcgttaaacttgaatccttaatccgacggacctcccccatgatttacggagtagtgctaccttcgtttccgaaccgggagttgattcattcgccagccatggcggatcgccgcgctctccagtaggttaccctcctccctctccgatccctttttctccccccctcgcgccatctacatgccgcctcgccttcttcggtccttcacccctatcgccgccggccacctttgngcgctctccgngttcgccccgcgcgcttgggagggcgcgccccacctgttcggcggaaatgcggnncggggcacccgaccttctcgcgcgccntcccgccgagctcgcgttattcgcccgcgcgcgcgccgcggggcgcgccgcgcc

SEQ ID NO: 56962 - DNA, 1501 bp, Oryza sativa
gtcctgagcagcttctactccaataatattctgcaccattacactgaccatgatcaatgatgaagaataaagacaaaggacaaaggactaagcaacagtaatttcagatgcattcatgcataatatttacctaatggcaagcactgtcactcgaagatgagcaatatgaaacaaataaagaaaatagaactaaaaatcctcgcgaacaccaaatgtccagttgagaacagaaagctaggaggaatagataggaacatcttatttttggactgaacacacaagatagtcctttcaactttattgcagatgtgtatcagggatatgtaaattcctggtcatagtcctttcaacttcattgcagatgcacatcaggggtatgtaaattcgtgatcaagcctagagtttcaaatttcaattcaaagtgacatgtttgctaggaaaaaaaaaggtatcattgcacacaagttctgcaattatgtctttgatgaaaagttgcagccgcataaatagacatggatacaaactaacaactgaacagaaacacagctaactcaacaattcaagcaccatgctgctccgagattgcagatacacctcttaggtaaaagactgttctaatgcactcatcgtgcttaaacttaaagtgacgcatcaggttatagagtttcattcatcacggtataattcataatagtatcatcatattctaatagtatcataattgcaaatcccccttctctattctctaacaaatccatgagccatacattgtttttctaaccccgcttaagtattcatgttatcctccctttgcaataataactcgcagaaatcccaaaaccaaagagggaagcagcacaacgcatcaaacttcgcaccaaaaatcgcgacacaccgacgatcagactttcaaaattaaccctagaaatcgctaaatcaaatctcacaaaccctaacccgacaaaggcgcacgcacagatcaggccacccgcgacacaccaaacaaactaacaatcgcacaaccatctccgatcagaacctaaatagagtaacccctgcatagctgcgcatcatcgtaggggggatgatggatagtatgggtacggaccgcgaggtagtcagcggcgtcgggcggaggcgcgagctcgcagaaggagacgaggcccgagatgaggtccgcgtcgagctccagcgcgccacccatccgctcccgcagctcctgcagcgcgcccttcagccactcgccggacgtgctcgccgtcgccgccatcgccgccgccgcaagagccctctctactatggagaagaagcggtgtggttcacttttgcaaattccaccctgaacctatacacaattccggagaaggcttatcacttcgatttttattttagtccttgtacttttacagttttacaaattggtccctcaccttatcccgaaggacacgtgcgacttcttcggtgagccagcgagcactcgagctgagagcaaagaagcgca

SEQ ID NO: 56963 - DNA, 271 bp, Oryza sativa
caacttttggtgtaccttgcctcctgggacaaggattaatgcacgcacgtaaggaatgcccgttgggttatttccggtcgtgacaagttggtatcagagccccccttgaccctaggacgagccgtagatcccaagccttagcaatattttcaaaaataaaatcccttcttatttgtgaaaatcctctagtctctctctgtcttgctgcttcatttatcgccaaaaatctaacctttaaaatgttgcttttctttttgtttttgtttgtaga

SEQ ID NO: 56964 - DNA, 1501 bp, Oryza sativa
atggaaaagttgaaagtttgtatgtgtaggaaagtttgatgtgacgaaaaagttagaagtatgaagaaaaagttgggaactaaataaggcctcacttatatgtgggtccaacctgattttaaatcttaaactatgctgtgttcaattgtcaatttctccaactttttcacgcgaacgtttatcaaactactgtaaataaataataatttttttataaaataattatatataaatgttgttttaaaaaaatatgttaatccattttaaggttttcttaagctaatagttaattaattagtatgtgctaatgagctactcgttttccatgtagtgggattgagttcgcaaagcatatgtttcactgtttagatccgaaacaaatctctcgtgcatatggaacgaagagacttattagcacatgatatattaatatgctttttagaacaacttttctatatttttttttgtcaaaacacatcgtttaattaggagtttaagaagcgtgtacgcgaaaaacgagtgaggagagttggaaagttgactatcgaacatagctagcctccggctccacacccaagattttgctgaaattttgaaaatcgtttacaaatatttgaattgaatgtacgtttcaccggaaacttaattcctagacgctagaaatcagtgttggctagctgtaatagatgaacttgctggtaattccatctcggccattacatgtagcacaaaatcatcacatcgattatggactaactagcccgccgtaattccattgcgcgtacaagatctagattaacagctgacaaaaaaaaagagcacatggtaatctacctactaactaataatgacaaattaagtggcgatcgacatgagctcgctagtcttgtgcggcactgtctcctgtgcggcgcctctgtcgtggcggctcctgatcctgctccttctccgtctccggtgtcggcctcttatgcacgacgacgacgggacttgctgctcggttggcatcggctaacaagaccgcagagaacgcttgtgattccgcaatctccgcctcggccgtcgcggcgtgcttctgcagcgcctgcacgatctcctcctcccccgcgaaggcggcggcgccacgcgtgagcttctccttcaacacggtcatcttctccaccacggcgtcctcgaacttgatcgcgctggccaacaacccggccttgcggctacggacggcatcaccgccggagtcctgcaggaccagtgatttggtggacacgcgcatggcggtgatcagcgccgcaagctccggaatgacggggtggtctctcgccgccatgcacctgagctccttctccagcaagcgccgcgcggcggaggcgatctccaccgcctccgcgcggcgcgcgtcggcccacgcgacgtgcttcctgagcaccgcctcctcgggcctccctgtcccggcgaacacggccaggcccctcctgagatccagcacataggacgccatgttatc

SEQ ID NO: 56965 - DNA, 1501 bp, Oryza sativa
tctccgctccatgcgccagcgctgatctccatctcgcgaggagggcagagcagggcgccgatcctcaatctcgcgaccggagcaggggaggggttcctgcatcctggtgagcatccaaatcctctctctctctcccccacccgctttcgtctcgaatttgctttgcgtgcgttaaccctacagcttcctcttctagatctggaagaagcttttcctcttaatttcagagcattaaccttagtacttacaagtaaaagtttgatttccacccccaaaagtatggggattcaactggattgaacccccatgtccggatccgcccctgggagagggtaatttcgtcggtttattatgcttttcggtgcttcgcggtgagggatttggtattttggatttgggtgggcacgcccatgtgcatttatcgtggagcaagattggtaggaaggttggctcgaggtttaccatgaaatttgggactatttttctatttgtaatttcttggtagcgcgatgtacgatggcaacaatttattttaatttttgcctccttcctctggtttgataaaattgagggtggtggcggaaggaaacctccatttcatcaatcctgaggcaagaagggtaccctttttcttggaaacctcatattaatttgtcatggatatgcttttcatgtaaccttatactgagttatcttcggtttcggtccatataaatttaggattgagatgatttctgagatgtaattattgtaaattgcatttataatcctgcatttgcataatgttctgagctgcagaacactggtttccattcccgagcaattataccacaatagagacaataacaaaggcacgaaatgtagggtggactctcgttcttgttattcttttgttatcaaatctttagggaattataaggattatagtttagtgttctttttgtaagcacacttgtgactcatcgcattaaaatgctgggacatgtgttaccatttgcataagctgagcaataccattatgtgtggtcttggacttatcttatctgtactgatttagcattgcattgcttttgatgttatggaaacatcgtttatatatctttttactattcaactgagagttatgacatatgaactatgaataattcctgtttctgctgcaacatttgctgattgaggaacttgcatgcagaaaggtggagctcaaatcattagtgccccatttatctcgtaccaaggactttggtgcctcattttgtgaaaataagaaatttctgtgagctgcttcgcaactgtcctactgtaggtttcatgttcttgtattcgttctgtgtaggtttttctaattaatcatgtcatttgttgaacccttttgttttcttttcactttttcagcagggggctacacctgatctagcaactaagattatgaactttgagcggatctcataggatttgtaaagaattcttttgttggagtagttttttttatttgaaacaa

SEQ ID NO: 56966 - DNA, 190 bp, Oryza sativa
atcttcaagtaaagaaagcgtattagttgtgtgagtctactgtgtggggcccagagggcaaacgagtgctgactatataaatctccagctgctgtagcgtatatatacaagttgaaaatgtaagaaaacaatctctctctctctctctctctctctctctccccttctgcttttctctcaattctctaga

SEQ ID NO: 56967 - DNA, 1501 bp, Oryza sativa
  unsure (1)..(1501): unsure at all n locations
caagtttcaaattgcctggtttttgtggatggagtaggtttcttggcgccaaaaattttatcgcttaagtgggggtcatcatcactttttttaaatatcaacctccaaaaacaactttcagccctttcacaaacaancacaaaaaacttttccacaagccaanccnncnnacnncccannannnncaacggcgtcatctattaaaaaacggatgtagtataagacagggaaaagtgtcaagggtgtaataaatgttttgtttgcattactgaagtggataataactatggaccatgatttacattcacatgtgtataatacagacattcaattagctaatatgtttcatactttggcatcacttctttatccatacacactaacagactttacactcccccaaatcttacaggcatgactgcatctaatgactgttacaacgatgtgaatggacccagaaagcaaacgtttagcatctcagtaatataatggagtcatcaacatcatttgtttgattgtttctcattgaatttaccagagaagtcagtaaggcagacagcagatcaatcatatcgaaaggaaaggacaatcagcgaatcagtatcatctgttgacacagatgatgtatgaacagccactgatagggaaaaaaaatcattgagccgacctgaaagctactcgcaacgattcaggaaagtacaaatgcatttgttatggcaattattgttctgttagtaacaatagatctatagcaatttgcatttgtgtagccgccatttagtctgtgaggtacaatagaaatttgagaactacaataccttctagagacaaagaaatatagcaatacggcaatgaagagagaagtttcagaccatattatctgaagcgtgtttccattagatttcataggtagaaacaaatgacacaagtcttgtaaactccattttcactagctctagaagtttccaaactactatctgaagaacttacagatagagctgtggatgttttttttatatttctacagaattgaggaccaaattcaacttaattggacagatacaagaaaggcaaagtcagatagaaagctgtttgtgcttccttttgtagattaaagttagatcattgcagatgagtacaaacacaatatatttcgctcgtaatttacttctgggagttacgggaaacatgaaattacagagaacagtaaaataaaggagaacccattgttcttttcaagtatctttgatcaagttactaaagcatatgcacaaagccgtaggctgatcagtcaaagccttcaagatgctcccaaaagctccttgatatcatacccttgcagctgaagcaattgaaagttatacatgtcagttacatctcatagttactactgcatgaaattaatatgccagtacatgccatctaaattctgaaataaccaagtaacataaatagacaatcatcagataactaccctattcatatgcaattctctgcaagt

SEQ ID NO: 56968 - DNA, 400 bp, Oryza sativa
atcactctctgtgctccctcatctgggtctttgtcaaaaattccttcgttgggtgtgtgttcatatcggttcaatgttctaatttgtccctctgcatacatcattccagttcggatgcattgtatctatcgctccctgcacagcctcacaaccttcatacatctacagttctttttgttcttgtgtttagcctttaaaggtttaaagcatctcgatttcgaggcaagatttgtctcctcgaacggaatgtccactatcccccttgttaaaaagatggaattttcttcattacaggatgtcgggtcgagggaagaagaagaatggagtgtccttcaatattccttttacactgccgattttcacccgattgacttaggtcttgttcgtttctccaactaga

SEQ ID NO: 56969 - DNA, 1501 bp, Oryza sativa
ttttctgaaaaagaatgcacgatgtactcttcgcacaagatcaaatctattgtaagtaacatggaaagaatatcatgtcctgaccataacgaaatatatcatctggcagtggtcggaaggtattggtgatgccatatacaacacccagcacaactgctgtcacgctactgcttaagacagtgaaaagaaaatgataaatactttggcaactgtcaaagtatccattgtttgaagaatgcaaaaaaaaaaaaaaacagcaagtgcttggattcgtacagttgtccaaggaaaagtatttctgccttctgatctaccgttgcctcgacagctctaaaccccacatacgtcaaaaccgattgctcaaccaatcctgtcagaacaaagctgtctaaagaacattcagaaaaagctttcttcaatagagctgtcgatgattgaatacactaaaatactgtaaagagcaataaatttgagcattatgtatctgccaattctaagttatgaacatatggaattttcttttcataattagctccaaatccaatactatgtgcagcattgcaatagcagatagacatcactaaaacactaaccagcatagggtacaaaagtttaggagtaccttactccacagcccaccatggtgagcaccaccgtctgccactcccacggcacatcccatcggcgaaggattggccattcgtctgaattctgctcacatccaaattatgtcacaaaatcttcagcaagagaaaccatcgcaaaagagaggaatacttacatccaactaaactagacatgttttccatcataataagatactcctatcaaatgcacatttgccattctaccgatgcatccgtaaaaaaaaaagaaaaaaaagaagaaagaaagaaagaaagaaagatcttagaggtgtgttcttccaagaagctactagtatttaaattcctcaaaatctgaagcggcggcggcggcgtagagtcacctcactggaaggcggaggcggcttattgccggagttgaaggagaggcaggcgtagcccccgcgcctcctccaccggccgatctccggcgaccggagccaccgccgctgagctcttaccgccgccaggcagccagctcttggcgatggaaatggcctccgttgcctggacaggagtacggctctgcacgggagcggccggagcaggtgaagagagatcgccggcgacaacgccgccgccgccgccgacgacgaggaggccgccatgagaaggatgcgcttctttgctctcagctcgagtgctcgctggctcaccgaagaagtcgcacgtgtccttcgggataaggtgagggaccaatttgtaaaactgtaaaagtacaaggactaaaataaaaatcgaagtgataagccttctccggaattgtgtataggttcagggtggaatttgcaaaagtgaaccacaccgcttcttctccatagtagagagggctcttgcggcggcggcgatggcggcga

SEQ ID NO: 56970 - DNA, 163 bp, Oryza sativa
  unsure (1)..(163): unsure at all n locations
agcgagcactgtcaaatggtcgctctggtcaaaggtgagcttcacctccgaccagtgcgccttccgagccgcttcgtgggttgggacggtggctagaagctctcgccttatggccttgaagcctcggcgggaggtgtgagcgcaagccccccctccccncagg

SEQ ID NO: 56971 - DNA, 836 bp, Oryza sativa
catttaatatactgtagtatcacattggctaatttacgagacaaaatttttaagcctaattaattcataattagagaatgtttactgtagcatcacataggctaattatggattaattaggctcaatggattcgtctcgcgaattagtccaagattatggatgggttttattaatagtctacatttaatatttataattagtgtccaaacatccgatgtgatagggacttaaaagttttagtcccatctaaacagggtctaatacacttgccaccaatcaacccctcttcttttctttttttttatttcttagagtttgtgtggatgttgcctcttgtagtcttgtatgaggtgtgatgactgcttctctctcttctcttctcccctccacatcaccatcatttaagtattcagttgcatatacatgttgtatacttgcacagcgtatctgactcggattagctctagttctttatttctttcttttttttttcttttctttacacaatccgatccgcgtgtgtaggactaactgaatatctttcggaggaaacagagaaatggagtaaaaaacactcggatttccataagccgcatgatccatatactagcaatcactggttagtttactacacattgtttctctttcaagttaggagaaaatcaagatcagaagatagcccaaatagaagcctgcgagagtcatagtagtataaactaagcaggattgtgagcgctcataaacttcccatttcccaatgatcatcgtgaaccgtgaactccgaacctgcggaagcggattaccatgtgtgagtgcgagatctgggccgtaaagg

SEQ ID NO: 56972 - DNA, 154 bp, Oryza sativa
catttaatatactgtagtatcacattggctaatttacgagacaaaatttttaagcctaattaattcataattagagaatgtttactgtagcatcacataggctaattatggattaattaggctcaatggattcgtctcgcgaattagtccaaga

SEQ ID NO: 56973 - DNA, 1019 bp, Oryza sativa
tagagccatggaggatcatcggggacgtccaagtcaaggtggaggcccaaaccaagtcgacgtcgggtgcaattcggagtccaggaccagtctgcactaaaacgggcgcccaggtcgcatacgtgctcggattggggcgttctttatatggatggaaagctaagaagataaaatttccaatggttttggtcccacgtccaaattcttttcgagtcaatgggaattgaccgaacaagttgacatccagaatctgtcccggtgctgcgtcaccgtatttgggcctttggcccgtgtatcgtgttggaacccattagggttgcgtcgagaggggtttgcacgaccctaaactctatatatcagtacccaccgccatctttaggtttttgggttttgcttagattaatctgtcgagaatagtttcgccgctagatcggtttataagaccccaactcgtgagcttaatcattcatctgcaattttggttgttttctatcttgttcttgtttgtgttcttcgattggcaaatagggattagccttcttggcgaggtcatccgcgtttcggcacgggtgataaccataggagacgtggtgctgcgattgcggggctcaagagcgtacgcgttcaagaagccggatcgatttgtgtcgcgactccgctcaaatcgttgtttatcggaacctttcggaagattgggaaccctagtgcacatcaagtggtatcagagctctaggttcaccgtcaggttcgctcagtttctttgccctagattagtttttgtttttcgcaattatcctagagtctacagaaaagccaaaaaaaattttagttgttagttaccttaacctagaccgtgtttagcctttgcatgattctttttcaaagtccgtagtgttgagtttgagtcctagtttaagttcctgttgctggtctagtgcgtgttttagtctagtcgtgtgtttgtcctttgtaaccctagccgctacctttcaccgtgtgttagggttcatcctttgaga

SEQ ID NO: 56974 - DNA, 516 bp, Oryza sativa
  unsure (1)..(516): unsure at all n locations
gcgggtncnnattgagttcgcccgcgtncgnnnnnnnnnnnnnnnnnnnnnnnnnnnnnnnntataaaattaccaagtataaacaactgtgggaattgttcaggtgtcagatgagcaaaggcaaatagagcagcactgacaagtgtgcaaacgcgggtcccataaatcggtgcgcacgctgaagtcatcgaatcaaagtgggttcgctatcttgggactgcagtagtcaaacacacaatggagctgctctaagggctttcgcagtatgcctaggtggtgtttgtcccgatttctcacgtcggagattctagtctgcctctccgttaccaaatgaagatccacggatcccttgaggcacgttcctcgttaggtttgtcgcaacaagacagggcatggctcgcacgttgcattagaagagggcgttgccctatgctgatgaggacatactccactattacccgctggcaaagacgcaaaaatcgggcggcgaccgtttgagcctctgaataatcccac

SEQ ID NO: 56975 - DNA, 174 bp, Oryza sativa
aggtgaaagaatacatggagagtcaactatcaaaaataagttcttctaatgcagcaaccaagaagcacacgcatgttgacgaggttgtgaaacatcacataggcctgaaggatctgttttagatcccatctgtgtagccacaaagggtgcacctaggagaatgaaaggatggga

SEQ ID NO: 56976 - DNA, 188 bp, Oryza sativa
cacccaaccaaaccctttataagcctcatccctctaaactcccaatccctcctaaaacttccctccacccaaactataggcgatgtgtttggtgggtcaactaggcggaggagacgatggggaagagaggaaaggaatggccaccaccttcccgcgcgctgatccgccgccggccggtcgcgcccata

SEQ ID NO: 56977 - DNA, 232 bp, Oryza sativa
  unsure (1)..(232): unsure at all n locations
tcctcccacccttgctatctcgttgcgtacttagttctgttttgctttggtatcttgttccatagtttgagtacgttgtttgtatgtcgtagtgctnnnncnnccncccagtgcgccccnattttagtcactgcttagcagccccnccagacttgggaattcggcacccccggcacttttctcgatatcctgacaaagccatcagtgaaagaggttattttttttattcagc

SEQ ID NO: 56978 - DNA, 185 bp, Oryza sativa
aggcgcactgtctcatccgtgtcgtttgagaagcactcacttaaactttttagaaaagagttcaaataaaataaattgcgaaaacaacagcctctccttgaagcctgcattaaacacttatttccctggctttgctgagtacttccgtactcacccttgctctatataaatgatccccccccagt

SEQ ID NO: 56979 - DNA, 279 bp, Oryza sativa
tctctctctctctctctctctctctctctctctctctctatatatatatatatatatatatatatatatatatatatatggggctagcttatattactccgactataatttttaatatatgatattgttaacttttaaaaatacaatcgattttttaaccttacttatataaaaaaatatgtaattaatatttattttgttgtgatttgatttacaattaaggtttctttaaatatgacttatattttttatgtttgtgaatattcatgataagaaaga

SEQ ID NO: 56980 - DNA, 503 bp, Oryza sativa
  unsure (1)..(503): unsure at all n locations
attagaaaaccntacgcagacgaattcaagaccatgaaacctacagtaggacagtttcgaagcagctcacagaaatttcttattttcacaaaatgaggcaccaaagtccttggtacgagataaatggggcactaatgatttaagctccacctttctgcatgcaagttcctcaatcagcaaatgttgcagcagaaacaggaattattcatagttcatatgtcataactctcagttgaatagtaaaaagatatataaacgatgtttccataacatcaaaagcaatgcaatgctaaatcagtacagataagataagtccaagtccacacataatggtattgctcagcttatgcaaatggtaacacatgtcccagcattttaatgcgatgagtcacaagtgtgcttacaaaaagaacactaaactataatccttatacctgcacacgcgacgcgcacagatgaaaacaaaaatctcggatctctcgccgatcgatcgatcaagaacg

SEQ ID NO: 56981 - DNA, 355 bp, Oryza sativa
taggggaatggcgcaaattagggatgatttggctggtgctatgtggaacaatagagggtcgtctagggtctgacctgcttagggattaatttgtaactctctatctgtgaacttaggatggggtgcactgttatctattcatgcatgatgattgttgtaccctgttgcactgttatctattaatttgagacctcgagatatttgcaatgatgctgtttattacatctatcgatttatgttaaatttatttgttcatttgcatgtggtaaatataggatggctgaggctggtggcgggaatggtggccatggtggccatggtggacaccatggagccttgcattggacaaccaaca

SEQ ID NO: 56982 - DNA, 955 bp, Oryza sativa
ctagttaacaccgttaagtgtaaaaactaacggaagtgctacatagggaagaaaaattttagaagtgcctagataggaaacttttgaagtttaggtgctatagagggaagaacaattttttttatgctagatagggaattttttcaaaaatcaacttctatcactctacctactccagcatataaaacgataagttttatccttaaataccttttacctacctattacttttactactttttctaataatgaggagtattttcatcatttttacttcccactattttcttcttggaagtctaggagttgatattttgtgggatggagggagtactgtacgggtgacaagtgacaaacagttcgaaagtttccaaagtttaatattggactccgctacactgctgtacccaggttacaagaaggtagtacaaaattaacgtagaatattattccctatgtttcgaaaagaacccaattctgaatttaaatttggagtttttttttaaaaaagaatttaaatatggacatatagtctgtttagtagagctccaactcctaaatttagcttcagaagttgggtttggagtgaagttgtggagcagcttaaactgttccacctctgtagtttattttgtgagagcgtttcacctagcttcgctcttattttggatagagctaaaactgtttagctgagttctagctcctggacaggtggaggcgtggagcgggagttagagctatgccaaacaggctcgtagtgtatattcaaatataaactcagtattatatttttttacgggcaattgtaaatttaccaatgctttgaattgttattttaaaactgccactagaaaattacaaaaataccactggaactatcattcgagtgtcatccttgcaaaattgaaaaaactagttgcaaatttgcaaatgcctcattttttttaagacagtg

SEQ ID NO: 56983 - DNA, 1501 bp, Oryza sativa
gaagaaaggttacctagtgagggcggtattgttcctgagatgcaattgtcccttaaggaaatatatttaatgggggaggacatggccgcaatagcgggtatagaaccaacaaagctgttttgttgtaggaaaatggcggtaagtgatgaagtattgaatagagactttgggacttctccactaagattattgctcatgagcctaagtacttggagagatgagctgtttgccaaggactctggtatgcttcctgtgatatcattattcccaagatcaacatatctgagagaaaagctgctgcctagagatggtggtatttcatctgtgagcctgttgctagtgaggaccagtgcttgcagcttagaaagattcccaaaagcagaggagattctaccttgcaaattgtttctgctgagattaatatcctgaagatgtatgcatttgcctaggctagctgggattgcaccttggaaggaattgcttgacaaatctaggatttcaatttgggaatatgaagaaagttgagatggaatgttaccttctaaagagttcatgctgaggttgaggttcctgagttttctcaggaggccaagcttgggtggtatgctgccatggaggctgttgtttgacagttgaagtgtcataagagaggtcaggttggcaatgcaaggtgatatggtgcccgtgatgccttctgatgagagatctattgcaatgacccggggaggacttcgtgagctgcaggtgactccatcccagttgcagaaattcaaggatgtgttgctccatgaggatagaactctagatggaccagagagctgagacttgaagcaaaggagagcctgtctatcgtcagtttcattgcagatggctaacgatatgctgcaaaagatgaagtgacaaagaacccatgcgatgtttggagacaggacactcgaagaggccattgctgttaattccaactatcaacaagagaccttctccgcaaatggctgatcaaatgttttgttggtagtccaagatatagtggcaaggaacaaggaagatgcacaaccagatttgctacctggtgtttgttcaaaacagaaaacctctatccaacactgtcagcaaagcaccttgtaattgagttgcttggaaagggtctagaaaactggaaagtgaaatgtggcatgcaatggaattactagactggtcgttcttggtaggccttttggcactcacacaatcccccatttagttattctgaaactacaagctgatgcccaagatttttgactcttcaggttgccacttaccttcctacatctgctagcctcctagtcctaaagaaaaactaaccccgactagctatgattctcgaatactggtgccatgtgaacgcacaccttattcctgaagagaaatatcgatagatgtgattcttcttgagttcccagggaatataatggatctctgatgatctatctgtctagccaacaaagaaataacctttacaatg

SEQ ID NO: 56984 - DNA, 1501 bp, Oryza sativa
ggcgaaggctaagtagggaagaaaggttagctagtgaggaaggtattgctcctgagatatagttgttccttaaattgagatatttaattggggaagacttggcagtaacagcgggtatagaaccaacaaagctattctgttggaggcaaatggcaataagcgatgaagtattcaatagagacttcgggagttgtccactaagactattgctcattagtctaagtacttggagagatgaactgtttgccaaggattctggtatgcttcctgtgagagcattattgccaagatcaacatatctgagagaaacgctactgcctagaaatggtggtatgtcaccggtgagcctgtttctagcgaggaccagtgttttcagcttaggaagattcccaaaagtagagggaatgctaccctgcaacttgtttctgctgagattaatctcctgaagatgtatgcatttacttaggctagctgggatctcaccttggattgaattgttccacaaacctaggatttctagttgggaacatgaagaaagttcagatgggatgttaccttctaaagagttcatgctgaggttgaggttgttgagttcactcagtaggccaagcctggatggtatgcttccatggaagctgttgtttgacagttgtagcgttgtaagggaggtaaggttggcgatgcaacgtgatatggtacctgtgatgccttcagatgcgaggtctattgcaatgacacggtgaggacgtcgcacactgcaggtgactccatcccagctgcagaaattcaaggatgtgttgctccatgaggataaagctctagatggaccagatagctgagacttgaagcaaaggagggcctgtctatcatattcagtttcattgcagatggctaacaatatggaacaaaagaaggtacagagataaagaacccatgcaacattttgagataaggcactaaaagaggccattgctgtcgattacaaccgtctgagaagagatcttctgtgcgaatggttgttcaaaaatggtactgttaattgttagtccaatatatggtggcaaggaactaggaagataaacagatgtactacctagtgtttgttcaaagttgaaaaccttttgtgaacgcttattacaacatggatggacatcttcttgtcaggaaagcaccttgcaattgagttggtcacttggttggatggaagggcatggaccaaactgaaagcgaggtgcgagaagtgagatgcactggaactagactggtcgctttttatatttggaaagttgcagttgctgaaccttttttttttttatccaaagttgctgaaccttttagcagagcactcgcagaacatatgcattcattcaggcttcccaattttttttcccaaaaacgtcacatcaaatctttggacacatgtatagagcattaaatatagataaaaacaaaaactaattgtacagtttacatgaaaatcgcgagacgaatgacgaatctt

SEQ ID NO: 56985 - DNA, 1314 bp, Oryza sativa
ctttggatttgttgccactaaattcttcattgcgaaaatggagcatgtcacattaagggggagttttgcactcttgcatgtgctctacttccctttatatgtgagcaaatcaactagtggtgctagtagtattttcaaaatgcccaagtcaacataagtcaaaacttttgtaaaatcaatgtaatttgaaaactatctcttggaaaatgtttcaaaaggtttcctatatgttttccaagcctcacattgcaaggaaaatgatttttaaatgaaaatgcccttttggccctcttttgaagaaactatattcttatttttggccaaaatgagattttcctccaaaatgagattgagagagaatttgagaaaagtttcaaaacaaagttggtaaagaggaggatttgaaatgtttttggtattcaaatcatattcaaaaaccaaatatttcaaaagttatttgaaaaacaatttagcccaaaaacccctatataccataaaaggtcacctcctagcacttaagtgagttttgttgcaaatcattataatttttaaatattatgggtggttagcaatatttatactcacacatttcaaagattgctttaaaaaatcaaatttcttgttgaattttattgtgtggggttgccggcttgtgcaagggctgtgcacagccggcagggggcctggcggtctgaccggcgctatatgcgcggtctgactggccaggtgcggtggtctgaccggccacatagggccggtctgaccggctgaggtgggcctaggcagttttgcccctttttcttctccatcccgcacctaccctctcctatctcatccccattcatccccaactcgaaaaactctctctctctctctctcacctccccttaaaccctaactctttcctccaccaaatcccctcggtttgaccgtggatttctctccggttacaccgtaagtgattctcctccgcttcctctctctattccatgtatcagttcgtgtttttgttgagtttttgatccatggcatggaaccctaggtgaagcacgaggtgttcttcgatttgcaccaatagagggtagtttcttggtgtgattcaactcctccaaccggtaaatcactcttcctcttgtgcattctctcaaatcgatctatttcaccctagggctatgggtagttgttccaatcttgatgaaataggtccaatcctttgatgttctagttccaatcttgtgcaatcttgatgtagcaaatatttttagagtcatttgtatgtgatggtaaaagggattttcttgtgcacttgtcaga

SEQ ID NO: 56986 - DNA, 425 bp, Oryza sativa
  unsure (1)..(425): unsure at all n locations
cctcatcttgtctatatctattttatgtttctttgtttagattcagatttttcttattatttttaccnacccccccccccagatgcncnntttgatgattgtagctcctccgnnnccagcnncnnnagacncgaggaaaacggcaccccaatcttaaacgnngaaaattatggtaagtgtgttgtgtctgacaactaaaacatgtcaatagcgtggacattagctttctgttctcaactggacatttggtgttcgcgaggatttttagttctattttctttatttgtttcatattgctcatcttcgagtgacagtgcttgccattaggtaaatattatgcatgaatgcatctgaaattactgttgcttagtcctttgtcctttgtctttattcttcatcattgatcatggtcagtgtaatggtgc

SEQ ID NO: 56987 - DNA, 391 bp, Oryza sativa
gcagctcctatcccacatgtacatatcgccatccatccatcccacatccatctgcatcacgaatcaaagcaatttttggctcaattgaagaattccatcactccaatcaaaatccatgacacaaattatttgcatgcatcaaaggtaaaagtacaagataaacaaatcagaaaaaaaatgaagtccatccgcacgtcgtggagtaacctgcactcatcatcgtggagaagttgcttcgcacgtcgcgttgggccgaagagggcgtggagctgggttgggaggcatcggatttggccgccccaagcgccggtgggaaggggcagagaggaggggttgctcacccacaccgttgttgcccctagcatggacgcgtccccgtcgtcggttcagg

SEQ ID NO: 56988 - DNA, 321 bp, Oryza sativa
tggtaaacaattatctaaccctatacaggttatcttcatatcttcctactggctccacttctggtctacaatgctaccacaggaggagcaggatactatgcgcaatggtgctatactcttggaatcggtagccaagggtctcttatttcactatgggtggcgtagttccataagaattgctagctaaaatattttatgtgatttaacgctagttaataataaatgggagttggggatttgtcccatcaccttatttctcattttgatttacttttatcttacctttttattactattaaacttatggttgtgtgtcttata

SEQ ID NO: 56989 - DNA, 436 bp, Oryza sativa
agtgcatgcttaccaaactgctatatggtgtgtttttttcttttttaaagaaaagttttatatgaaaattgttttaaaatcatgttaattaattttttttaaaaaagagttaatacttaattaatcatgctttaatgaatcattccattctacgtgcgtgagaaattagcacccaacatcaacctctgaacacagcctaaaggcagtggtggtgtgaaagtgaagcatgcaaagtgggctgtgggcgggctctgcgtttgaaagggggaaggaaggttttgcatggaatttgcaatggcagccggtgagaccttttcctgcaattctgctttggccaattccttccttctcacatgcattgcaaatttgtttgcaatttgctcgcattttttttgcaagtctgcacggtttgagttgacaaaaaggttaccctgca

SEQ ID NO: 56990 - DNA, 371 bp, Oryza sativa
gctgataataagcatatgttcctgatgaacaacatgaatcttgcatggttaataacataagacagacagcacatggatcaaaatcttactgatgcccaaagatatatatgaatatatatcgagtaaaataaaaactcttgttggaattcttgtatacaactattttataaaacccaaagagaggggcaaaaattaatagagtaaatatcagctgttcttcatcaatctagagctccctttgggtatacatgcttctttgttgatgaacaatattatttgcgaacagcttaaatatgtactaaaaaaccatctcatttgaatcaaattaagcaaacgaaggggaaaaattaattgaaagaaagaacttcttt

SEQ ID NO: 56991 - DNA, 1501 bp, Oryza sativa
ttatggctgtgagaaatattaaacatcactatatattagtaatcaacatccatacaagatccatgggcaaaacagtcctttcactcctcctaccaaatctggagctggaccatatgtattattacccaaacaggtgctagctccaggagctcccggtggagaagatttcctggagaggagctcattttttttgtagaggagctctcccaaacagccccttagggttttttttgttaggccatacttttttgatgggccaagaaaaatgaatatctagtcttttctaggccaaattctagggtagtcctgggcctacatggactaccctttgggttcgccactgccaaaatataaagagttttggttaggacatatcctactattacgaatctggacaaactgatgtatctcatccaaccaaaactctttcagccccattgtttcgtttatttgtggaataagccaaacggcatatttgcagactaaaaagtaaattgtgaataaacttttaatatgtgttcttagcgatctaaaagcaaaggctgaaaaataaacttcgatgaaaaccaaatttaaggttgaaaattcaaattttggctgataaacataagcataagcgaaaagatgaggccctttatattttttaaatggagggagtactaacagtacttagtatactgagtagtactcctactccacttcagtaaggatcataggaccaaaaggaaaagactagtggctcagtttgaaataaattattggatagattgttgtcacggattatctatttaagtatagtgataaagtaaatattttaataaataaacttaacaactaacttaaagtgatctagacaaaacagtaaaagatattatttttaaaataatgtacttttaaagtatgggacaaataatctggttcaacgatccaatacgtaatatgaacaatttgtgcttccttcgtttcaacttcgagtactgatagctcttaaatagttataataatataaagtagagtttaatgaatatgtttagaatttaatatgctttattaataatatggtaattttaattaagtatttagaaaacctttaaagaaaatgagttgtcaaaagtttgaagattaatggtgtacaataacaattatttggaaagatgagttacagtaaatttcaactcacacgtattggtgtgccgaatcgtcgatggatcacggatgtggaagtgattatcgacccttttttgttaaccttccaaataatttagctcagactttgtaccctcacagtgacttgtacaagcgtttactccaattactcccaaacaattcaagccactttttagacttccttaaaaaaagtaactttttttactgggataattgaagcatgttcagttccaacttctacaaaagcatgcatcatgccatcctccaagttcccaccattctctcaaaaacgaacagcaatggctgctttgagagtcttctctacaggcgtcat

SEQ ID NO: 56992 - DNA, 246 bp, Oryza sativa
ggggtctatttgtaaaataagttttcaaaaaggaccaaaatgtaaaaatttcagggattccatcaggacgggacgggatccctttcacccccttgcctatcaaagaggagagagagctaagcgccttagccgtgaggaggaggtggctgccggcgagggccggggaagaggacccgctcggcgagatgtggacacggccatcggcgatgagccctgcgcattaagctcccgcggcatcgaggacct

SEQ ID NO: 56993 - DNA, 1501 bp, Oryza sativa
cgtcgaggcgggaggactcctccccgcgcgccgcgctcgatccgtccgctccccagtacgcccgaggtgaggcccgtccccttcgattggttccttccttcgctctcacttttcccttccccccagtctggaatcccggcgactgaccccccctgtttcgatctccgtgcgcgggggagcggtcgatccggtcggtgaatgcggccggggttagctttgggtcgccccgctgctggtggcttgtcgagagtggataggccctagggttcatgtgtgactttttgcggcgcgccaatccgtagtaagcatgaacacactgataggttctctcttttttttttgcgaagtttgttgagatttagaagagagtttaggttacaaatacgacattaatcccgcaagcagctgccccggggtaaaagattactagcatcccgtccaggacgagcctgactaccccactgataggttcaaccggcgtatggaacctcgaggataggttctctttgtgtatagaacacactgataggttctcttcgtgtatggattatccaacgggggatggattgagccttccattggacgtttggctctgtgtgctggttgctagattggatttagaatatgagagtcatgaatcgtgttgcattattatactagtgaaatggattgtttcttcactgagctatgtgtttcctacagtgatgcatcttctataagctatcgcgattgtttctttaacagattaagcgtggtagttgctatgttatgtatcaagagagaaggaaaccttcacgcatatatgtggttttaatggttaatgtttgcaatgttcttgaggcatacagttcgtacacatggagattctttaccgattgtttagaacaaccgagttagttcaagcaatgcatatataaagcttgaaatggaccttttatgttctgctctgtagtgggaacacatgcactgtgagtgatcttggattctgggatcaggcttacatgatcatttcgtttcctcccattcttttgatttcagtgtcaggaggatatgactatgttaggtcattttggcgtgttctaatgttgttattatgcagaatagaactctgcaacttgtcgttcagcattttcttgtcccaaacatatttcacttacctgtagcatctagacaatgttctaatcttttgatgtttttatctcagaaacaaggagaaaagttaaatacctaccgttgtatggtttaccattgtactctttctgtagcttcttgatcactaaatatttacatttacagtttctgaacctgtgttatgcttgctgcaattcaacgcagactgatttaatagcagttagactctatcatacatctttcaaaaaaaatttctttctggaagttttctcaatgaactacttacatatctgtggttttttgacttggtacagggcagtgatactctgctgcttagttgggtgcagtgtgcactacaagtctacaacaa

SEQ ID NO: 56994 - DNA, 1501 bp, Oryza sativa
gtgaggctcttaagattgccgatctcttgtggtataggtccggaaattttattatttcttagccacaaccgttggagactactagatagattgccaacagaacttggcaggtttccttgaagattgttcccatccaacatcagcttagtcaatcttgtgcaatttgaaagtgacgagataaagccccagtcgcctgcttctagcatgttgtatgccacatcaaggtcctccaagtttgtcagtgatccaaaggatggcatgattccagttaacttgttttcagctaggtaaagcatttgtagatgggttgaattgagaagagaggttggaattgagcccttaaacttgtttgctaatagaatcaagccttcaatgtttgggagtgtatagccgatctctaaaggtaatcttccggtgagtgagttatttgccacagtaagaaatgtcagggatgacatattgaagaggggtggtggaattgtcccagagaaattgttcaaagtcaacatcaatgtctgtagcgttggaatatgtcctaagctctctggtatgctcccatctaaacaattctgtgaaaggcgaagataaagtagggaggaaaggttccccagagaggaaggtattgttcctgtgagacagttttctcctaaatcaagatattgaacttgtggagagacggttttaacaggtggtatagaaccggaaaaattgttctggttgaggtaaatgccgttaagtgacaacgtgttgagtagagcctttgggagttctccactgagactattgctattgagaatgagttgttggagagatgaactattcaacatgggctttgggatccctccggtaagagcattcttcccaagattgacatatgtgagtgtaaggctactgcccaaagagggtggtatgtcacctgaaagtctgttgtttgccaggaaaagtacactcagtttaggaaggtccccaaaagcagaggggatgctcccttggagcttgttgttgccaaggagaatttgttgaagatgcacacattgacttagactaggtggaatctcaccttgcagggaattgttctgcagatctaggatctgaagttgtgaacatgaagagagttctgatggtatgttaccttccagagagttcatgctgaggtcgaggttctggagttcgttcaggaagccaagctcagacggtatgccgccatggaagctattgtttgatagttgcagccttgtaagagaggtgatgttggcaatacaaggtgatattgagcctatgatgccttcggatgggagatcaatggcgataacacggcgaggagctctcctgctgcatgtgactccatgccagttgcagggtaacaaggatgcattgttccatgaggctagaactccagttggacctgagagctgcgacttgaagcaaaggagagcgtctcgatcagtctcagtttcatcactgatggctaatggctggaagaaaaggaaatgaaatataa

SEQ ID NO: 56995 - DNA, 1501 bp, Oryza sativa; identical to SEQ ID NO: 49619

SEQ ID NO: 56996 - DNA, 1501 bp, Oryza sativa; identical to SEQ ID NO: 49260

SEQ ID NO: 56997 - DNA, 588 bp, Oryza sativa
acataggaagtcagacaatcctgccagtaggaacatgtattgcactgatgtgatctacaggactcgtagtatacaatgcattttgattcttgatgttacaatccttctgttcccttgtcacgcacctttgaaccagtacttattatagtattatgtttttcacaactactaaaaatatatttttcatgacagatgtcacagatctactaatgtcattttgacatgagaagtcttaatgtattaattttttatattctccaccaaaagtttatgaggtttgatagagcacattctaaagcaccatctatttgagaatgaggtactacctgaacaataagcatgacttctgatatttggttttctgcattctgtgcaacagcttgagcttgacatcttccctcccgaacctatacagcagccatagtctgagaaattattatcccagaactaaaatagttcaaataaagtgtataatataccaacaggaaatgaacatataagcacccactgaaagagttgaaaagctttgagagatcatactgtgaattgacgccaaaatccacaattatcaactctgttccacacagg

SEQ ID NO: 56998 - DNA, 1501 bp, Oryza sativa
tagatgcttttgcttctcccgttgtaaaaagggcgaggtgtctctcccctcatctcgatgtttcgttgtgtacattacctttgtattaacttatcagtgtcgcaactgaactactgaaaaagcccattgccctgtacatatctgcagaaccagaatcaaatagagaagttttgaagtgagataaatcaagggatagtgttcctcatgcagctgtttgcttaatttgtttgcaatgagttggtctaatgcttttgattgagccaagccattcttctcccttctagaggtcgtcaccgtttcttttaccaggttgccttctgccttttttgtagttctgtcggctgtcgctacctctggaagtaccacgaagtctggattagttatcatgaaaacagaagcaatagaagggatgtagaaaacctttaagtttacttctaaaattcaaatcagttttggattataatttgcagcagagccagacaggttttaataattacaattgatatcagaaccttactactgtaatcaattaaggaaagactatatttggtctcttataattatgaccttgatccgatttccgccccttaactatgacatggttcactattggtcaccttttacatttcgtttctgaacccaaaccaaggtgattttcgactatgtgatgtccctacgtggagtacacatggacaaaaatggtgatggcatcaatatatgattaataaataataaacaaaagcacaaagaaattattacagcctagtatacctaccttgtctcatttttcctcttctctcacgcaccctatgattaattttaaattgctaactaaaatgcaaaaacaccatcccggcttgggatcagaataaaatataaatatgaaatatgaaatatgaagcagttttaaaagatgaaaaactaataataataagctaataaccgatggtttaaagttgagatactaaggattcattagaaacgcataaagaaaaaaaaagtaggattcaagtgcgttttactataataaattctatgattagaaaaataccaggaaactctagaaacaatcgtctggattaatcacataaaaattcagaaatcagaaaagagaggcacaacgaaattcgtcaaaacaggttaaatcccatgttaaaattgttttaaattcccatatcttgagaaaatcctaaagaatttcaaaagaatttggcgaaaagccattcctcggctggctaatttcacaatgaaaaagaaggattagcactggtgcgaccgtgcgatagtctggccccacctgacaggccacgtctatccatcctctcgctccacgcgtcagtgggccccacacccccacgccagcgaggcaaaagcaacacctccctggctccctccttcccctctctccatctctctctctctggaacactgaccccgcacacctccacccccattccgtaccttggaagctgaaaggcgcaaaaagcttccagaagcgtcc

SEQ ID NO: 56999 - DNA, 1501 bp, Oryza sativa
aatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatcttcgccacttctcagtctggtgctccgcaatgaatcatgctatacaaaaagtaaagccgttgcccacgcttgcttgtggctggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttcggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattat

SEQ ID NO: 57000 - DNA, 375 bp, Oryza sativa
tatcgatgtattaaaattgacggcacaaagcaaagagaaagaagacggtaaaactagtgctttaatttagaattgatcgatgtgtagggcgattaaatttgctagtttattttctagtttcgccgtactattaagaggggtaatgacctagcaaagagatgattaaattgctacattaggtcattgcattttcacttgtgctcactttttcatcacacacacaaaaactcacctttgctttcactgagctcggcctgaccaggggcggtcagaccggccacatagtggcggtctgaccggcatgccctggccggtctgaccggcctcacaacggcggtctgaccggcccgtaaggccggtctgaccggcggcaca

SEQ ID NO: 57001 - DNA, 1501 bp, Oryza sativa
atccctcctctttttttccctatgttttcttgttaccatttaccatgcatgtacttctcaagctacctacctagccttttgacaagtaaaaaaaaaatgaaaaaggtaatctggtatatctcttcacatactaatccgtattggtgatggaggaattcacaaattataaaggtaatctggtccttaagcattattgacggcacgattccgttggctacctcctcgactgtgtggtactaaatgctgacataagtagtcttcaaaattgaaaaggagtagtgattcataattcactcatattcagtaaaaaaaagtaataattcattcatatttttaacaccatgtatcacccaagtagcaactccttccattcccgaatattttaaaaaatgttagattctcttatgatggaaaattgtgtgattatatttttcacataaggtaatttgataatataatatattttgaattgttttataaattaattaggggaaaaagattagtcaaagtttgattgtgaatagtgtttggtgacaagtttttgggaacggagggagtatcaaggctagattgcattcaacaaacgtctacgagtccaactaagctgtcactattagttgctttgctctctgcagaagttaggttcagtacttgtaatggctggtctgcatacattgcaagagtttttacagtcgaataatactattcttcctacattaaaaaaagaagaagaagaaaaggtgggacgttccaagcagaaagactgagctatggaagtcaagtgcagattgatggtgatactttgccctttttggatctcaaaagttggatgatagaaatgcataaattaatatcagtactgaggaacatttcacaaattttctttttataacgaaaaaccgaaacctgatttagtagttcgacctctaaaaaggtaaatacaagatgggattgctcatctcactagagaaaatacactttaggcagtttagctttaccgtgaagatgcaaatttgtagcaaaattttagggctattttgtaacgcacgattaaaaaaaaggagaaatagaaaaaacacacatgattgcaaaacaggttgtttgattaggcagtaggagataaaagaaatatagtcaaaggaaattttcaaaaaagttggagctctttttaatttttctaaatctctataatattgtccatttcgtaggatttttttttttaaaaaagattgatttcaaaggccttcataggaatttcttcaatttcttttgtacaatattgaaatcctctaagtatcttatgtttcctctacaaatcaaagtaggacttactgggaatgcactctcgtatctagctaagcaatggaagagatcgatggaacaacttaccgctgcgcacatgaggatcccagcaagaacagaagccggccacacgatttgctcctcgggcccaaacctcacatccatgtccaccgctgccaaatcactttgcccttcgatc

SEQ ID NO: 57002 - DNA, 181 bp, Oryza sativa
tcaacgcggcgaccgacggggagaaggctggtagccggcgagagaggagttacgcgacaataggcgacacaagccttgttctcatggctcctcgagcggccggcgagagaggagctgggcgatagtgagtgacgaagagccgggtctgatggctcctccgtgactccgcctctctccaagt

SEQ ID NO: 57003 - DNA, 1501 bp, Oryza sativa
gaagggcaaagtgatttggcagcggtggacatggatgtgaggtttgggcccgaggagcaaatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatcatgtgtgttttttctatttctccttttttttaatcgtgcgttacaaaatagccctaaaattttgctacaaatttgcatcttcacggtaaagctaaactgcctaaagtgtattttctctagtgagatgagcaatcccatcttgtatttacctttttagaggtcgaactactaaatcaggtttcggtttttcgttataaaaagaaaatttgtgaaatgttcctcagtactgatattaatttatgcatttctatcatccaacttttgagatccaaaaagggcaaagtatcaccatcaatctgcacttgacttccatagctcagtctttctgcttggaacgtcccaccttttcttcttcttctttttttaatgtaggaagaatagtattattcgactgtaaaaactcttgcaatgtatgcagaccagccattacaagtactgaacctaacttctgcagagagcaaagcaactaatagtgacagcttagttggactcgtagacgtttgttgaatgcaatctagccttgatactccctccgttcccaaaaacttgtcaccaaacactattcacaatcaaactttgactaatctttttcccctaattaatttataaaacaattcaaaatatattatattatcaaattaccttatgtgaaaaatataatcacacaattttccatcataagagaatctaacattttttaaaatattcgggaatggaaggagttgctacttgggtgatacatggtgttaaaaatatgaatgaattattacttttttttactgaatatgagtgaattatgaatcactactccttttcaattttgaagactacttatgtcagcatttagtaccacacagtcgaggaggtagccaacggaatcgtgccgtcaataatgcttaaggaccagattacctttataatttgtgaattcctccatcaccaatacggattagtatgtgaagagatataccagattacctttttcattttttttttacttgtcaaaaggctaggtaggtagcttgagaagtacatgcatggtaaatggtaacaagaaaacatagggaaaaaaagaggagggatcaat

SEQ ID NO: 57004 - DNA, 915 bp, Oryza sativa
aatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaaga

SEQ ID NO: 57005 - DNA, 418 bp, Oryza sativa
  unsure (1)..(418): unsure at all n locations
cacctaagtgaatcacgcccccccctgatcctnttgtcccctctaatgaataatgtatctcattgagttcacctatattgccgtgaaaaccaccctatatatattgacccattccgaaaggccaccctcttcatatcttctttccccctagccccccacaacccaaaatggaagcgcccttncttgagcgtctcaactggccgaagcatccctttgctggttggtttccaccatggtgtgaccgtcctttgtgcgattgtggggatggatgcatactcaagtcttccctcatgatacaaactgggggcaggagattcttccaatgcgcgaactttgatcaggtatgcttcatctattcgaagttcaaatggataaaaaaactaacttcttcgtacacaattgtaacatcttacgcaga

SEQ ID NO: 57006 - DNA, 199 bp, Oryza sativa
  unsure (1)..(199): unsure at all n locations
ctgccgtccnnnnnaganacnnccagtctncncnnagantngggaattggtaccccattaaaagttttacaaaaataatttttcattttgaaaattgacagaagtggtcgcctaccgccctctaggagggggatttttaaaaatcgccatcccagagggcggcgaaagtgatgtggcagacggccgttcgctctcgggc

SEQ ID NO: 57007 - DNA, 1501 bp, Oryza sativa
tacccggctgtacagatctaatctccaaaccaggagctaagcaaattattaccaggtataacatctataattattgtgagaggtgtgagactaatcacaaaaaacattgctcaacccgcccataaccgcaggcacggctattcgaatagttttactctggccagaggtgtaccactgtacccacaagacacagccccacatcatgtcaccatgtgcctcattaccaccatggtacctcggaaaggggctgtgacattaccccttgcataacacaatccaccgcagcgcaccattcccggatcatagtcacccccttataaacaaggcatggactccccagcgacccccgtgggcttatctccgccacttctcagtctggtgccccgcaatgaaccatgttatacaaaaggtaaagccgttgcccacgctggcttgtggttggcatggttaatgtttcacaatagtagctcgcgaaccggtccttaattgtcatgagcacgactctcaaaaccatgtgctcacaacccacctttaccatattttagttggcaagtaattatttaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccagggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaaaaaagactaataaaaaccaaataaacaatacataaaaagtaaacaaacatgtagatcataattttagatgaattatgagacttgaacggcctcattctgacttcaaatgaatttattatgaattttacaagattaaatataattaaagcccatttaaaaagaattaaataaatttaattcaatttatggacaattttaatatgtagatctttattttatacaacttttgcaacttgaaccacattaaactgagttacaatgaattagttatgaatttttaaagattaaatcggattaaaacacttatatgaattttaattgaattatgacgcaataatgaattatttttgaaaaggaaaaggaggattattgcgtcagcggctagggtttgcggtggaccgggcgcacggaggcagttcacgggaacgaacggccgagatcaaccctatccaaaacggacggccgagatccaacggtccacgaccggctcacgggagagggcgacga

SEQ ID NO: 57008 - DNA, 1501 bp, Oryza sativa
caagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccctgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaaataattacttgccaactaaaatatggtaaaggtgggttgtgagcacatggttttgagagtcgtgctcatgacaattaaggaccggttcgcgagctactattgtgaaacattaaccatgccaaccacaagccagcgtgggcaacggctttaccttttgtataacatggttcattgcggggcaccagactgagaagtggcggagataagcccacgggggtcgctggggagtccatgccttgtttataagggggtgactatgatccgggaatggtgcgctgcggtggattgtgttatgcaaggggtaatgtcacagcccctttccgaggtaccatggtggtaatgaggcacatggtgacatgatgtggggctgtgtcttgtgggtacagtggtacacctctggccagagtaaaactattcgaatagccgtgcctgcggttatgggcgggttgagcaatgttttttgtgattagtctcacacctctcacaataattatagatgttatacctggtaataatttgcttagctcctggtttggagattagatctgtacagccgggtatggttgttcaggatggttgggcctgtacagcatgggtgtgctgttcagtgttgattaaaatttctgattaattactctactgttttagtactcttaactccttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggcgaagacgtttggcttataccccagttgagctgcctgtgggagtggagccggagcttcgctagattttattttccgctgcagttttcttcatggtgaggactaagtgcctcttaagtaagtatatatcgttttagttaatttgatgaatctgtatattaaattgtcagtttgtgtacctcggctgattcctggacgaggattttatgcacaaataagttcggaaattactagtgaatttccgggcgtgacaaccgggcggggagccgagatggcggtggcggggccataccgcggcgacgcgccgtctccggcgcgagggaggcggggcaaagcgcggcgaggaaggtgggg

SEQ ID NO: 57009 - DNA, 1501 bp, Oryza sativa
gtaatatttcgatgtgtaatgcactagtaaacttgttgatagttgtaggtggattaaatatttttttggagtagtagctttaggacaatttaagttatgcattggttataatatgtcggtttggactacgtttaggaatgaagatttaattttcgttgcaaagttacatttgatgttttggtgtagatggatagacttattcgtgtttactacggtgatagagtggtggaaccttatgttggtgcacatgttgagtttgaggatatgtcattgaagaccattttgtttcccacctacccaactctagatgaactaaggtcacgagtgaaagaagttcttggatggaccgaggataatgtggagattcgtttttatgggagatacgatattggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgtcgtggagggggtgcaagtaagactgagttggtacgagaagacttggagggggaaggagagaagaagagacctttgcttggaaataatttatgggaggcaggaccatcaaagagacattgcggtactgatgatgtggatgcagcgagggagatgaaaagggagttagtaccagaggggcttgatctaagtgaacatttgtcggcgagtgttcattggtcgtcgtatggagtcaaccctgaatacccgacagaagtagcaggccaatatgtgaatccagatgattactttgatgtcgaattaagtggtggtcacgattctgtctcagtagaagtcaatagagatgatgttgacgaggaggcaagtgttgagcaatatgatgttgaatttgctgaagactctgatgatgaccgtccatttcctccacttactaataatgccaagttagcattagaggaatgttgtgcgtttgagaaggtgtttgggaggaagccggacattcctgagtttagggacctaacacatgcccatggtgcactactagatggcggcatcaacctagatcagttgtcagaaccatttcaggtggatggtctcagaaagggtttagagttcccatccatggtcgcaatgaagctatggctccaggagtacgccatcgtgcaccatcgtccataccgtgttgtcaattctgccgcaaataggaggtacactgttaaatgtgaaaacccacggtgcaaatagaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctg

SEQ ID NO: 57010 - DNA, 1501 bp, Oryza sativa
aatccaaatttagattattcagctgaacaagtttcccaatgtcatctgggatttgaccagagagtctgtttcgagcaaaggacagtttgcctaatttgcgcaaatttccgattgttagaggtattttttctgacaattgattgtaatccatgtacaattcagtgaggctcttaagattgcctatctcttgtggtataggtccggaaattttattatttgttagccacaatctttggagatcactagacagattgcctacagaacttggcagatttccttgaagattgttcccatccaacatcagcttagtcaatcttgtgcaatttgaaagtgacgagataaagccccagtcgcctgcttctagcatgttgtatgccacgtcaaggtcctccaagtttgtcagtgatccaaaggatggcatgatcccagttaacttgttgtcagctaggtatagcatttgtagatgggttaaattgagaagggaagttgggattgagcccttaaacttatttgctgaaagaattaagccttcaatgtttgggagtgtatagccgatgtctagaggtaatcttccggtgagtgagttatttgccgccaccagagatgtcagggatgacatattgaagagagatggtggaactgctccagaaaagttgtttaaattcaagttcaattcttctagtgttggaatatgtcctaagctctctggtatgctcccatctaaacaattctgtgaaagacgaagataaagtagggaggaaaggttcccaacagaggaaggtattgttcctgtgagacagttttctcctaaatcaagatattgaacttgtggagacacggttttaacaggtggtatagaaccggaaaaattgttctggttgaggtaaatgctgataagtgacaacgtgttgagtagagcctttgggagttctccactgagactattgctattgagaatgagttgttgcaaagatgaactatttaacatgggctttggtacccctccggtgagagcattgttcccaagattgacattgtcggtgatatgggaccgggagtatcgagaccagaggcttgaggcagacataatcgcccacgtggcctggcaccctcggggacgtcgggcccgagggtgaggtgtccgccctcctcctgatttccccgaggggggtcgggtgactcctgtcccggccccgagggccgaggcgccccgaccccttgtgggtttttgcgtcacatatatgggttaggtgaacacggcagggctcatctaaccgcatttattgcggtctggtcaagcgtgtcacgctgcatgcagcgcagtgcagcgcgttcctttatccggtctgtgaccagtcacagaccggtcagatcacgggttaggtggcgactggcggtctgacgcacgcctcgccccatcccgtcaagacgagagcctctaggcactcgtctctagccggagctagcgtgttgcctcttagagatggcacgttacccccgg

SEQ ID NO: 57011 - DNA, 1501 bp, Oryza sativa
ccaaccattgctactccactgcttgtctggctcgccaccatttctatttattgttcttgtgaccttaaaaatcaaacatttcctctctcttgtttcgtcttatagtttctggagattccgtcaatcgacactgccctactactttacaatcagcttgtcgtctctcctctttattatcattagaataaattgaacctgattctcgttagggtttacgtttttatagtttttataagttgcgtcaaccaccgccgcccatggtccatatcttcattttcattggaatttaaaaaatcgaacctaatcatcattggagttcgtttttaaagtttttagaagtcacctcaacttatgccacactattcctttacagcccacctgtcacccctactctttattatcattagaatttttaaaatcaaacattattatcgttgtagttctgttttcataggtttgtatttgttgccggccgattgagctcgtttcctggcgaggttgagttgtgaccatgttgttagctttactttcttcacctaacgtgtttacttgattgcctctgtttgaacttctcagatagtcatgtatgcatatataaaatttacatcaccatgcatgacccctagtaaaatattcgataaatctaaataactctagattcgtccccaaaaaataattgttgaattcattacttttggagactaaggcctcctagatggctaggtgtcaccggtgagcacccaaggttgtggtgtaccacaaaaagattgtgaaggtttcgattccacctttgcaatggaagaaatcaaaagtgaagtctaggagtgtaaaatttgaaagagacctagcctttatggccctcaacaaaaacgtaggaacagtagatccgaacatcaggaaataaatcacatgtcttctcttttggtttgccctttcttgcctttactaatattatgcttaagcttatttttgcacggtctatttgtattcttatttgatctagttggtagccatatatcttatttagatatcttgtttgtcaccttttgtttcatatacatattgtctatttgagctacaatttcatagattatgttttatccatcgaacattttggttgagaccagaacttctgatcccataccgaaagttctgatttgaaccgaaatttttgtttattctaatatgctatgaagttataatatttttaggaacacctatgtaacgccccgattttcgttcgggtttaaaaatcaattaataatgcattttctagaaattaaataaaagttaaatcaacttaatcaagtgaattattgagggaattaaaaatcattggccaagaatattttgtaatattctttgtgccctaaaatactctccggatttttccgcaaattttcggagctcgagaaatagttttaatagcacaaagatcattgtatcaattaaaataaaaagaaaacaattaaaatcctccttcctctctttgggccccttt

SEQ ID NO: 57012 - DNA, 1501 bp, Oryza sativa
aacgtgaaccagcaacaaaattatttttgatggtgattataaataaactggcagtgacgaaaggagttggactgatggctctttactagcgaatgcaatttgcatttgcaaaccgcattgtattagttgcacacttgcacttccagacaaattaaatcacattaggaagcggtcaatcactgcctccagacccagatcgatcacacaatctttgaagttgtgttttatttattcattgctcagaaaggatgaagccgtgtgtccatatttggtttactagcagcctagcaggactgcacgaggtcaagttgtttgctcttggcttggtcaaaataacccagtggatagacttctcactctgtattgaaccgtgaagcttgtaaaagaaagagacaggttcagaataatgaaatcagtacgtagtttcattgtgataatgaccagaaaaaggctattttctatatggccagcgtggatggacgactcaattttgcgttgtctcttttcagttacacggaagacaacacatctgtaatacacatcattacacatggactgatggacacaacatttacttagctgcgagggcacctcttaacatacacacacacacacaaaaacatttattaagaagaaattgtaaatgtgttgggattaaatacaagacctcgggttaaaatcatacacctcttgctactattctatcaagtcacacgctaaataaatgtgacttctagcaaatcactaacatcactaatattggtggctgcaggacttaaacattaatgaccacattacatgactgaagcttttgcatcaattccaacaaaatgtccaaaacttatattgttcaaccaaaatcagtttagtttgcaatatgtatttttttactatttattaattgcattagtagaaaatttatttattattacattatcaatactagtgttagaagacatacatgaacatacaattggaaataatataatttgatcctaggtagtagttgctaactacttcctaaaagaaaaaataataataatttgcggactgcatagtctgacttctccattgttcatggtagcaactggcaactattcaagttgcaaagagaacatatctagtcagaacacccccttagtccccaactacgtaaataactcaattgcaaggcttacttggcaactattgccacttcatattatacaagcttcaacgactacgagccccaagtaacttgtttttgaaagaaaacctccaagtaatttaagcagtacagaaataaataataaatggtaggtaaaatagtccatgggttgaatggaagccaacagacctgaggtgaactacaaaagcgtgtattcatggatcatccaagtccccacagtgtcatggattactagaaacctgatgcaatacagagtatttatgcatcacagtgcagctattgcaaagcaagtttttatctccatagaaacttagccacagagaagcaatggcc

SEQ ID NO: 57013 - DNA, 595 bp, Oryza sativa
ctgttatgctgtcctcagttttctgcatatgctccaatatatagaagttttacaaaaatcatgtatctgaacatttagtttatcacatccacatgtatcttgaatagcatgggattacatccactacgcatgttttccaccactaccattagtacactatgtatatttcttgaactaattaccatctattaatagtgatgtccaagatagtagatagcagagttatgcacattgtagcaccagagcggtatgtggccttgaaagcagccttgagatttgagaatggtttaacaattcaaaaaagataaacacctcttagagtggatcttctcttccatttgtactctggagcaatgcatcttagagtggagcttctgtcaagttcatccatttggactttggagcaatgcccaaaagtctgtgtggggcagttccctttaacctgaggcctattgcttgtttagaattttacagttttatagaagtgattaaattatattccacaaaataaaaagaaaaaaataaagaggaaacgactgcactggagtacactaagagctgtgtgcatgatgtactgtaacaaaaataattattt

SEQ ID NO: 57014 - DNA, 485 bp, Oryza sativa
agactggctaactctaaaaccatgggtcaccgtctgtctagcgtctaggtgaacactagatgtaattatcgattataattggtagttttttcactatatttataatcaaaatagtttactaatatcttatatccaaatctattcgattttatatggattaaaaataacagtcaaaagtcatgtgcctcggtccaaggtttatatgagtaacattaccgatgaaaactagatgattttttgcaaaaaaaaaaagagaaattcctgggtcgtcttggaaaaaaaaccactcaatttcttagtcaatttcaaaagaatccaagttggattttaaacttccaacaaaatttagttggatttcttcgatagtcaacagtttttcatgaaatctagaaaaacaacccgccttcattccatggttagaaatggttcggttttgtgaacctgcctcagttaaaagtcataaccgatactaacttttctatagg

SEQ ID NO: 57015 - DNA, 355 bp, Oryza sativa
tttactaagcgaaacatgttgtcacttcgtcagtgtttttgcgcctaggtcaaaacggtcaaaaaaactatcaaacttcgccacaccttgtaatgtatccgacatggacgtataataaaagcattaaaagcagatcattacaaactttggtggtagtctggtagataagccgttgagctaacaaattgtccaaacaagcacagtacgtatagaacaacgagtactgtattttgaagagctattcacgtctctgcatgacagcgatcgctaatcacactcagcccacagatttgtatagaaaaatgccaaatgaatggcatgaattctccgtggttgttcggttttctttcccaga

SEQ ID NO: 57016 - DNA, 743 bp, Oryza sativa
aaagataataatgcctggcactaccaattttttggtagggtattaaaccaaacaaacctatagattttttttctaaaacatcatatattattgattatagaaagcaccatacactaaatcggtggtgctacctcataatcctcgtagtatcttctactcgaaatccttctctatagaacagaaatgtcattttgagttcttttaacgaagatatcctatatatatcatatatatatatatatatatatatatatatatatatatatatatatatatatatatatatatataacttacatcaaggaaaataaaattctcaaaataatattaagaaaaacaagaaaagaaaatactaaattagcaggctgaagttgaacaagacagtcatggtcatggactcgtggctgcagcctgcagcgttagattgagaggtaaacgtccagttagggtggtggggcccacaaagcagccactactatttcggcgaattctccacacgttgcgctcgcgacttgcgcccaggggccacatagcgttgcagttgcagttgcagaggcaggcatcttcctctttactccgcggagggggatcccatctccggcgaactcatggcccccacctcgccggaggaactcaaatgcgctgccaacggcgggtgcgccgcggcctcgccggggggcaccccgcgcgccggccactacctccccgccgtgccggcggcggtggagggcgagctccggtgg

SEQ ID NO: 57017 - DNA, 217 bp, Oryza sativa
aaagataataatgcctggcactaccaattttttggtagggtattaaaccaaacaaacctatagattttttttctaaaacatcatatattattgattatagaaagcaccatacactaaatcggtggtgctacctcataatcctcgtagtatcttctactcgaaatccttctctatagaacagaaatgtcattttgagttcttttaacgaagatatcct

SEQ ID NO: 57018 - DNA, 1501 bp, Oryza sativa
ccgtcgtcgtcttcgtggaagcccgctacaggaaaaacatggaggttttcttccctggtgaggaaatggaagcttcccttgtggtgtatgacatcctccagaactgacgtggtgacgaactcaacagcagtcgccttctccacaacttgatgctccatgcgccagaacacatgaacgcgtggatcgtacatcacgcgtggatcgtacatgaacgcgtggatcgtacatccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggtgcgtgcgtcggccgggagcggggggcggaaggcgtgggtggcgcaaccggcgagggcgcacgcgaaggaaggcccgtcggcgcgcgggacgaggatcgatgggagcggcctcgtccccggccgcggctgctcaggcttgacggcgacgcgccagttgcggcagactcgggccatgcggcgccggtcgacgaggcacgggagacgcttgaggatgaatccgagcacgtcggcgtcgaggtcgcgccatggcgagtccattggagaggcggaggcgcggcttgccggtggcgaggcgaggaggaggaatggaaccgatggattcctctgcttctggaagaaggaggagatgtgcttggtttggaagggggatgggggactgggcctcatttatagggccagctttcttgggccccaaatcttgaggcggataaatgggctaaaatttatgaaggctttactttttctttttcataagtgaccttccgggaatttaaaattcaaactgggagttcgtttgtgatgccagctctgccatgcatatttttgttttgaggtcggatgggtgccatgtctgtatattttcggcaaaagcacggcttggcgagcgtctaatctagtgtttttgttgtaccatcagactgatgcacaagttcagaaaaagtgaacaaggaattcagagataagcatcctgtgtatgtatcaacatttcctcatccccttctctctgtaaaggacgagctgtgaactgagcatccttcagttcagcactaatgaaaagattaaccatatcgcctacagaaaacatgtgtgcctatgttactaaagatgatgacctcattggaccaataactttttctatcttttttttctctttttttttcctgtaggataataaccatctgtccatctgaactgttaacctgcttgaatgccttttctcaaaaaaaaaaaaaagggttaaccttccctgctcccatttgtttctcctgtctgctagacacgattctgcaccatatgtacatccgaactttacgttctcaaaaaaaaaaaacatttaggcccaagaagaaacgctcagcaaagagcagcgatccaaacttcaggcccaagaaaacc

SEQ ID NO: 57019 - DNA, 532 bp, Oryza sativa
tccgttggtcgtgtagacgctgcagcttcggaagatccgctcttcgtggaagttgaagccggtgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttacgaccttattattgttattgttattattaccttgttcaccctagaaccaacaaaaccccaactagtggacactctactcatggtaccactagtatgattttaggtagatgcttcgctatttaattaggtaacattaggtggttttacaactctagaccttgggaatattcatatcacctggacactgtggaattgttggagtattgtggaattggattcacaccgccccctctattcaaaatccccaaaagtggttttaggctgggctcggggtgcatggttttgatagtagcacctcggccatataaggaccggt

SEQ ID NO: 57020 - DNA, 291 bp, Oryza sativa
ctgcaatccataaaccacagtaggctggcacgtgggccatccacctatttattttctcggtttttattttctaatggaaatcatgctgtgtcattgacaagtggggccgacccttttgattaggggtaaaccgctccctttaatcaccgatgggtcccgcttgtcattgacagtaaacataatattgattttaattatattttctaatcatccggacccacgcgtcatagaatcggctaatcatcattagggagaggattactgtgcgctaactactatgtgggtcccaca

SEQ ID NO: 57021 - DNA, 817 bp, Oryza sativa
  unsure (1)..(817): unsure at all n locations
cgagtgataagaccctgagacgtgatcacccgnnnnnnnnnnnnnnnnnnnnnnnnnnnnnnnnnnnnnnnnnccaaaattacaattagccccttgccgccctcttgttgggcggcaagggcctaatcgcaattttggccgacggcggcagacggcgcggtcgacccaccgtctgctacgtcagcttgccggccaccatttgggcggcaggggctatttctgcaatttttttggtcgatagattatttctgtaaatattaaaaaaaaatctaaaaacgaaaaaattccttctggaagcgggtggagatgacggcttggtttggaagaagagggtgggtgggccagcatgcgatcagactgggcctcatttatagggctagctttcttgggccccaagcccccaagtgcatcttccccgtgaggaagattaatgggctcaaatgtagaaagacattttaccttcggaaaaaaatccactttaacttccttaactgttcatcaaatctaattcgtgacccttaactaaaatatcgggtaagaccgaactattgaaaccagtgtaatttgaattctctagcaattttgaagggtggttttgttgtcgtgggggtgttgatctggtcttcatgccacgtgacgcttatatagcattaaaattttaaaaaaatatatgtgagacctactgacatgtggggcccacatatcatcctttattcctccccctctctctctctctcccttctctcacttttctcttccccaccggatcggcggcggcggcgtgcaggcaatcccctccagctccgcgccatctcca

SEQ ID NO: 57022 - DNA, 358 bp, Oryza sativa
gtagggtgagttgtgctctctctctctctctctgcaattcagaccacactgtttgcttgatctgctggacatgttgaaccgctttgcctttaatggcacccgtttcaggtagatacgttcaagaaacttatgcaagttgcaacaaaatctcttgagatgggcactaacttgatgcttggggttgaagcatgctctacaatacttctggcagtggaccataatattgatgataacatgaagcatgattgcttgtgtactcgggcaggattgtatctaaaggtttgcctgcttttgtttatctgttgttgaaaatctgatctgtgtaaaacgtacggatcattaaatattgatctacaga

SEQ ID NO: 57023 - DNA, 233 bp, Oryza sativa
  unsure (1)..(233): unsure at all n locations
cgagtgataagaccctgagacgtgatcacccgnnnnnnnnnnnnnnnnnnnnnnnnnnnnnnnnnnnnnnnnnccaaaattacaattagccccttgccgccctcttgttgggcggcaagggcctaatcgcaattttggccgacggcggcagacggcgcggtcgacccaccgtctgctacgtcagcttgccggccaccatttgggcggcaggggctatttctgcaatttttttg

SEQ ID NO: 57024 - DNA, 884 bp, Oryza sativa
ggacagtgataacggcctacgatagggaaggcgcaggactatgccctagggtgacgcggggtcgtcgtggcggccattatcactcaatcccgaattcaacgcgcgaggggacgggatgacgcgggcactcgtggcggcgcagctttggggcgggtttttgacggctcgaacggcggcaggcccacgcggcgtggcgcgacccggtgcggcgcacgggtcgggaaggcaggcgcgcggcacagcagcggttggagagggcgtcgtcaggcgtttggtcaggttagacacaaatcgaacacctggcgcgcaatgaacagtagcggcccgagaaaaatcacaattagggcttttcctagacctttttgtgtgaataatttttagatggtttaatctccttttttttagatagttacctatatttcaacacttccaatcttgtgatttattgcaccatatattaataattaatttttctaattccaacatatgtttctattttcccatatttaaggttttagtatttgtcttgtcatatcaatatatttgtcttctcacaatatttaacttaaataatacattttacaacagagaaacgaataacaccagcatgatgcaaaagtttttttttaagagttcaaaattttagtgattattattaaggatttttaggatgttacatccggccctcgcccgcccaccctcccgccgctaccgtaagctcccgcccgtccgccgccgccaatggcccccgtcccacgctcgcagagagaaaaagagagatagggggaggatgaagaagatagagaggatgacatgtaggcctcacatgtcagtgggtcccacaatttatttttgtgtgagaatgacaaatgggtcccacacat

SEQ ID NO: 57025 - DNA, 1501 bp, Oryza sativa
  unsure (1)..(1501): unsure at all n locations
cgtgagtgcgtcgagcaacctggaagggccagtaggtgatgatggcggcggcgacccaatcctcgtcctccggtggccaaaaaagcgtcgcggcgagcatgatcacaccagtgttagggacagggccgtctggcccccccaattcagcagccgtcttgtccgggcggacaaaaaaagggaggttgaagcgcaactgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaaggcccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacaaggcgaagggcttccgccatgaagtcgcgcgcgggcgccgccgcgtccatgggaaagncgaaggcggagccggggcggggggcaaggcgtgaaggtgncggtggcaagggttggccgncggcgaagaaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagct

SEQ ID NO: 57026 - DNA, 416 bp, Oryza sativa
cagtggatcccccatcttactagtctgatctgctgttgccattgtgaacactcaaggtcacacgcaccaaaagtgaacagtgagcaggacatgtcaagaaagctgaaacgtaccaactaggcaatttgtgcatatcttagatataatggctagactgatgatacgctgacggagcaaaattcataggattgagtacttaattaattaaattgatgatggcatgcatgacaagatagagtttaaagggactagaaagcaagtttttaccctcgagcacaatcaaggaatcaagtgcagatggactaagcatgcatgttagttttaaaataaatactaattatttgttgttgtctatatatatatatatatatatatatatatatcttaccaaatgttagttacagaccctgcatgca

SEQ ID NO: 57027 - DNA, 516 bp, Oryza sativa
aataaagttatatctacaggtggacgggattctccggataaaagttcttacctaagacttgatgggcgacggcggcctgtgatatctatgaagacgtcgtataggagatcatgttgatttccttgctcgcctccattcagggggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaat

SEQ ID NO: 57028 - DNA, 1501 bp, Oryza sativa
catcacttccctaccatttttaactatacatattttcttttgtatttttaaaatttagtaagctatcaatccaaacatatcataaactctctacaatatcttgccataacaatatttggtgatccagtctgtgtatttgtctaattacataacttggatcctctttactatatttatgaatgacgatataatagacaatacatattatatttttaaaataaaaatattaatgtgcaccatcgctagtcacatgctttaaagtaacgcttaggatatcgatataactttcgatgaatatatttaatcattactcgcatagcatagccacatatattaggcgtgttcggaaggccaggccacaatcgtggcagcagcagccacatgttagtctgatgcttgcagcactgttgccgttggctacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaaccgtaaaagagatcctaagtagaaacagtaaaacaattagaaatagaaagggtttaccacatcactcactgtaaagatgtttgtaaacaagtttcttattacgtgtatcgaaatctacaaataaacaagtttgactattgtgttgtgtgcattccatctctagaggctagacgggcatgaggtcatacccagaatccaaggaccgtagtactagaccgcagaagatccagatctgggaagaaaagcagtgggaaagcaagccgtttccgcgttgaaacagatttcctcctctcctcttctctttcctctctctcctctccgcccaacccttgacttcccattctattccatctctctctctctctctctctctctctctctctcgatcgtcttctccacttcctcctcgcatttcccactagtgaggcggaggccatagccatggatcccttccaccacc

SEQ ID NO: 57029 - DNA, 440 bp, Oryza sativa; identical to SEQ ID NO: 25115

SEQ ID NO: 57030 - DNA, 272 bp, Oryza sativa
ttcccacgccggctccatctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagg

SEQ ID NO: 57031 - DNA, 1501 bp, Oryza sativa
catgtctagtgttttgtgtagcacttttttaacgaaccggcacttttgagtagcattgaaaggaaacatattgaatgatgttgaaataagaaactatgcgaagtaaaatatagaaaagactcctaactaaatacaaagtaattatattgagaggagaaagtaattttctttatttggaagtaatcactataaatattttgtaaagagtaatttagcgtcatatagaaaataactctttaggtattcaaagtaattacacacttggaagaaaataatctttttataaaaagaatagaagtaactttttatggtgttagatgtaagtacacttctagagggaagtaaaactgataagatagaagtactttttatgggattagaaaaaactttgaagaaatagaagtagcttttaacattactagagtaactatattgctagaaaaaaaagcaagtctggagaaatagaagttactcttcacggtattagaagtaactcagtgctagaggaaagtaactctaaaaacaaaataaaagcaaatatttaccccacgttactagaaataactatattgctgtaagaaagtaacttttcatggtatctaaagtaactacactgctataagagctaagaacaagaatacaattttaaaataatttaaatatattaaatattggacttgttttatcacatattttgagcggagtacaataggtcaaacggatgttaaaaataatatatctctatctctactattataaaaattgaagatgtttttaccggtattttggtaagtcatccgtatttgaatcggttattaagttcgctctattttggaaatacatatccatgtttgagtcggattttaagtctgtttgctttagaaaatacaaaagaagtcatataaaaaatttctttaaaaaaacttgtatggtcacttgagagtaaagttggactcctaattataactcatgattttctaaaaaaatattcaagcgaattcacacagtgaatttcatcccatgtaaatcgtataacaataataggattaaaataacattcacctgttgcaatgttgcaacgcacatgcattttttctagtaatttaaaagatataagtggagaagaacagcaaattaatagttatgaacttaatatgtagcatccgcttaaatggatcctgagaattgaagcaactgaaaccaatctcaagaagcaattcatcgatcttcactgcaaatcggttttgatgcaatgcaatgcattcttttaacagaaaaaacgctaagtaatgttgagtaaacacatcgcagaaaatgcattactaactacaacacgacgatgatccactaagcatgtgtttggtttcgggactagatgggatgggatgaaaccattcatccctaattttggggttgggatgattccactcacatgtttggtttgtaggatgggacaatcccaatttttttgtttggttgaagggatgagggagaaatggga

SEQ ID NO: 57032 - DNA, 1501 bp, Oryza sativa
caacattgtagagcttgatgagatctacaacttttttattgactattttattatttgagatcatttaagggtctaaatatttattataatataccatattaatttttacaaaatctcagatctacaattcaaacgacatctgatggagatgtgttctatatcaaagttgtagagctcaacaggatctaccactttttagtttataacatttatatttgaaagcatttaaagcataaaacaaatattgcaagtttcgaaaatgtgaagtaaaataaataacatctccaatttatacaatggcaagtaagttatacatctaataaaaggtcttgagaatagaaaatgataatcatatttgcatatggatctcttagagaaacaaccatgaaaattgattttcacatacggttgtgagaccatctacaaaattgacgatataaatgttggagatgttgaactaaaataataagtgatatctcttccttgattaagaaactcaatttgaggggctttttatataccggtaaatattcgctaccgtattcgatccgtctcgtattcgctccgtatctgtattcgataatattcgatttcatttccgtatccgagttttcgattccgattccgattccgaaaaaaaatatgaaaaaaaaaatatgataaagctagtttccgtccgtttccgatccgttttcatccctacttttaacacacggtcaatacaccacatacaatataattgtgagtttacgcttttaaaatatgtgtatacacatagggaggacagataaatcactgcaccagaacgtaggtaccgagatttttactctaatgtttggagtttggaccaacacaacaaccctgtgcttctcaatatgaagtcgaatctaataaagcgctatgctacgcttcactttagcgaggataaaaaaaataggagagctgaaaaactaataaaaatactagaaaacaatataccgtttcaacagaataactgacgcttaaatactaagatatattttctataagatatcatatgatagtttctacgagatatcatgtatgatacccttggtaccaaatctaatacttacggtaccatgctgacaccatcatgatacatagataccagagtctgagacaatacctatctactaatacggtatcataggtactggatttggtacctaatatattgtgctgatataagcacaaataaactaatattttgttggaatggtatagtgctccgtaataaccctcgtatataatggtatatatgtaaaagaaaataaagaaaacatataatggcgggaaacatatctaatgtacccctcccgtttgctcctataaaatccccccacccccaggtcttaacggctaataaactctctctttcttcccttcctccaactcccaaccagtcaaccaccagaagcgagagaaagaaaaccgaaatcacgcgaaccgccgccgcgtgacgcgatggagccctcggcgg

SEQ ID NO: 57033 - DNA, 1501 bp, Oryza sativa
tattgttattactaccttgttcaccctagacaaacaaaacctcaactagtggacactctactcatggtatccctagtataattttaggtagatgcttcgcaatctaattaggtaaccttaggtggttttacaactatagactttgggaaatattcatatcacctggatactctggaattgtgggtttattgtggaattggcttcacaccgccccctctattcaaaatccccaaaatggttttaggctgggctcggggtgcatggttttgatagtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcataggccttgggttaaggcaggttcgtgtgggttcacggccttgattaataactttgtagcattctaggatcgcgtttacaaagtagctttgagcaactaaatgtctttaaatgctgtttactgcaaccctaaccctttatattataattcccttgtactcccttgcatttattctgcatttgtgggtgtgtcttgttgagtacggtggttgtacacagtcttgctcaatttttcccaagcccagaagaggagctccttgaagatgaaggcttcggtgtctagctcgtgcctgccgtcaagtgcctgtggtcgtcgccctagtcttccgctgttcttcgtttgtctctgtgtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacagggggctacacaaatataaggctcaaaatttgacaaattttatgtcaagctgaagaaatcaattaatcagccaatgagtcaactccaggagtcattatcttcatctttgcttcgga

SEQ ID NO: 57034 - DNA, 1501 bp, Oryza sativa
cggcggcataataggccagccgtgtgggtggaggcaccactcggcggcgacggaggcaggccggcggtgaagtcgtagacgcccaacagcggcggcataataggccagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggtcgtgtcctcatcatatatgccccctagagggcctcctgcccaccttatataggatggggggcaggattacaagatagaaaccttaaccaatacggtatcggtttcctaaatcaggactttaggccgttccgtcatatacaaggaaacgtaacacccaagtcatgatctgttacatattacatagatataagttatcccctataactagtcggataaccatgccgtgtgggtatggggtacccataatctccacagaataattaaaattcaatgtgaaagcctccaacaattaaaatgtgcaaagataaaagtcaaacgaggcttggaggatttttgtatatttcctaaaagcctaaaatgcttaaacaaattttagtggaattttcagagcacaaataataattgaaaagaaataaacaaagtgga

SEQ ID NO: 57035 - DNA, 445 bp, Oryza sativa
catagaaaatagacccatgatcatgaattcatgttgcatgtatccggaacaagtccaacttgaaggtatgatacttgtgtttgagctagtaagcccctgagcatatagcttgtccttctgtcgtagtcacaattgtccattgatggtagcaatcaaaagtgatgaagttgcacagccgtggagcgaagaaaccagtcggcagcagacaagtcagccaacagtgaagatgaaggcatccagcaacatcgacaaaattgagcagccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatca

SEQ ID NO: 57036 - DNA, 1501 bp, Oryza sativa; identical to SEQ ID NO: 21322

SEQ ID NO: 57037 - DNA, 1501 bp, Oryza sativa
gaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcggccggggagagaggaatcgcgcgcggagatctcggccgccattgaagacgccggcgatgattgcgggattcaaatcggacgaatccgagggagagagagagggaaaagaggggggaaacgggggaaacgggaaagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatga

SEQ ID NO: 57038 - DNA, 1501 bp, Oryza sativa
cttagtgaatcttgattcgacgtcttctaggtaaaaaaaaaataaacaaagcgtgcaagacaatagacatgtcggctagaggctacataccaaaataccacatatgacagggttcagaacgcaaaaataactggagtgaaaaaataattcgagaggcaccaacaggtccctttcatggcaaaactgtagatagtgagacatcaaggggcaaaccctttcccccgaggaataatagcgcagctgggcggatggacttcgttggacggccgtgcggacgcaggggcccacttcgacgctccctccacctaccacccacccactgacacgtggggcccacataaaaccccaggcccacctatcagtcacgggcctcgcggggaagcgaccaccaaatccgccggtggcatcgggccgtaaattcacgggaagcgcgggggttgattgggccggaagcgggccttggtcggcggtttgaccctgcatgccgcgctggccaatgggagaccggcagcgatggcgtggggcccacgtgccgtggcgggtaggtactttggcgcatgtggacgggggaggccgatggatggatcgggccctgcgagcgagccgacaaggcaacggaaatctcgtgtggttttcgcggctaaattgaagtacactctcgtgtggttgattatgttttttgattagagcgattttttggattaggatgccgtcatgctgcgtggctgcgtgcgagcgtgtgcgtgcatggggtttagcgtttcgagaggttaggatttgatcggctctgtggaacgttgtagagatcgggtgcgtgacgtggtgatggtggtggtggtggccggtcttatcctaggtaggtagctggccgagaacgcggcttgtagtctctgaattagcgccttaagatatgctcgtatgctaccgatagctacataattttattagtgtgaagtacatatgtcccaacattagaaaaattgataataaagttatatctacaggtggacgggattctccggataaaagttcttacctaagacttgatgggcgacggcggcctgtgatatctatgaagacgtcgtataggagatcatgttgatttccttgctcgcctccattcagggtggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaa

SEQ ID NO: 57039 - DNA, 235 bp, Oryza sativa
cagtttactgataaaattgataaacacatctttatggccatgttctggtgcatatcatagattttataatgcttgagactaaccctgaaatctagggcatgaatgtaaatggtgatgtccttgtaaaaaccatgaatttcctggacatgataagcatgttttatctgtatttatggtataagtttttttttttttgctgttatcaggaagtgaaccatgggttcatctgtctcaa

SEQ ID NO: 57040 - DNA, 774 bp, Oryza sativa
atcctctcactcaactgcaagtcagaggatccctttcccttgtggttggggagtattgctgctggaggcagctttttgcaagctatggctggttgactgcgtgaactgtgaagtatgtagtgtttaagtttgagtttttgccagaagaaaattctttgcaccgcaccacgcctcatgtgcgacactgcgtagagggctgactagggtggacaaaagctcgtgactcgttaactcgtgcggctcgtgacaagcttggctcgactcatttaaatttcgtaatgagccgagctggctttaaagctcgttagaaataacgagctagctcgtgagtcttaacgagccgcggagaagcccaacagacaacacaactcgaacagcaaaagcccaactcggttgaggagaggaaaaccctagcacccacacggcatctctctgactctctcactcgatcctctttcacgttgccgccaccagccgttgcacggcaccacagtgcttcacgctgccaccgccagccgtcgcgcggggaagactacgcggtggcgttcggggtctcctgccacggcgccgtcgaacccggccttctccgcggcggatggcgtcgcctccaaggacctccccaccccgccgccgcaccccaactcctccctctccgtccgcatcttcctccccaccccgccgccgcacccgcacagcctagggctccgcccgagccgcgccatcgtcgtcgccgtgggatataggcaagaggcgaggtgaggtgaggtgaggcga

SEQ ID NO: 57041 - DNA, 1501 bp, Oryza sativa
atcaggggagcggcggttacgggtcacgggattgggttgttcgactcgaggttacgggttgctactgcgggattgggttgttcgagtggaggtgtggggtctcgcttcgattcgcttctccgtccatttgatcgggggagagaaaaatttttcaaaatcggtcgaatcacgagtccctgtctccaattgcggtgttacggggtgatgatagggatcgatttttggtcgtttcctccttgggttcttcctaacactacagattcgattggtctggagtaggtttcaactttcgtcagccacaaactgtttgtccgcgagcacggcgtcattgaattggcgaaataaatcgatcaatcaatcaatcagcgttggtccctgaccagtccgtcctcgtgtccaatgaaaagcttccgatggatggatggattggttggaaaatctcattacgatagctctggagtgcttcattagtttcattatattgtccttttggatttgtggacatacactctaatgtaggttatcgtaaacatgaatgaatgccgattagcttgctcccttggtggtgttcccctcttgtgctttcgctgtaaccagcgattgccggttgccttcggttaggtagagagaacttgatctgtttgagggtattttgatttacgaagtacctacttcaatcttgtgacgtttgtttgcaatcatgtgctgaatgtctagttatgtttagggggaccttcttgttgttggattagtgcgacttaattaatcttccctttcgtgatactgtcacttttagttggaaaagactgccaggtgccagctaactgttcttgtactgccagcacgacaattctagtgctctccttctgcattcagttttatggtttttttatttcctgttttgttgtgcttttttaatacatcttgaaagctttagcctgactaagaaaatggtttcattatttgcaatgcttatattatatttgcactagcaagaactatgcctgctatatttgttgagcaaagagacattggcaccttctaaaacgaacatatttacttctattcattatatcctttggccaacctttttgtacctgctactgttgtctcctggttaggaaggtggtactgatgcacatttttttaatgtgccgcttaacaaaaggctactcattgttacctggcataagtaccataaaagtacgctctgccatggcacggagattttttacttgtaaacagtgttgcctatgttatatatgtttgatgttttaacttcgttattcattcatgttaagaatgttcatgccaccttttactttatgaagtgctgttcagtttttttcctcccccagtgacacaagaaaggattcttatcactagcttttcgcactatttctaccaggaaccttatgttaacatgttttctcagagcatgagaagtaaatatagcatcatctttgtacttgtgtattgacatgattcttttccccctaga

SEQ ID NO: 57042 - DNA, 1501 bp, Oryza sativa
cacttgattaattatgttctgaatacaaatcaaattcaattgtaaagcatattattattatcatctatataaacactctcccatatggagaggcaacacatactacagtggtggacccagaaaaattatactggccatacctattctagcgatcacttcaccatatattttttaaaagaaaacacccaattatgatggaagaattttagcagattttagtcggatttttcaaaatactattcaaatgtggtccataatttatgaaaaatctataaaattcagaataatcaattccatgacctaatctatttagctgttcttctttttcccccaatgtttctcttcttctagtcctttcatcttcccctgatttgatttcttaatgattacaagatcaagacaaaccgtgatcattgttatattctattttctgagaggattctatttttatgttctttgattgcatactatatcctagtgttttttcaaaaaaaaaatgggtatgccggtgctaacccggtacaccccttaggtccgcccctgcgtgctaaacacaactattatgatggttctgtatagattcccatcaacttttgctttatctagctgtttatatatgttggttgaaatggaatatattttttatgtattttttctgattatagtgctttcttttcatatatgtagggttcaccaattaagctatgacattttttttattttaagctagagtaattttctcatgggtgaagactattttacccccccccccccccccattcctatcaactacaccgttcaaactagtctggaattcagaccttagctgtatgaaattagacatcacgtacccccacccacaaactatcaagtgggagtgtgtgggactacatacacttaggtcaagctatgaacaatagaaccaaactttttatcatctgcttttacttatgtactccctcagttcctaaatatagttaagtaggagggtttttgaaaggattcttaaggactggtgtgcaaggtctaaaatacctcccattatagtcttgggcaatgtgaagtgcatggccactctggtttgaaggatccggctcctctgcctttaggtgctaaaggcatgagcatagtaatatgtgccttgcgcaacagtgtggaacatatatttgcagttatttactgtttatgtgctactgtactggactgtagtgattgatctcgttcgttcactgtaaatcggacgactgaaaatattctaaaggcacaacactgtgcttccctggttgaggtgatgtgaacaactaggggtagtatgggaaatttagtgtacaatgtcacattttcatatcctagttagccatacttgtaaaagtttcgaatctgaaaggtagctatatttcgagatggagggaggcactcaattagtaagatacataaaatatatttttgatggcaattcaaaaaaattaaattaattgtagtggatctcagggtggagaga

SEQ ID NO: 57043 - DNA, 325 bp, Oryza sativa
ctatgaaagtgtggtatgtcataaatatagcaatgaaccaaagacttgcttgatttagtcaaagggcttagccacaagttgtggcaagtgtttctctcctgctcttcttttcttttcttttctttttttgttcgagataaaaatctcagttagtatgtccctctacaccatgcaatacaaattaagttgaaacacattcaaatggatatacggataaaattctttattggatcttatttgagaaacgataatactccctccatttctaaaaggagggattctaggtttttaagagattaaggatgaagataaaagatcactatca

SEQ ID NO: 57044 - DNA, 224 bp, Oryza sativa
ttttaattggttaaaattatttttagggctctgaaaattccacttaaaatcctgttagtgaatttcgacctgtagaactcaagaaaaattccacatgccaattccgattattatttgcattgatttaaaaggggtttactcttactttgcaccggtattttcttaggatcatttataaattaaatttaggcttggaaggagaacttcagggtgtgacacccgcc

SEQ ID NO: 57045 - DNA, 1501 bp, Oryza sativa
gactcgggagggaggaggacgaggaggagggcggccgccgctgcgagtcgggcggacgcaggagtaccggatggggagggagacgcagctgctcgccgctgagggctcgccgccggtcagcctcttcgtgctgtgcggcgaccgcttcgaggcggcgcggctgttccgctccggcggcctgtcggtgcgcatggcccgcgtcgagggccacccggtctccatggcctcctgcgccgtcggcaaccaccactggatgctgtcccgggacgccctcgtcgcgcgcctcgacgcccgcgtcttcgtcttcgagatgcccggattcttctacgccgtcgtcggcggcggtggcgccgagaggaagtgcgccaccctcgccgagatcttctcccggttctgctcctaccacgatctctccaccacgcagcaaggtattccaattaacatgcaaattagaacgcgtgtgattaccaattaatcctactagttaattacatattgtgcgatgcgtatcaaattatcttcatgcatgcgtgcatatatactaggttgattactgtacacaacaacatgtactagatcaaaaacattagttagagcaggtacatagcaagctataagccgaatatgatacgcgatgaaaagagaagagagaagaaagcaagctatttgtatctagctgtaacatagactatgatatgcgatgaaaagagaagagagaagaaagcaagctatttgttatgtccaacatattactccctccgtattttaatgtatgacgccgttgactttttaacaaacgtttgatcttttgtcttactaaaaatttttaatcttttgtcttactaaaaaaatttatgtaattatcatttattttattgtgatttgatttatcatcaaatgttctttaagcatgacataataagcatgacataagtattttttttatttgcataaaaaaattgaatcatgttcttttaagcatgacataagtattttttatttgcataaaaaaattaaataagacgaatggttaaatattggttaaaaagttaacggcgtcatacattaaaatacggagggagagggagtatatgggtataatacctgagaccaggtattaatggtgtagtatatttttatacttaattattgtattaattgactgttagaatagcgatagatgatttagatctaacatttggctatactattagggacaattgcatccatgcccctacttttaattccaactactgttttaccctcactttttagggtttgcaattttacccccatttttttaaaacgtcctcagttttaacaccgttaggttggtcccacatttttttagaaaaacaaatagaaataaaaaaaatgatttatgaaatatcaatttaccgttctatcctcgagggaatcgataaacatccaaccagctctcctctcccaccggattggtccttgcgcggcggcggcggcggccgcgtgtgtgcgcggaggc

SEQ ID NO: 57046 - DNA, 676 bp, Oryza sativa
ttatatcattgcaatagtgaagctatgaactacagtgttcatatatggcacaggcaggtaaacagtgtcagtcccaaccttatcacaatacacacaaatatgatagtcctactactaactgtaataaaacagtatgagcaaatactctaggagtatttcaaatgtcaaacggtaaaaatttcactcaggccgagtttagatccaaactttttcttcaaactttcaatttttctatcacatcaaaacttttctacacacacaaactttcaacttttccgtcacatcgttccaatttcaaccaaacttccaattttgacgtgaactaaacacaccctcactccaaagatccaaggggacagacaaaacacaaaagtgcaacagcatcagcagcagtagaagtagaagtagaagaagaagataaccactgcaacagttgatcacctttctaccactagcagtaaaatctttgcaaaattccatccatttcttcatctaatcaagctgctgctacctccatagccatacctttcttcttcctccttttgcttttctttctctctttctttctttctttttccctccaactgcagttcaaatcgaatcaagaacggaggcaagaagaagatataatagcagcagcattgcgaagctgatgctgccatagttgccattgcca

SEQ ID NO: 57047 - DNA, 1501 bp, Oryza sativa; identical to SEQ ID NO: 21311

SEQ ID NO: 57048 - DNA, 432 bp, Oryza sativa
aatgatggaattgacagcttctctgaatgtcgtctgcttaactttcacagtttaaatgaggctgttgcttttgctttcagatacagcacagaaaattccgtctgaaaatgcagagcccagacggtatatcattctcgtttcaactgtgatctatattctgcgtacatttttcagtacttgtcgattattacttcggcataagtaattccgacctacaaacctcacctgaatatttcattagaatgcgcatcaaaacctgacagtattccattcctgttccttcaggcttctcaatccgtgccgataagaacgaattccaggttggcaataatcatatctttttccctttacgtcgatcaaaactccataattcatgagttatcatgcatgaagcagacaatttacctatgattgttctctcggacctacagt

SEQ ID NO: 57049 - DNA, 1501 bp, Oryza sativa; identical to SEQ ID NO: 57033

SEQ ID NO: 57050 - DNA, 989 bp, Oryza sativa
ggtcaataaaaatgcacacttacgtggcgaaaagcaatgatattgtatccaatcaattgcttaaaatcccaaacagtaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcaaacatattaggcctaggccaaaacatatgccttcgacaccctttaaaggatgacgcatgtaacatgctcctgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatagaaaatagacccatgatcatgaattcatgttgcatgtatccggaacaagtccaaattgaaggtatgatacttgtgtttgagctagtaagcccctgagcatatagcttgtccttctgtcgtagtcacaattgtccattgatggtagcaatcaaaagtgatgaagttgcacagccgtggagcgaagaaaccagtcggcagcagacaagtcagccaacagtgaagatgaaggcatccagcaacatcgacaaaattgagcagccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatca

SEQ ID NO: 57051 - DNA, 1501 bp, Oryza sativa
ggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcgcccggggagagaggaatcgcgcgcggagatctcggccgccattgaagacgccgccgatgattgcgggattcgaatcggacgaatccgagggagagagagagggaaaagaggggggaaacgggggacacgggagagggaatcacgggggtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatga

SEQ ID NO: 57052 - DNA, 256 bp, Oryza sativa
gagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacga

SEQ ID NO: 57053 - DNA, 1501 bp, Oryza sativa
aactactgctctgttctttcggctaggtggaatggtagttggagcacgagccagctaccgaaccaggacacatcagctaagacaccgattccacaaaatcccccgcggccgtgatccgttcaggtattcacagcttctctcacgcgtcgtcttgctgtccagcgccggcgacgggtacagactttacagtcatggcggcggcagtgctctgctttgtcaccctcctcgccttctgtttcttgggtcagttactccgaatctctctgatcgacaacacataatatggctgtgttattcctcccatttttctaacccacctctctcgttttccgcacatacgattttcaaattgataaatggtgtgatttataaaaaactttctatataaaagttgttttaaaaaatcatattaatctattttttaaaaaaatattatttaatacttaattaatcatgcaataatacgagcttcactttgcgtgctgggaaacctgaacacggcctatgtctcagtgctataactcgctttgatcctttacattgatggaacagcgccggcggcgttgatgttggggtattaccacggctcgccggagctagtcgtcatcggctcaggttgctcgaggcttgtggagacgaactcgttctttgcgcaggacatcaaggtgaccatcctcccgtagctctgcacgagctcagtcaggacgagtgttttaatgtgtgcactcgctcttgcaggcaaggacggagggagggtcgccggagaatgggttggtgctctacgggatgccggtcgctccgcctctcggcgtcccagccgcttggtcggaggctcgccgcgccgtcgtaccagccaattctcacatggtaatgctgcgttatcatctgtgtgattctgtttgaaactctgaactcatgatcatgtcagttattttcagaattgaagattagttgctacttactatactccatgttgtgtgctgcaggaatgggtgtatttccttaacagaggatcggagatagaagtagcttacagcgtcaggagtgaaactgaatcgtctcgtccaatctgcatgatcattgcgcgaggtaagaaaggttcagatatatgaacaagtgtgtttaagtgtgattttttcatatcagtaacagagtttcactgacaccattaaaattcttgcgtgttggtgcttcactgcttcataggcaaagaaagcttcttgcaatgggctgagaatccatcagcaaatgagaccacattatcttggcacttggtgcacggtaagcatgatctcattgactaagaatcagttgcagacttgcagtaccccgggagaatccgtatactaatgctatcaggatgtgtaatcacaggaaatggaacaatcaagcagactatcaatctctcttcagagtacttcattgccttgggaaactttaacaatcaggatgtaacggtaaattaccccgtgtcaagagcgacagagcttccaaaatgttt

SEQ ID NO: 57054 - DNA, 1501 bp, Oryza sativa; identical to SEQ ID NO: 21324

SEQ ID NO: 57055 - DNA, 1501 bp, Oryza sativa
gccattgcttaagtttaatgtgcacatattgaaataatgagaaatatatctgcaatgttgtttattcatcttggttttatcttttctaatgtatagtttgtatacaaactaaagggcaaaagagacattctctaacagaaatattgaatagaaatagccacatggcatattaagtgggtccaaagatgattttaaacaaaaacaaatatttagacgacatatgtggacaaaatgaaatctaaagtatcaaattgagcatttgatgaaacttgagggactaaattagctattcacccgtggggaaaataggaatacatgcacactccaatatataggaatttttcaagagatttgagtggattgaaaattttctatgtttttttctatacaacgtgtggaaaagaaaaaaatcttttatttttactatatctacatttatattaaccgaatagtatccatagaaattaatcctgagaaatctaaatactttaaaatttctataaaacaaaaaagcccttaaattgtcgaactatatattcacgaaaaaaaaaagacaatataactagcatcaggatgttaaactcacaggacacagcaattatgataattcgaatgaatttgggttcgttcaggtgtgtcaaaggtctgaagaaacggctggaaccaagtcaggaaacaacgtatatttgtttccacccagaataatgcaagatctcccaaggccactttgccattcgtctgcccaagccccaacggtggggaacataactggaaagagtgcaccccctccgttgtttgtactgttatctctcctcttattaaaaagtttgtgcaaatataaaaaatgaaaagttatgtttaaagtagtttggataataaagcaggtcacaaataaaataataataattctaaaaaattttattaagacgaatggtcaaacagagcatgtaaaaagttaaaatatcttatattatgagaccaaatgagtagctgtgtagtacattagttctggccggtcggcggtggcgacatgaaccgaattggttttggaagtactccgtatttgacgttactgtaaaattatattagctgtataagtaatttctggtttgtagatatgatgaaactggccactcatgttttagtttgtgttaattcaatctcagtctccactgattattttatttggtgaagacgagattaattgttgtacatgttttttagactaattaattaataatttgttaatgtttttcaaaataaatcggctagccgtcaatttaaatgaatagagtaggaaaaaactgtatgcaaataaaaactgtaagaacatgtacaagttaggtcccgagatgtgggctagtgattaagataacaagtacatctgtttcacaatgtaagttattatagcatttttcacattcatattgatgttaatcaatctagatagatatatatgtctagattcaatatgaatttaagaaaagttagaatgacttat

SEQ ID NO: 57056 - DNA, 1501 bp, Oryza sativa
aactgatcagatcaaatacataagctacctaaatgacttaacttattttctatgtttttgaactaatagagatgatatatcagaatgcatgttgtagtttgtgagatagctagtcttagcccaaccagctggttcatttttcaactgagctccaagagtttcaaactcggctcatatatttcctatagtagagtaaccatagagttgactttctgtgaaaaaaaaacccccacatttttgcattgtttatgcaaattatcataaattgaatcaattgctcataaacctctagtgcaatcatggattgatcaattgtaattttgctgttttggtttctctcttttctcctctcccctctttcggcccttgggcctttgtatatactcttttttcctctcttaataaaatttaccgtgagggcctctctcactgtgttttgataaaaaaaaacactttaaccttttttttgttttgaaattttatcggtttgatgagctttaagatttttttctctctttctgcatccaagtccaatttcttgactagaaagttttgattcttttagctgaaatctccaattctacttttgggggttgatgggtagctagcatttgagttgaaaaagtagagtaggctatagctttgtaaaatggtccattgaaatttcaaagcactaataatgccaatagaaaggtaaacacaatgagaagccctacataaagacatcaaacctctcactttgtaaaatcaagcattcatccttccgaatctgttttatcccattgaaatccccttaaataccattgtcgcatgctcacatcccatcttttccaaagggaaaagatcttctcaatgaggagggaacattgtgtgccaaaattgactcacgaatatacaagcatctaccaacatggacactcctgtccatatgcatagctagaaattaagtttctttagaacaaagaaagcacgtgacataaacttatgctatacaaaatattatgcatatgctagaagttacttccattaccttaaaataaacatatactacatagaaacttaacattgaataattgttgatctacaagaaattcctgccttccaagatgatgatgagctgatcccatgaaagaaactctgcaggagagacaaagctgcatgcttcagtatattctctgcttcacctgtctctcgcctgccaaccatcgatccaagtcccaattcccaaaccaaggtactacgaaaaatggacacatcaaggcaagaaaaaaaaagaaaaggagcaaaacgaaaacgagatatcactgcgaattcgcaaaaaagttagcggcaggtggtacgagcagagcaggaagccaacaaaagcgcgcgaaataaagctgcctctcgcgcgctttttttttcttttaaagcggagcagcctcctactcctgcacccctcctctctccactttccctgtaaagcaaacgcgcgccatgaggaagaaggcggcggccggcg

SEQ ID NO: 57057 - DNA, 604 bp, Oryza sativa
tttttgaaaaaatttctagaaaagttgcttaaaaaatgatattaatctatttttaaatttaaaatagttaatactcaattaatcatgcgctaatacctcaccttgttttgcgtatctttccaatcttctctatctcctcctcaaacacagcctaagtgtcggtttattaggaaaaccgtcatttatattattagtgttggttttttaataaaccggcacctatataatattataggtgtcatttttttacttttagacccattgaagggtcgggaggaccgaaaaagtctcatactatgtgccaagtttagggcgtttcttatcaggagtttcgtagtagtgtgtgaatttgagcccaacatggaaaaaaagaataaaatgcactagtggcccttaaacttgtcataaggtttcacttagatccacgaacttgtaaagcgtacatcgaggtctctaaacttggtttaatatatcaaccccgtccaaagcattgtttgaccgtggtcttgtctacgtggcacgccacatggacgatgacatggcgttttttttcatttccccttttctttttcctcctattcttttatcttcttcctccactaga

SEQ ID NO: 57058 - DNA, 562 bp, Oryza sativa
tgcgtaaagtagtcctttaaaaaaacatgaattttagctctttaatgatatcattgaaagtttgaaactagtctttattgctaaattcttttaatgtaaactattgaataatctcacaaataagtaccatctattttactttgaaaaagatgagaattcacaaactaattttgtagatcatgtttcttgctaatatttttagacttgctaactaactaaactgataatactttcaagctatacaaaaacaaactagataaatatacttatcttagctaaccttaatataaagtaaaaatatgaggggtgtagtggtggtggtatttggatagggcctttggcaacccccttaattagctgcgctacttgtttgtactaaacttttaataaagtaaatgatcaaatattatgtgaaaaataaactgccatatagtttaagacaaggataatacgaggaactcttgcgccatacatacatacatacatacatacacacatacatacatacatatatatatatatatatatatacatacatatatatatatatatatatatgtat

SEQ ID NO: 57059 - DNA, 540 bp, Oryza sativa
agtagaagatagtgcaattaatgatgattttgccctttcttttgggattaatcgtgcacacgtcagtccacggtggatgagtttccggttcaacaggacgataccgggtgctgcatgtgcacgcctgacccttataattaaatccttataacaccgtgtacaggacacattcatccatctttaattagtttttttaattctaattgcatgcgtgtctggcgatctggaatacaacatgtagctcaaccggtttagctagatccaatcattcgacaataatattcattcagtgtcattcaatctctcactcatccataaataaaacacataaaaaacctagtggccatctaccgtttgatcggggtagctctagtttcatccgagtctatgctatgtggaaaaaaaacttgtatcacgacgagaaaaaatatatcatagcaaattatggcataacagaaaatttgatctaaattgtaaaataaaacaaaattttaagtaggagatagtggaattaatgcttatttttcccttttttctagg

SEQ ID NO: 57060 - DNA, 1501 bp, Oryza sativa
tccccactagcgcacattttcattcgatttttgcgaaaaaaaaatcaagcctgcgcacaagtatggcccaaacacactaactgggccatcgtgtggcacattcattcactaacttgccttagtctggtccgaccaaaggcggtttattgcccggttcatcacaaaacaggccggttcaagcgatctgaagcggttcaattgtacgtccggtctttctattcgaccgaaccattgcaacctctggttccggttttttcgggttaaaccgctgacctagtctgattttttccactatgaaccctaccagcactagaccgatctttggttttggcgacgagccttgagagtcctcttggccgtgcatctctccctcttatacaagtgctagtgggcttgggggctaaaccgataaggatttaagttggttgttaactgatcaaactacctctagttcttatctactctattttatgttaggaagataacggtggaattatctatcctttaaaagtcatatgaatttatttttaaatttaaaatacttaatggctcaccttgttttatatatgctcttaattttttcatttccccctactctcaaattaagtggttacttggctagaagtccgtactccatagtgatggtgtgtggcaaagttacgatcattcgctccattgaaccgcaatcattctacgagcaatccgttaacaaatctaacaagagacacaaagcacgctgaacagtgaatcggacgaggagaaaatgcatgataattaagcactagccataggcgtggaaccagtgagggtgacaacaaagtcaactaataaccggtgatctggattattaatttgatattcttagttccagctaagtaagttccatctgcccagctgttttctgggatcaagctgttggtttaatttgatcttccagaggtcaggtcaacttccttgcattgcattatgggagagccaacagttacacatgaccaacatctttttgtccataacttatggaccattagtacattatgctagtagcatttatatattgattgatactttcttttttcctgcacttctaacatggacgcaattgaatacgagtactaattaattcactcgtttgttgtaatgtagtagtactaagatatttgttgtaatgtaagatccgggaccttttgctttgaccattaatagcttagattgtcaaatacgaatgctgtcatcattcatcagtagatttgtcatcaggcatacacttgtgtatcgtgtgtcacattaatttctgtagttaagtctattacagagacggaaaggtatattattggcaccactaattcttccctgggacaaatggcacaatgctgaccggttgctaatcatactataatcctattgttagcacttagttttcaaaatcagcaagtctctgaaatagcatcaaacgatgcgtgggtacatcactgaacacgacacgtcggtacccactgcgtga

SEQ ID NO: 57061 - DNA, 792 bp, Oryza sativa
  unsure (1)..(792): unsure at all n locations
tacacattattcagagactcctacgatagtcaagacaaaaaagacatcttaaccattaatacacaaaaatagttttttattagctttctttcattttctccctctgcgagcagaggaatttcttttaataaacactaagagtcggctctaagccgatatcataagtagcaacaatgttttctcttcctcccctctatcttccacgtcaccaaatttacttatatgataacagagagagtccgctaataaacaccgttgtagatacctcataagttttccccctcacgctcgcgaaatgttttctactggagaaacacatgtgtgcctacacctgtggcaacattcatggtacccgctccaaccccccccccnncccnnngncaaaaaaaaacacaaaccaaaatctctctcatcttttttttttcctttacaagaaaaacaaaaaaacgatgtanaaaggaaggtcgaaaaggaaaggaaaagaaaggaggatgcagcgacgaagagaggaagaaagaggctctctgatttgtttgcgtttgtgcagcgcgtcttcccttccttttgaccacgcgacacatccagcagccaaaaaaataaaaaacccaaaaaataaaacgattattttatttttgtgtaaagagaagggaaaaaaaaaacgcgcgaaggagaaggagacgagctgcttcttcgtctccaacttcccttatctctatcaacccccattcctccattactctccctctctacatatacccttccccacccacctcccaccctcccctctccaac

SEQ ID NO: 57062 - DNA, 232 bp, Oryza sativa
agaccggaggaagaagagggagtaaatagtgtagttggggtgacaagaaaatcaacggccgggtgggcggacaataatttcatggtcctccctccttccctcgccaactccgccgccgccttcttcgcctactcttcttcttcttccacctccactccattcctccacctccacccacactagccactagactactagagctgtgggtgtagtagctaagaatcaagatcga

SEQ ID NO: 57063 - DNA, 1501 bp, Oryza sativa
gacacatctgattttggaaataaataaatatttatgccccaaaattggctcatggttttcacaaaaccagtgtaaacaaccggctgtctagatcgtagccatgcagctagctggctgccagggatcagtagaagtactctgtgcagtgaacagggtgagccatgagcatcatcactgatggttctttttgagtggctaagcatgtcactgggatagcccatgatcattctggatgcaatgcatggctagcttcaaagtgaataaaactgatctagaaacatctggttcttcatagccagagaccaggctacaccatataagagaccactatgtactttcttggtcacaaaaatgatttgcatgctcaactaacatggtcctagatacgctctgctgggtccagagacaagtgtctagatcgtggagaggggaatttcagtttatgggtccgattccattgtaaggattgcccccaacaccgttccatcacaatctagtgaatcttgggatttgatctaaggaggatgtctctactcggatgtagcacaacagtttgtttctgataagagatttgatttatagagtggactctgctcgggcatactgcaaacgttttattctgattagatagcttattcttttaggagaacacggaataaagggacatatatatattctacgcacatcaccctcacacagatcaagcttagaaattgctagcaaaacccaattgcccattgtatagctcacatatatactatcatggaatagcttacacattgaacatgtgtagcactaaaattggtttgtgccaaacttaatggcgcgacttaaaattggagtaatattctatttagttcggactacatcgtcgaatgataagtacggtatcaagtttatcgaaggtgatgttttagaaaccatatgtattgggtgccacaagttattcagatttgtttcagttttttttcctttcttatttttcctgcattcctagttagtgcagatcgaggacatataagtattttttttgtgaggatatatgtatttttttaacttaataaaatctgcattatctcgttctattattcatcgtctgatcacatgcatgctagtttctgataagaatagtctttcttcaatatttgagggaggagaggggattgcatatatgcaagtgcagaatttctacaacaggatgagttgtaaagcgcataataattcaccgaaatataagaatgcacacatgcaagatagatcgagaattggatagatccaagaatgctcaggttggtatgtattaagtccattgttgtggtcgtcccagagcttagctattgtccttttaacaaattctaatccccttagctttatcatcaacttgcatgctctgcgtgtgcaagaggattccagaaaagaagaaaaaatgtgctagagtggttgtattaaggtagcagatttggtagtcctagctttgcttgatccattgctttaggccatg

SEQ ID NO: 57064 - DNA, 1501 bp, Oryza sativa
agtatatgcaacgagaaacaaaggcatgcatacatgtcatcatttggttaattagactattgcaacttgcaatagctacctacctgatgtacgtcgaagcaagtacaagttgcatgcaagctttattgtctgtgtctgtctttaagaaaattaaagcagggagactctaggatcagaaagaagaataagctgttcaaaatagaccaactgttcatgatgcttttcaccttcctttcgttaattagaagcatataatcccagagatttcagcgtcaaggggaaaccatttgtagcttggtagcacaggttatataattaaagccaccaaccaatcatttgggctaagatcgagcgatactgttacggtgctgttgcatttacttttgactaattaatctgcgagctaccaggccaaatggatcagccccaatgattaacaacgctcatggattggaactaattacacagattcatcccgatctgcaggtaacaaaaatatgcgaacctttctgcagccaatctatgcaatggtacagaagtgtaaacagataattggtggcttgcagagaagatgaatctgaattatataagcaggttgggtgcttcttgttggtggccatgtgagtatcagtatgtgacccaggatgactcggatgacacagctctgctcgccgaccgatatgaaaatgacggtgatcgactgcgactgccaccagttggcggcggccgaacgagaccccccgcgtcgttcctcgtcgtcctccaccttcggctccctgcttaaactgcttcgccgacctgttaactatttggcaatgtacctgtgattggctccctttcctaaaccttccgatcctgtttctataaatcggttgagcgttctatagaagcttgatgcctatttgtacagctaccatgtatcaacatgcatgattatcgcattgagctgtatcatccaacattccctgctccggcggacggccctgctcgccaagccctggctctgttggtctctgcctctgtctcaaacagatgttgttcgagccattgactggatggctaaaggagaacagagagaaggaaggatgataggacgacaggtgggccctgtaaattcattattattatttttctgattgggatgtcatgttggcaccacgtgtaccagtttaagtcaagacaatccataagggataatttatccggtacaaaaagcttagggtgtaaaatatttggttttgtattttccgggggtaaatcggattggcacaatagttcagcagtgtaattcaaacttttttttttaaaaaaaagttgttctactattttttactctctatcccaatataactgcaacatagtaaacataggctctatttagttcacaccaaacttcctccaaactcccaacttttcatcacatcacatctaaaacttttctacacacataaactcccaactttttttttccaaactaccaactttccccaaacttctcccc

SEQ ID NO: 57065 - DNA, 385 bp, Oryza sativa
accgtaggggactaaccgtgcctatccctgaagttgatatccggcgtcttgtcttggcgtatgttggcttgtatgttgtggcttctgttgttccgtgtatgttgattgaggtggtcatctcccgtctcctcctagggggtcttgtatttatacccataggtgtccccttgtctaagtagaactagggaaaccaatatggatacaatctgagtagtcattgtcgtttccatgtagaactatggtttgtctttccttaaccggaactccctcgaggtcagtttccgtataagatatggtatgtggtggatcctgccgagatttagtcaactactattaggtatgtggtatccataaccctgacaacggcgaatggggaaacaagaga

SEQ ID NO: 57066 - DNA, 1501 bp, Oryza sativa; identical to SEQ ID NO: 21325

SEQ ID NO: 57067 - DNA, 1501 bp, Oryza sativa; identical to SEQ ID NO: 29723

SEQ ID NO: 57068 - DNA, 1501 bp, Oryza sativa
tgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagca

SEQ ID NO: 57069 - DNA, 1501 bp, Oryza sativa
tacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagca

SEQ ID NO: 57070 - DNA, 1501 bp, Oryza sativa
tataaacattatgcttataatagaagttcggttgttttcctctttaatatacttggattttttttcttctaactaagagctaagcgaaggcttgcttagtaggccaatggttttgttcccctctttttttttctcctttgaggacagtagcaaagttacacattttttctgttttgctaatatatgaaaaatacaattcaaactcacgatactctaacaactactccgtaatacacttttcaaatctttgtgtaatatagataagcctgaaatccgctatacaactttatgccaacaatggaggttgagttgtttctctttaattttatatgaaaactttttttttgttttacccctaactaagtgccaaacaaaggcttctttagtgatatcagcggtctatagtctctatctctctagcatgtgttaaggaaacgcgtgtgtacacgtctttgtataggatttttttcccactacaacaaattaattcctaccctaaaaaacaaattaattcctcatatatatgctaactagaaaaaaaattctgtgtattgtaacaggtgaaggcaattttacgattgaaaaaaactttaccaatttatacgacaaaccaaaataagacaaacaaaacaatagaaaaacacacgaaatatatagtattgaacccggttgtattcgcttcatgcgtcatcacgcgaagaataccttatatacaccattccatagtctcacaaattgatgggtggcaatgtcataagttgatacatgggtattttgttatacttcatcgaccataggttggaattttaattgttcaattagtaaaagtcttttttttactataaatgaaaaacatttgcaaagtattaaacttatcgcatacacattttaaacaattataattttaaaagaaaaatatttatgaaaatataaaattagaacataaaagaaaaggagaaaacagagagaaaaggacgagtaaagagaggccattagaaagagcaggagaggatcaggatgattgggagaaaagaaaaaagataaaaagaaaacgagaaaaaagatagaaaaaacaggagaggggtgcgcagtgtgttgtggtggtgcacatgacggggtgcccggatggtgtggttcgattgggttgagctaagaggagggttggactgaaaggaggtgtataatagataatctagtttcatgatgaattggatacagacgacgtacaaccaacttaaaaaaatcactcaaacataatatttttaatttttataatagtaaagttagactcaaatatggataagatgtattaaaatttggatgaaaatatttttaatttttatagtagtaaagatagagatagtagcactatcactatgcaatgagcattgctgcattggcaacgatcacatggttccgttttggtgtacactacagttgtcgtcttctcccaaggattactgctataaatgtgggattttggatttaaccggcttttaaa

SEQ ID NO: 57071 - DNA, 180 bp, Oryza sativa
ttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacgg

SEQ ID NO: 57072 - DNA, 1501 bp, Oryza sativa; identical to SEQ ID NO: 21322

SEQ ID NO: 57073 - DNA, 1501 bp, Oryza sativa
tttgtctgattatgcaggactaacagtagtgactgctatgcacgacaaacttgcatagctgaattgcccgccggtgattcagtcaggagtaaattaactgtgggtcatctcgatcatttcttttattttttttactcgttccaaaaattaactgtgggtcatgtactatgtccgctgcaaaggaaataatacgaaaatagatgctaaactatctcatcatttcttatatacatatatatgtcatccaaatagtggccggctgtgtaagttcattgtggatgtaatgccggattttaatccattttctaaaaaaaaatatcatccaaatagttaaaaaataataaaatatataatatgcgatatatcattttacaagcatgcaaattatcactcgtacaagttaaaattaaaaaaaaacaattagaatgatatatcacatattaatctaacttatatttttattattattttttaattatctatatgacatgtaaaaaataagagtacatctctctaagagattaaaataagttctcaaataatattgcatatgactgggtgaagcaatagtttaattttgtagaacacatgttttacaaatatcttttttccttttatgatatggtgagaaaaataagtttgtgatatcttttttccttttatgatatggtgttgtgtgtgaccattattttgctccacttggcactaggtgaaagtatctgttaaaccagatgcaaatccccgagagaagagctcgagctccacagcctgagctttcaactgcttccacctgtgccaacagacgttgtcctcgacctaattataagcctccagttgcctccgtctaatagaaggagataaagagagggagaggtgatgcatatgacatgtgttctatgaattatttttaatgctttttgctaattgatctgtcacgtttgtatcaagtaagtcagcttagaccaaatctaccgccgactagttttatatgggtttttcttattgtctggtttgaaaagtagaaaggttatggaatattcataaattttagtttttatgagctcatgaatgatgagtagtagaagacattaaagtctgacgattaatccctctaaactattacgatggtcggatattctcgtaataatttagagaattatttgtcggaatttaatactccctccgtactcgtaaaggaagtcgttttcgacagcgacacggtctccaaaacacaactttaacttcttgtttctataaaaatatttattgaaaagtgatatatgtatacttttatgaaagtatttttcaagacaaatctattcatataatttttacattttcaaactaaacaaactaagagttattcatgattttattcccaatgattgatttaaacattatcctatacgactttctttatgagtactgagagggagtatctcctactactacttagagcaaggctaataatacagccgacttgttggctataagattcttt

SEQ ID NO: 57074 - DNA, 539 bp, Oryza sativa
tgctcactcaaaatcttgtcaagagtgtccttacccttgaagcacatctccaaactctgttgagcttaaccacttgctccttaagctcattgttctcaacaacaagtgaggcatcacaaatagaaacacaagtgctagagctagagctaggcatatccacaagatcatcacaagaggtagaaatgctagatgatacaacatgagcaatatggcaaatagcactatcatcaagcaaatcacaagatatgccaacatcaatgagaactccatgttgagtagtggaaaggaggttgtcatgagcttccttaagcttctcatgagaaatggtgagtctctcatgagaggtctttagctcctcatacaagacctccaaagaagcatgatccttctttcgggccttgaacttgacaatctccttctcactataagcatagagctccttaaacatactcacaagctcatcataggaaacatcatcacaatcatcatcactctcactatcactaagaaatgctaccttagaggagtcctttgccatg

SEQ ID NO: 57075 - DNA, 336 bp, Oryza sativa
ccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtcctt

SEQ ID NO: 57076 - DNA, 1501 bp, Oryza sativa
tgcgcccggccgcacggcaagacggtgctcaatcacctccctggggaccccgggcatgtccgccggtctccaggcgaagacgtcggcgtttgcccgcaggaaggagacgagcgcgtcttcctatttgccgtccagaagaccaccgattcatgtggtcttggacgggccgtcgcccagggcaacctctttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgtgactttgaggtcgccatggacagagatggggccaccggggcccggcatcttcatctggaggtaggcgtagtggaccgccaccatgaacttcaccaacgcgggcctccctaggaccgcgttgtagggcagactgaggtccgccacatcgaagttcacccgctccgtgcggaagttggcggatccaccgaaggtgaccgggaggtcgatatgacctagcggccaagtgtgcccctgcgtcacacctacaatcggctgggacggccgaagcaccatccccggggccttgatggcgtcaaaggctgcgggggaaaggatgttgagggctgcacccccatctatgaggacacgccccaacttcacgttgctaacggtgggggaaaccaccatcgcgatctgtcctccccgggcaacgcacggcgggtggttggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcgatgtcctctgcgggggccttctgcttggcctcactttgccggttgccggagggagccgccggggccttgccctcacggcgctcctgcctcctctcctcctcccacttcctcgtccactcagccaaacttttgaccgcgcggcagtccgcgaggtcgtggagggaggtgttgtgcacggtgcaccacttgccggtcgggcgctccctgctgggagcgccggcctccttctttttgtcgctcgcaggcctcccctttcaggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctcttccttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcat

SEQ ID NO: 57077 - DNA, 1501 bp, Oryza sativa
tattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataaggggttgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacatcaa

SEQ ID NO: 57078 - DNA, 180 bp, Oryza sativa
aagacacaagcccaaattaattaagctgacctatatcaatacatgttgacgctgattcttttgcagcctgttaatttcaactgttccatgccgtccgcatcctccacaagaatccttcatgggacacgttctgatgactcctcgccgccgccgccggcgtcaccgcccagctggtgacca

SEQ ID NO: 57079 - DNA, 1501 bp, Oryza sativa
gatacacttaatttttcaaaattttagcaacatttacacaactatagtatatttaaaatattcagtaacaaacgacatgatttttactctatatcttcctaggctctcacctagttttgttagggtagatagccaaacaagctattttgaataagatgtcgacaactttgtcaatttggtattgttccaagtgtgaaattgtatacaagtgtttagaatgttcctactacttatatgttctgaagatactgcaactaaacgcattaaaattaactctaaaattaagtactaaaatttattttttaattgcgtatgaaaagctaaagagcaagtgatgaagctgtaattgtactggtagaaaagatgtgctatgctagagtactctctctctctctctctatccattatataataataaaccaatttttatataataagtctaaacatatcccctctataaaaaacaatttatgactacaaatctaattgtaggttatatcgaaatctgtagctataaattttggaatagacgaaactagaagaactgtcacttggattaaattcaagacatctcgtaacggtggtactgtagaaaagtacgtactagtagtacaacaccttgtgctttgtaattttaaaatctaccgtcctcgtttatgtaccaggccgattatcaacgcactgcaaattagaagagatgccctgacaaataaaatcacgcataattttgtgggccgttgacattgtagtagcactgtttaaggtggagtggaaaacatccacacttctaaacaaaaatactcatcacttgttaccctacaacgtccaatgatgcatggccgcacaaggaaaaaccaagagaacgatgggaacataatattatcgctgtccctaagcttttctctcatttttttatcttttctttcatttctttgacttcttttattcgagggcttttcccctttctctgacaaagtggactacacgggccaaatattctatccgctcccacgttctccacggcacggcccatttataaagcgaggtgatggggtggtgtgggtcccgccggccacgtgagtgctagctggcgagccgtgtcaggagtcatgtgagcggcggggtccgaccgaccgacgcgcgggggcgggccgcaccacccgcaccgcacggcccgcacccggctccggtacgtggtcaatgccacgtcgcgcgccacctctcgtcgtcgtcgtcacgtcacgcgaggctccaccttcccctgtgccgccgtgctcccgtgtacagacgcagtgattggtgaaggttgatagggagggcaaaaatatctccgacgcgaacgcgacgcgagagcccgtgaacctgtctgcgattttctgatgtgcaagcgctgttcgagtcgtgagatgagaaatgatttttgataaacagggggcgtcgtgcagtcgtgctcgttagtactttgcttggagtggatgctgcgtttgaagactttctgggg

SEQ ID NO: 57080 - DNA, 1026 bp, Oryza sativa
cccccccccccccccccaaaatttactttgcctctgtagagagaattcccggtaaatttgtgcgtgtttttttgctttccgtgttgagatgttattgctctcgcttttgttcccccaatggaaaagggaaaaaatgcaagcgaggagaggaaaaaaaaaagggcttcctgaggctgacaggtcgggcccacctccgccggagatggcgtgtggcttgcgctgtttgtgatgagttctctggtggtagtaggttggcatatacggggtgctctttgctttgagcatggagctgcaattcgctttgctttgatttcatctttttctactgtgcaattgaagggcatcaagaacatcatgtatcaaagctaatttcatatgtctggcgataggttgtgtgggttgctcccatggagctctttaccttttttttgcctggttataaattgagagcaaaataaataaatactaatggatgataattcgattgatgcaccatgcaagctgtggatgcaagtattcgccttaactatgtatgctggctggttttctgttagagctttgcatctaccatttttatgggtcactctatttgcctaaccttccatgtaaagcagtatggtatgatgaatcaaattggatagatgtattggacagcgttgcacacgctagttttcttggtacaaatggcattttccttgtctatactagtactagtagttctttcctctgcaacaatgaaaacttccctatgtagttaagctcacaaattctagaaacacttgtgactgtcttagagatggacagaaaactgccactgcaactttgcactgattagttgtgtttttgtacttttatcaccggcaaacattgtttgtgatcgctgtttgtaaaactgatatctggctctctgatgtattttttcccaggtgatgatcattgtattaaccaaaacctgaacctagtgttggccctactgtaataattcagtcacttatcagcagcatatggaattaggtggcaacaata

SEQ ID NO: 57081 - DNA, 1501 bp, Oryza sativa
catgttaggtaatgttgcgtcgatgctaagatgtatccaacctggttaatgggttatgataatttgagatctaaattctagccaatagaaacagagggggaaagggaaaacggaaattagctcatataagatctgtttatgtaacattagtcatatgcacttgggttgcaatggggtgagatatggtgaacatgattcaatttttattttgttttctcccatttatcttctctcggttggttagtttattttgcatcattttagcatatttttataggtaaattttactatagagcacccagttttttttaatgtgcggataaacatagaaaaagcatgtcatggttaaaagacatcttaaaattggtgatttgctaatggacactttcgggccagttggagagataaaatcttaaagaaagacgagaatgccctaaaaccacatgcttcaacacatggcattagagtaaaaatttagaaatcatgtaactctaaatctatcatcaccctaaatacatcactaatatacatcatatttcattttcactttaggcttagctcaaaagttttttaccctaggggtattctcatgtttttgaataattttctctccaattgagtcgaaaatatgctccagaaaattatcaattatttaaaatgtcttttagccttgacgtgtttttataatgtgtactagcaaaattacataaattttaaatgtcaattagctatttttacttttcttttaatatgtggaattagggtaagaaggaaagaagttttaaacagtagagatatgtactaatggggagaatgatatcgcttttaaaattaaagatttttggaggtatttaaaatgaacttttgattttccgcgtttcataaaaacactaaaatctccaaaggatttactatggcatatttgacttcggacgatgtacaactcaagattttaacaacaaaaaccattggaaatttcaaaacttgcagacaaacatcccacatttcgtatcgtgccgtttaaacaaatttcagaaaataaagcattgccatccatctgatctgatgtcccggagccgcacgccgctgatgatccattatcccatccctctcattatttatttcctcgtatctccagccgcacacggaatattaaattatttcatccatcgatatcgtttcaaaatatatttattacttatatcgatttatcacaatcaaaatcaaatcaaaccgaaaagggaagtcgaaaaattcagtcaaaaaaaaaagaaagcgaaaaatacttcgccgtcgtcaagtagacgtcgccgtcttccgcagccagcctctcccccatctcatcgtcttcctcctcctcgcatcgccggaggccaccggggaccccaagaatccgaccaatccgatccccaatctgcttctccctaggcccgcgagaatcttgcgaggaaatctcgctgccggattcgaagaaaccgccggattccgtggagaatcaaga

SEQ ID NO: 57082 - DNA, 1501 bp, Oryza sativa
gcgcctcgtaactttggcgctgtgtcccgccatggctgtgctgtgctcgatgtggttggtgatcaggcgagacgccgacgcgttggtttgtttgttggaattagcgatctgcggtttttgtaccatatgggttccatccatctggtgatttagcttggtttgcatgcgtgcagcggtcatgggatctctctagatggcctggtttgctcggtttgcgaatttatttacggcatgttgatgatggtttggctttggcagtaaatttgtggtatccttagaggatgaaattgttccctttgctaacaagtggtcctttagctgcttgggtgttacaaggggagagctgagaagtgcctgggaccattagctctaagtggactatgaggcataattatcagcgggattattagttgtatcacttgactttaagtggaaatgtttttaatgaagatagatatgctcttctgatcatggtttccttagatagctgttgtataggcctcatcgcggctggatgagactgtgttggtttctttttgctggatctgttttttcgtgtgggcatgcaggttgtgtgctttataaaaacctgggtattgaatgctatattgcgtttttcttgcagtgttaagttcggtcttctcttaatattttctttcctagatggaattaaatagcttttagcgtctccggtttggaggtttgaacgtaatgcctttttgtgttctaatcacaagttggaactttgcaccattcaaacaattgtactgaaattgtttcacctcggcggccttgtgattcagactacttgccaaagatcatgttatttgttcattatattccactgatgaactttgtgtgtgaagttacactatttctgtctactattctgttttgagataatacattgtataatcaatctcaagtcaaagttcaggcttcaatctgagaagtcaaaaccatgattgcccgttttagagccactgcactctgagtgtctgtgcactagataaaacaatgacttgcgtttaacaaatgccgacatatctgttctgggtgtatggtattcgagtcacaagattcttcatcgtcttgcaaacagaacaatacatttttttttttttgcattgttgttaaccccccacgccaatggcagatatattcaattttgttttgcttcacaagaaaacaacagctgagctgcagtgctcttgtccctcattcgggagaatgatacattggtgttattctttttttttcttcagaaaatagtaatcatctacaaatccactaaattctgaaactgggaatcgatattgccattttatttatctcggttgtagccgtctttgctctgtaattcagtacttgatgcatgggtatgaaaacttctcatgctgtttctaggttgattttgtcttcttttgttctgtgcaatgatatcaccattatgcaatttctatataagtagatttaagagggtaactgcattatatcctga

SEQ ID NO: 57083 - DNA, 1501 bp, Oryza sativa
tttctcaaaaaaacttattataacatcataaacttattctattatcaaagttttacaagtgtgacagaacttttctaaaaaaaaagggttaaaatatcaggtacagagttcaatagtggtttgcaacataaaacaaaagagaaacacagtgtgcatcacatgagcaacagttaccaaaaatagccttattattattaacaggcaaatcaccgaatcacagccgccggccaccaaaccggccatttccgcttccctattccgccccccttcctccgctcccaaccgagtccccggcgccgccgccggctacatcctcgccctgcgtcgagggccacggcgccgcgcccaccgcccgtcgcagcgcccccgctgctcggccacggctcgcacgaccgcgcgggtgagagaacagccggcgctgccttggcctcggctcggcggcgcgacgcccccacccactccaggctccacgtatggttcaatcctatgcaacttcttttttttttgttgattcgggaattcatgcctatccttgggtgtcgattgcgcatgtagtttcgaatttggattttgtcagtttttctagaatcgaatttggccatctgtagaatggcgctatgacaatgggtgtctgatgcatgaaccatcctagcgtcgtagtatttggcaagaattgggttcggtgagaagatgtcatgtaaagttggggaaaggaatgccaacgttttgagtttggaggtggggtttctcgttgaggacatatgctcggtgccgtttctggtgacaaaatcctgcatctgatagggagagaacaagatgctccaacccccattcggtttggtttctgcacggtgaactgccgtttgctgttcagaaattttggaggttcctttcaattgaacatccatgtcccatgttaggtcattcctgcttacacgtgcagctaaataggcatagcattatgacctgctatagagttctatgcagatctcaataggtttcccatacccccatcaatattctgattccgtcggtgttgttgatcaatggttctccacattttagttcgtctctcatatgtgcggaccagtatatgtgacggagctattttcctatatatggtaatctgtaggacttataaacttgtgaaagtaagttcgtgtgttatgccttcctaaaattttgcagacattcactctacattgttgttcaaagcttcctctcttaccatgtatgtaaggactccttcaccggtgtataaccaaggataatagttgttgtatattgtttgctacaatcttatcgtagatgtgtataaaatagttttatctcttaaatgttaatgatttgtatgtgccatggtgcatcagtgtttgaatgtatcagaatcaaatgaacttagtacaatgtgaggggcacatttatagatgtgagactatgggactatatgctatgtaaacaaatcattggcagaatatgtattaaacattttagtcttatc

SEQ ID NO: 57084 - DNA, 1501 bp, Oryza sativa
accaaaatgaagggtaaacatgaataataaagagagttgggtgattcaaaccgaaaaaataaccacaagttacccaatccaaaataaaaaaaaaagttgatttaacggtggctcaaagtaaaaactttggcaataaaaatgggtcaaaactgtaatacaatattttaaaaaggaatatgaaaacaaatataatatcgacattatttcatccgtatatagtgtccgatttaacccgttttttttgacaaattgacccttttcaaaaacttaattcgaaactaacccctgccataaacttcaaccaaaactaggccatcggctcagcgccaatcgcattggcgctgaggttggccgtgtcagcgccaacgagactggcgctgacattgtgccaccgtggcggccgggccgatcccctagctgacgtggcagctacctcagcgccaaccgcttcggcgctgaggtgcccaacctcagtgccaagtaagttggcgctgaccttggctacttagagcccggccgaggtcgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaatatggtaggatagggaagaaag

SEQ ID NO: 57085 - DNA, 1501 bp, Oryza sativa
gcaagcgatttggaacattggatcaagaaatagagggctaattatatgtagttgctattgtgcagtcacaatagcaactgcactggacctcaatctgtgcagtggtggtggggtgggtgagagtggggcagtgggagcaactatggaggaggaggagatggtggtggaggaggtgtggggaatcggagataaggttgattggcttcgatcggttttttcataggcattagtttttaaaaaaccagcacctatagtataaatataagtgttggttcttaaaaaaattgggatcttaattatcggtgtcagttcttctgaaaagaccgacactaatattataggtgtcggtttttatttagacactaatattataggtgtcactagtccacgtagccagctcattcgacgggcgggctcacttacacataccatcacatttacactttttgtcatcgtttcgtgttaaagggttaactcaggaataatatggttggagggaagatgccctataagttggctccactattgctaaacaataaggtggtactaaacatacacacagctctcatggaccacacatgctatatcttaattaggccagaatgtcacataatgggttaggtcgagcggaaggaggtaggaagcaacggattaggctaggggccgggggttgaaaaggaatgaaggaatgctttcgacccaaaaccaatgaatgattttagttaattttttccaattaaagtgtatagtgataccaatgttttaattcgttgcttagctcttaatagctgttatagcattggaaaaagtcttgctcatttcaacgcacagacatttttagttaaactacaaaattagtgcatagtacaactttagagcagtgtagcacatgaactcaataaaattacaaaaggggattagtttggcttatatactaacaggatttccaaatgaataattactcaaccttcatttaagatctgttatagcatcggcgtcaagaatattctgcccgaatctgcattccacgatgagctagctggtcatcgccgtcgccgcacctatgccaaacttgggccccacctcacagtctcaccctcgtactcgtcgctgagcttgctccaccacccatctgacaaccacactgtcaccgacaagtgggccccgcagccattacctacaactgcccctcgctggaccaccgtgctcccggtccacccagcagctggcaagcgcgggcccagccaacgtcacagccaccaacacactgacatgttggtccacaaaatcagcggggcccacgtgtcattgagcatgcagactcggccggtgccagctcagctcggccgcgtcgctgcttaaaacctctctcccactctcacgctctcgccatcctcgagcactccgccgccgccgccgccgccgcctcgacgcatccgcttccccccacgcgagccgaagcttctagaaccttcgaggccgcggctcccacgggcggcaa

SEQ ID NO: 57086 - DNA, 1501 bp, Oryza sativa
aaccgcctccctgccgcggccggcatggagctcgtctgccgcgcgctcggcccgggattcgacgtctacccggagctcagcgtggtgccgcgcggccgcgttccccgcggcggcgcgcgcgtcgccgaggtcctcatcgagccggggcccgagcgggtcgcttgggtgctctgcagctggggctacgaggggaactacctcgccaacctgaagctgttcgacaccgagtggccggaggcggcggcgtgccaggacccggcggcgagcggcggcgagctgtgccgcctcgtgttcgaggacgacgcggtgtccgtcgtggcgcccggcggcgagcggcgcgtcgtcggcgacctgccggtgaagcgctgccggcgacactggctgctgttcagcaccgggtgcacgtaccccgaccacccaaacccgtacgccggccggctcctccgcaacgccttggagttcttcgccgtctgaagaatctgacggactgatcagatttttttttgtaataaatttctgattagttttgttaggatttagatcagaagcatcccaaggtgtcgatgtttgcgagataaatcaaccaatttcgtatggattttggtgccttttttttgctggcaaatctggcattctccatgaatcttgcaatcatgcgcgcacgccgaaatcttgctacttcctccgtttcacaatgtaagtcattctaatatttcccacattcatactaatgctaatgaatctaaataagtatatatgcgtagattcattagcatcaatatgaatgtgggaaatgctataatgacttacattatgaaacggagggagtaccaatgaaacaagaaacgaacaacccgttgaattaatccaattgccaattcaaatttgctcaaaattttactacaccgtcacaaaatttcaagcgaataaaaattctatcagaaatatttttacgattctcgcaaaaaccagttcaattcttcgaagaacaacaaaaaaaattctctacatttcataggaaacctgaactgcagttcttcataaatcggccaagatggagcaatagaaacataggagatcgaggacactcatgttcaaaaattcaaaattcaaacactcgacatgtctcaaatttcaaactctgaaactgatgaaactcataataactctatcattagattactgtgaggtgtggtcctcgtgaccgtccaaaaaccgttggctattttgagcgctcttcccgccaaatttggctcggccgcgcgcgcccgccgccgccgcttccgctctcctctccatctctcccgccaccgccaccgcctcctcccatttcccgcacgagccaccaccacctccacctccgccgccaccgccgccgccgccgagcgattaactcctctcctcctcctgcacgtcgtcgtcgtcgtcgtctctctgcacgcgagaaaacgggagaggcggccggcgcggcgcgcggccactagtcatcccgccagggcgc

SEQ ID NO: 57087 - DNA, 1501 bp, Oryza sativa
agtgattctatattcgtcaaagggtgtatttgacactctcctttctcatcttctacactcttattttctacacacgtgtttccccaactgctaaatggtgtggcatttgtaaaaaagaaatcgatagaaaaatgttttaaaaattttatcaattcatttttcaatttttttagctaacttaattaatcatacgctaatgggctaccttgttttccatgcggggaatgagttgcgaaccaataggttcgaaccaagcctaagagtatctccaatagcctctccatctcactctccaagtcaaaatttagcaactttattttgaaagaaaatcgtactccaacagcctctccattccactctctaagccattcggatggccaaactccttccctcacttgccaaacttggccaacctatcccacttgccatccatgggtcccacaaccttctattcactttttctccgttcgggagcagagtggccaaaagggagaggtagtggctgacggcggaagcttgaggatggcgagatctccgatgaccatacggaggcacgggacctggtcccctcggagtggcaagccaatggcaagatctccgtaggcggcggcaccctgcaggagaatccgaagaagaagcaacgccctacaggaccaccgcctttgtttgttggcccagtgccgctaccgcccttgccggtgcgagcaagaggtcctgcaccacccatttggctgaatccacgtcgtcgccgtttgcccaaatctgcgtcaccgcttcgtcatcatcacgcccatgcacaacctcaccgcttatgcccgagacgacgaggatggtggtggcgacagtgaccattgccaccgcctacggtcccgcggggatttggccagtggcacgacagagaagaggagaggggggagagagagaggagagagagggtgaagaagcggtgaaatagtagagaggctaataggtgagacccacatttagattcgatagtgtaatagagagtctgttgaagtgaaatgcaaattagactttccatttggtttggcaagttggacaaatagtcatttgaagagtgagatttggagtttctgttgaagatgctctaagagctatgctctaaaacaggcaacatttataattaaaactgtcaaattcgtatgaaagttcaatattttttccccaaaagttgattcaaaattttgaaaatggatcgagattgtgttcctcggtttctaatatgcgaaaaaaatattactagcaccccgtacggaatgcaagaatttcagataatcttcggtcagagttagaggcaaaaacagaccaacagtttaatatcaaatactccctcatctcaggttataagacgttttaactttggttaaagtcaaactgctttaagtttaaccaagtatgttgaaaaatagtaacgttgtcaacccaggacaaatttattatgaaaatatatttaattattgatttgatgtaaccaatttag

SEQ ID NO: 57088 - DNA, 1501 bp, Oryza sativa
acgtttagtttgttgccaaatttgataaatacataagaaatcatgctaaaattttagtaatattgtcatctttcatgtacacaaacctacacgaccaaatgtgatctttcagaaaataagaggagaagctcgagttttggtaattttggctaaatatttgttttaaagaaaaggcaccaagcatttatatgattgaagggacctgtgagatccgaggagtaaattattttcctatcatcttggtagttaggcatactgtgacaaatgactttttggcaagttaaactcatgtgtagtttaactggttagactttggtttcttgtggtggaacttactcaccctgtttcaagtaatagatttgaagcggatgcttacatctacgactagttattcttttagtgataaacgatattcctatcaacagcgaaccatccatgatggcttcatcaatctctagcctagtttttcggaggtgtccatagggtagggtgtaaaagtgtgaacttcatcaatctcaagatatgctacatttattgtggtgagtatgcgcacgttgttagcatttacgtttgtactgtgtccataaaaaaaattaacagcttctttggagcaatgattaaaaaacacacaagaatatattttttactccaccttattcctataggatttgaaaacatagaaatatttatttagcgcattgaatggtttttatgaaacaaacttatgaattttagaggcacgttccatagctattgctatagttacgctgcacgttatgcacggttttgctgcttgctgctgcagttggctgcggcatagcaagacagcaagccaaacagaccatatattcctttgttccaaagaagctaacatgaatttttttcgaagaattaaaatccttcaattccctttaaaattccaaaaatcttaaggagccctaataattaagtttggttgcacatacatgacaactggtatgtgacgcacaaagaaccccacaccagactcagctttcatgcatcgagctgctcaatcacacaaattttctccccatttatgagatatcccaatcacactagtaaatgttggtagtgccactaccaatatataatacaaaaccaaccaataaatttaaaataaaaatttaaataaattccgcatcgacagctccccgaccgagccaagatgcgaacaaaaacgcaatcatcagtcgcgaacaaaagaaacacaattggctcgagagaacgaacaatcagtgcagagccgagccccccgcgctgacgtggatccgacggatcgcgggatcccgatccgacggcccagattccccctcccgcttcttttatctccaccccctcctcccagatcctctcctccacacacgctcgccgcgcgcccgcacgctcgccgtcgccggccgccgcctcgtcgtcgtcgtcggagaaggaggaggaggaggccgtctctctgcgttctggctgctcgcctgcgtggtggtga

SEQ ID NO: 57089 - DNA, 1501 bp, Oryza sativa
cgaaaaactaggctagagattgatgaagccatcatggatggttcgctgttgataggaatatcgtttatcactaaaagaataactagtcgtagatgtaagcatccgcttcaaatctattacttgaaacagggtgagtaagttccaccacaagaaaccaaagtctaaccagttaaactacacatgagtttaacttgccaaaaagtcatttgtcacagtatgcctaactaccaagatgataggaaaataatttactcctcggatctcacaggtcccttcaatcatataaatgcttggtgccttttctttaaaacaaatatttagccaaaattaccaaaactcgagcttctcctcttattttctgaaagatcacatttggtcgtgtaggtttgtgtacatgaaagatgacaatattactaaaattttagcatgatttcttatgtatttatcaaatttggcaacaaactaaacgtagccattttttttacaacttttaaaaaaatggtatggttaaaaatggcatcaaagtgaactagcctttaattgctcaagtgattttcaagaacttttgtttaggtttaagtctgttggattaagtttttaagttagctttcttggttaagtacctaacttttggtttaacagcataatattatattatagctttaaaaacatatgaaaaagttaattatttttaggcttaggtttttaagttttttttttgcctatatgatttataagctaatggatttaaagttctaagtttaatggtgaagttataactctacctcacttaagaaaaaaaaagtttctccaaatagtgtaagagtggcttatgactttaaaaaagtgaaatggaaaagctacttgtttatgtatggttagacttttcgactcataagctagcttataaatctaaataaagatgaccttagactttttttgttgagaagtcagcttataagtctaaacaaataggacctcggcattgttattgttagtatgctaatattccctcagacgcttttcctataatataggaacattataggaacttaagattaaatttgatacggtatatcataggtttgtttagaatcgttgtagtataaagtatttcatacgatttataagttgtgatattatatgatggagggagtactaattaatttcataatcatgattcaatttgtgattctttgatatattttggtgggaagagattctgctaaatgttttacacccttagaaatctcaatgaggtctgttttttctgtaaaaacgaaatgcaaatatcgtgcttggctgtttggagcgttcacaacgacgttgtgtcactcataagtgaagtgcaataatgaagtgacaggtattatattgcttataaaatatttttgcgcacgaaggacctgttcactttggtgccattttcaaccataccattttgttttaaagttgtcaaaaaaaaaagggctacgtttagtttgttgcaaaatttggtaaa

SEQ ID NO: 57090 - DNA, 1501 bp, Oryza sativa
tttgccctcgaatgctataccaggaggttcagttcagaagtcatcctcattttatcactgtaattggggtatcttgagttcttaatccattttagagtacagatttgtgatccaatttagatgtacacgtgctttagtaaaaaaaaaacagaagcaggtaggaggaggcaacaccgcaacaggtagcagaacagatcacacaacaaaacatccacgaattgcaagctgggaattcagaccgtgacgcaggccgtgacgccgccgctgcggtcaaggatgagagaacaatctggaactgcaagcacacaccaaaattaagtactaaaattcttgactgccggagagatagggtgagtgcgtttggtaatcgtgtgtgcacgtttgatgaagcatatcatatccttgtcgaaaagaacaaagaaaattaaggaagcacccgcctactctgtattagcggacgcaatatcacagcaagaaacaatctgtatgtaaattttctcctagcaggtaaaaaactgatactcgctccgtccctaaatatttaacgctatttattttttaaacatgtttgatcgttcgtcttattcaaaaaatttaagtaattattaattattttcctatcatttgattcattattaaatatactactactactcaagtttttaataatattcacaaaagtttttgaataagacgaacggttaaacatatttacaaaagtaaacggcgttaaatatttagggacggagggagtacatgacttacttatcttttgctaggaatagagagtaggcagaaaatatataatgtaaatcatagcgtgaatttaaaaactatagtaggtttttttttaaagaaaaattgagaaattcccaagggtcttccggctagctccacaagatggtgggctagatgacctaggttcaaagcctcaccccttctaattatttgatattaggtcattccctaatattcgagttttttttaaagaaaaatcatctgtgatttattcatgtagtaccttatagtgacgtagataaatcttaaaattttattttcttattattctacgatagttgtaaagtttgcaacaaatatttttcccaccattgcatataggtaataatcacttcatgaggtgttaaattctggctattatccttggtgtaaaataattttggaagcacatagtatgtgttatgtacattttgtattgcctcgaaccatctagtacaacatcctaacaaaaaaatatataacgaattttagttatgcatttgtattgtcaaaatccaaatgcatatatgtatatgccaaaataggccacacccatgaaccaggaagcctctttttggaataatcaacggactcataacagtcactgctgacgtaagccacacacatctccatcgcctataaaagctcacctgaacaacctccaaatcacacacaaaacgcagaagcagctagcttcactgatccacattactaccagcttctt

SEQ ID NO: 57091 - DNA, 1501 bp, Oryza sativa
ctctttacagaatggtcaaagaataaccaaattttatattttttataagatattttagattttgaatagattaatatcttattcaaattactacttcccaatgtttctcatttagacacatgtatatattttatatatgtgtctaaattcatacgagcgttagtaaatctagacaaagattgaagaagatcaaaacatcttataacatagtagaacggagagaatatatgagaaacattaaatattgctttggaagcaatctcgcaaattgcactaccaggagtacaagctactaattcaaacctcacagctggcccgccgccgtatcgacatggtcgcaacccgtagagcaatagggtgggagagcctgggagactggactggagacgtgcaatttccacagattgtccgaacaaaacaaatttcagaagcgttatgggccgttgttttggaacaggatgcaaaaagtctattccgtgtccttcaaaatattatcggagtttgattcatatacttccaccgtaaaacaagatataaaaattccctcaactgttcgaaacaacccaatttacattcttgggcgattttgatgatggtttcgttgtaagtggggctttgacctgtttttcatgtgacatggcactcatatgatattttagcattaaaaaaaataaaaactacatatgaaatccacatgtaagtcatttattaaaacaaaacgtaaggcccacatgtcataatctctctcctcccatcccattttctccctcacccttttatcaccattcctctccagccgcgcgcgtctgcgtacctggcttagacgacaagcccctctagagacgcatcccaccgcaccacctttgtcaaggacagtggacaccgacttaaccgccacggcaagcacgagcctgactaggcaaagaccctggctgaacattggcgagatctggttgggcgtaaggtagcaactgagctcgagaagagcttgacaaggtagctggtggctgagctcaaggagattgctatgactccctaaatctgaagagaaacacacacacacacacacagagagagagaggtggcgtagctcgcaaaacctgtcctccaaactaagctcgacgctccagctgccataggtacgaataagcaggtaggtggtggttaatggataagttgatttacatcggtttaaaaggttgagagtttttatacttgattttattgtcaagggctatgaattaaactcattctatagttgaggtacgcaaaatggacttcaccgaacgggattaccaccaccgtgcagcctagattaacgcagtcaaaaattgtcagaccgatacgaaaagatgccttcagcttctgtaatgtgctaggtacatgtgaattgtctgaggatatatacagactaggtttgccgtgatatccaaaagcccttttattctacctcacgagagtactaagattttctgtgattcaatctagtccgttcaagctg

SEQ ID NO: 57092 - DNA, 351 bp, Oryza sativa
ggagtaccgcgtccctgacagcttagagcttgccctatgattcatggcctggtttcatctcaagtgatctcccgaatggatagggttgcagggttaaggttaggggagaataaggtcaggatgagaaagtgagatgtgtttgtcggcttagagggatagctaggacgatggttgtgtcgcctcagcagtgggagatgatgaggatggtgggcatgtgttgaagctagagcaacacgagatggtggaggccaacggtgtgggagcattggagccgagtacaaaggaggagaattgtggaaatgaggttgcgaggagaagagagccatgttgccaggtgaaacttgccaaaga

SEQ ID NO: 57093 - DNA, 883 bp, Oryza sativa
tatatatatatatatatatatatatatatatatatatatatatatatatatatatatatatatatatatatatatatatatatatatataacccatccagcaaccgggccatgcaactaaaaaaaagggcaactcacgtggctgagccatctttagtcccggttggtaccgggactaaagatcgatctttagtcccggttatttcacccgggactaaagatagcgatctttatttccggattggtagtcccggttttcaagggactacatgggggttaccagccgggactaataagggtttccccaccagtgagaggatggaagaaccgaagaagacggtgttgggtgtttagggtccatggatgacagacgaaggcagcgtttaattacccgtccctaggcttccttgtgtccgttggttccagcttgaacggactagattgaatcacagaaaatcttagtactctcgtgaggtagaataaaagggcttttggatatcacggcaaacctagtctgtatatatcctcagacaattcacatgtacctagcacattacagaagctgaaggcatcttttcgtatcggtctgacaatttttgactgcgttaatctaggctgcacggtggtggtaatcccgttcggtgaagtccattttgcgtacctcaactatagaatgagtttaattcatagcccttgacaataaaatcaagtataaaaactctcaaccttttaaaccgatgtaaatcaacttatccattaaccaccacctacctgcttattcgtacctatggcagctggagcgtcgagcttagtttggaggacaggttttgcgagctacgccacctctctctctctgtgtgtgtgtgtgtgtgtttctcttcaga

SEQ ID NO: 57094 - DNA, 218 bp, Oryza sativa
caactcactccttcccttccaattcttgaatcagaactgagctgattgacttctcaccagctgataaatacaacctaaatggtactcctttgtaacatcccggcctagggcttaataggattaatagaatactcatattaacaagttgcaacttcttttccggaagccaatctccagagaactccagggttaagcgtgcttggcctggagcaatttgg

SEQ ID NO: 57095 - DNA, 1501 bp, Oryza sativa
aatcaatgtcgacaatatccaagaagcttcaagggagactgatggatacttcatcaaaagtggcattgtcactgtgatcaaggacgccttaatccctagcggaacagtcatataaaggcaaccaatcaccactgtacataaggttctctcaaattctcatatttattctatttagagcgtttggacatcaccaattcaccatgaaatgggaagcgtcttttattttccctcttacaaacaatttctaccaaaattggatcgactgccttgcttaatgctagaatttgcttagtagctggtaagcctcatatttatgcttaaataagtgattcttttgttctgtaatgcaggttgggccttgcagcatatggtgatctgatctccagtgcacatcaagcaatcaacttttaacgctgtggtttattccatgctgccagttcaccaagctctgcatcaacttgcaaggatatcataaaaaaaataaaaaataaaaacaggtgccacttaaaggcaccattttactgttactagtatgagcaaccgctctagagcttagaggtgttgtaagtccgaaaaccgtgtctgaaatgtgggtattttgatgtgtataatctttgtccttttgcatgatcagatttaaatatcctgtgtttatttctacctcttctgcttagatgccatttctttttaatgcttgaatgttccatgcattgctgatgaaagaggagctaatttgtgtcatggattttgtccttgatattcacatatatcaaaccaaaatgctacataagcaacctagatctaagggatcgcctgaatatgatggtgtgatttagaggtttaagtgtggcctgcagtctcagattttggtatcttggtgcatgatgctgttgaccattagcatgcacttcagaaatcagaatttatattttccagtgtgtgatttgatctggcaggaactattcatgcccatattgaaaatagaaacatcaagatggatatgcaaaataacacaatactgattttctacagttgagctatcagtcaaatgaacatttgattgtaaatcattttatagtttgtttcgctaagccctctctttgttggatcaaatttacagatgttgaaagcagctaacatgtaggaatgacatgtcatgattattggctaggaagccactgcaatttgtacttattcatatccactagctggtcatatgcacggctgtgcagtgtttactgacatgaatggtagggttcttcccctcaaaacaaaataaaaatgaatagctgggttctgttcatatcacaaacagaacagaacagcaaacaaaacagcctacctaagatcagtaaccactactcactcatgattctgatccaattctactagatggactgatgtcatatgatgaacccaatgactaactgacaaaaatttcttgtctgatgaaggtaactttcagttcagattgaacagagggagctctgcatagaaggga

SEQ ID NO: 57096 - DNA, 1501 bp, Oryza sativa
gcacctgcttgttccgatcacccgtgcgtgcgggatgaacagaaccggggaaatggagagacaacgcaggaacataaggagagtatcgcctaggaacagcagcaggaggaagactcgatctttgagagcctctgccttgcattatatatagagagagatctccattaccacacaaataaatctcatttgttgtgaagattaccacaaaataaatctcatttgttgcgaagattaccacacaatgaatctctcatttgttgtggaggttacaacaaataaatctctcatttgttgtggatgttacaacacaatgaatctctcatttgttgtggaggttacaacaaataaatctctcatttgctttggaggttacaacacaatgaatttgatttgttaatagtgactttattctcgtctgttacaaaatgaaagagcaacaagcaggctcggctcggccggccgtctcgcctcgccacgcccacagccgaggccaacttggcacgcgcgcgtgtgtggaagtccaaccatcacctcaaccggtcaatagggaatctccaatatcaccctatttaagttgaggttcttccacctaaattttcaaggcagtattattgtctctaacattacttgtgggctcttgagattttaattgaattaaattgggcctaccccatttattccaagactctcaccattcatcttgaacatctagaaccctaatcgttgtgcgcaagcaagagtctagcacaattgcaacaacttcatctagtcttggaggttgggaaacaaatcctctattgtagagctaatactgcacaggtgctgtagcgatcaaatcaagccatccgattagattaagcggctctgattctgtccttaaacaccgaaaatatttttgataatttggaaactaacaaactgattttaaggaggaaaagtcaagataaccttgatggagggaaaatcacgaatcctccagagtacttggcgccaaaataatacaggttctccttttgctttcttcctccttgggacttggtgccaaaaggagatacagaggtttcactttgccttgttctgtccagaaactttgatgatcaaataaagtaagccatcagtctccaacgaacaggtatgtatgccatgtcttgtaccctttttgtgatcatgtcctcacaaaaaaaaccaaaagcattgttgtgggattcttatgattggagtggatacactctacactcgtgtagtgctaaacagagtatacatacaaatctgaggccttatggcgaacgactcaaactccaaccatcataattcaaataggtaagatcaatttcattcaggggtcaacatagttttatcatctacatttttcttttctctgactatgttgttgatctcattactgaataggatcttaataatgaccacatagcaatccatatttaacactgtatttctttgttgtaaaaaaaaagagttgatccctgtttctttttacagc

SEQ ID NO: 57097 - DNA, 1226 bp, Oryza sativa
tattgccgcccgttccggggagccgccgctcatcgccggcctccctcggggcccctccgtcccatccggcaccggaaatgaattccttgcaccccggagatactctcgccaccttgaatcgacctctcatcgccccgccacgatttccccttttgctcgccgccggccgccgccgtcgctatccgccgcccttgacctctcccggcgaaatccgagccgttggctcgcctcctctcgcgtctatcttcgctccggtggtctcccctccttccgccgtgcctcgcgccgctccgccgacgcgcgccgccgcccgccgtccatccggccggccttcgtcttcctcctctcgccattcgacgcagccgccacgtaggcaccacgtcggctaggccgagtcaacccgtcggcctccctcccccatcccggtgcgcgcggtccacggtgcgccagccgccgacgcgtgggcccgcctcttcccggtccatccggcgcatgcggcatgagccgagcctactaaccctagcaccgcaccccacgtgcactcctcccccaccgtgaaccaggtcgccgccaagtggcccccgtcctaggacccccacgcggtggatccggtccaccagaccgcctccctctccccacccaagccctaatgggccaatctcctttgggccgtgcctcacgctcggcctaaaaagtctatatttcctccctccaccaaatcaattctcatacacaaaagtccatctttcccccttgttggccccacatatcaatgagtaattaaagaatattcttgggaatactcttttccataaattcaatagatcatttatttattccaaaaattccataaaccatttctcctattccagaaattccaattaagcttccgaaattcatatcttctcaaccgttcattcgattgactccgttccacttcccataattccgtaaaattgagatctatttaatggcactattatttagtctaaatagggtctttttcttggtcttttgtctaggtttttgattgtttgcgtatagttacggttaccggattttcgtcgatcgtggatttctcgaagattcgtgaagatcagtgaagaccttcagcaaggcaagtcaccctttgatcaattgctcctataattgaaaaataattattattttgtttgcaacttgcattattagaatcacacacttaacttgcttggcctcggtttgca

SEQ ID NO: 57098 - DNA, 1501 bp, Oryza sativa
gattttggttgaattggatatcctattactacgaatctaaatccatgtccatgcatccaacaaaaatatcttatattttgggacgggggaatatgtattttctaattaagttcttattattttaatcttattaattagttttatgtgttttatattgtctagtgtaaactacgtgttgttaattacatggtttaaaaatctatgtgtttttccaattcaaaatgtgtgttgagtggccaatagctggtccaaagcaatgtatttcttttacttgttaaatacagttaatttgggatttgaattataagttttgttataaatgatctaatagtatacatggataaaaaaaattagctatatatatgatgtagatgttatagttgttcaagaaaaaatttacaacaaaatatgtttcaatctaataaggcatgaaaatagaaaagaggagatgcaccggccggttatgggtgtacgtatgtgcagtttgcagcacatgtacctgtacagggccttttcttttattattaaagtaaatgcaatgaaggaaaatagtgggtcctttgttaaataaaaaaattggtgggtccaccttatttaaaagtgccacgtgttgaatcaagagcgtttgtagaaagatatgtggcggcttaggagtgtttatatgaagtttaatgaacttttagtatataatagatagatgtatgtggacaatttttacatacaaatatattttagaaaacaaacaaatgcctttacattttgcgaaatggcctgtagcctagtggttacaagagcctcggtagcacctgaggtcttgggttcgactccccatgggagcgaattgactccccatgggagcgaattttctaggatttaacggcgctgtgctttcagtggtagacgaggcgctgtgctttcagtggtagacgaagcgaggcgcatgtggtgactttgtcaatctctccaggatttgccgatccagtcttcgaagatactcataaggttcatgggggtgagtgcgcgtgcgcatgtggtgactttgtcaatctctccaggatttgccgatccagtcttcgaagatactcataggattcataggggtgagtgcgcgtgcgttgtgagtgtctgcattgtactgtgtaattctaaaaaaaaaggcctttacattttagaatactgtcatacagcaacagagcgagaaaaaaccgggtcacttgcacacctttcaggccgagcccgatcgagacaccggagtgtctgcaaatgcgtctccgaatacgaatacgattacgaaatacgacgaaatggactcggaataccttctccgagacagacttgtacacgcacacacgtagtgcaagtcgaagtagacgaagtgaccgtatcgctataaattcaacgctcttccgcgcctcgtctcctcaacacaaaaccaaccacgtcctacgaattcgatcgcttcacaccaagaaaacctcgctagctagcttgtagctcgcca

SEQ ID NO: 57099 - DNA, 1501 bp, Oryza sativa
ggggcttcgaagttcgaacggcgctgccggcctgccgctggcggtctggcgctggggaggggatggatgcggcggccggcaactcctcttgccagtcgccgccagcgccagtggctgaggaacggaggaaggggattaggggagggatcggatctggggcgtcaggcgctcacgggccacggctcgcgctcggctcagctcaggacttagggtttctctctttcatgggccagacaattgttaatgggcttgggctcgcttagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcctgagctttttgtccacccctacgggagaatagatgacgaaacaaaagtcgtgtaggagatggaaaaaaaatcgatggagcctatccgaccaagtatccatcaatttagtcttttattctagcagttttttcctcatatgctttttttatttttacagacgatggaaatatttttttctcgcgtgtttttttactgactacggaacttttttttctagcgcgttttcttttgcgcttttttctggcatttttttcctcatgcgttttttaaaccgtttttattttctcgcgcaattttttttcttttttaatatacggtagaaacttctctttttaaatatttagattagattagattagagataaagaagatatataaaagaactactaaaacgacgaatagaaattagacttttttccgccgctcttttttccgtcctttttattttttttctcttgtattttttttacgaatggttttttggccactttattagtgtcggacctttcataggattcgatttttttatcgagtcacatataattcctttttctttggaatcagatattttttattttttcgcccttttttttaccgcggcgacggagtcggattagtttctatttttccttttttttatcggacagatttgtttttttttcacccctctttttatcggattttttttattttttcgcttggttttttcgttcggtttttttcgtccagtcgatttttttaccatgtcatatataatttctttttctttggaatcggacagttttttaaaatttttttcgccctttttttaccgattcgtttcgtttttttccttttttttgccccgtattttttttgatcggactgatttgttttttcgctcggttttttggatcggacttttttctcccgtttttttcgctcccttttttttatcggacttttgtttcacccggtatttttcgctcggttttttccgcccgatttttttttgacagacgaaggaatcatcttttatttttttaagtagtagagagtagagatagagatagagatagagaagaga

SEQ ID NO: 57100 - DNA, 1501 bp, Oryza sativa
tttgggacaaatcttgatggctaaaagttgttatattttgggacgggtggagtactatatttatctaaacttagtcgactttgaccaaagttaaaacatcttataacctgaaacggagggagtagttaggtcttttgtaatgcaacgtgtttatatatctcggtccaagatataaacttaacatggatactctcgtttacagctagctgtgttttaagtggtaagagacatacccttcaacagcaagatattcatgataacttcgtcgatatcaagatgcgccagcctagtcttcggaggttatcataggggtaaaatgtgtttgtgcgcgtttataaaagtgagtgttcacgcatttatatcagcgcatgtgtctgtactgtgtattgaaaaaaaaagaagaaagaagaatcactattgtatcaaccgtcccttcgaaagtccgagttagaagacttcacatacgccggcgaaacgagtgaaaaaccacccacagagaacgcacgaaacggcgagagagcaaaaacaaggtttggttttgttgctttctttccaggaggccggcgacgtgaaagggttccaacaggtggatgctgaccaacgcaatgcgccgacgaatcgaattaatggttgtttaaattttaattaaatgggagaacagaattttagcctttgatgatggctccatggccccaattatttggcttttgcaaaaggagacaagaatttagcatcgatcacccactttaatcagttctttaattgacgcgtgaaatcgatcctaggatttgatttttttaaaaaaaggttgatggcacatagcatgtttggacttatgttgctgggattaattttgtttgtgatttaatcttttgttttttttcctccgaacatttctccaaggatggcccacagactgcacatgtcactcaccacctggttctagatggtcactccacctgaccaatcacagctctacacaaaactcttgagcatcaacagtccaacacatagaccaattcctctaaaattgtgtggaatttcgataaatgttcacaaacaaagcccaagagagggttctgtacttctgttgtgatacttattatggtcagatgtatcaaatatttttttgtgtaggcaggttgattttatttttcttaaaaaaaataaaaataaaaaggtcacctgcatcctggcaacctagaaggccactccacttgaccaatcacaattcacacagttgcacccttgaacatcaaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtcca

SEQ ID NO: 57101 - DNA, 1501 bp, Oryza sativa
ttgaggaatccaactaggaatcatatttgtgctgtaaaaagaaacagggatcaactctttttttttacaacaaagaaatacagtgttaaatatggattgctatgtggtcattattaagatcctattcagtaatgagatcaacaacatagtcagagaaaagaaaaatgtagatgataaaactatgttgacccctgaatgaaattgatcttacctatttgaattatgatggttggagtttgagtcgttcgccataaggcctcagatttgtatgtatactctgtttagcactacacgagtgtagagtgtatccactccaatcataagaatcccacaacaatgcttttggttttttttgtgaggacatgatcacaaaaagggtacaagacatggcatacatacctgttcgttggagactgatggcttactttatttgatcatcaaagtttctggacagaacaaggcaaagtgaaacctctgtatctccttttggcaccaagtcccaaggaggaagaaagcaaaaggagaacctgtattattttggcgccaagtactctggaggattcgtgattttccctccatcaaggttatcttgacttttcctccttaaaatcagtttgttagtttccaaattatcaaaaatattttcggtgtttaaggacagaatcagagccgcttaatctaatcggatggcttgatttgatcgctacagcacctgtgcagtattagctctacaatagaggatttgtttcccaacctccaagactagatgaagttgttgcaattgtgctagactcttgcttgcgcacaacgattagggttctagatgttcaagatgaatggtgagagtcttggaataaatggggtaggcccaatttaattcaattaaaatctcaagagcccacaagtaatgttagagacaataatactgccttgaaaatttaggtggaagaacctcaacttaaatagggtgatattggagattccctattgaccggttgaggtgatggttggacttccacacacgcgcgcgtgccaagttggcctcggctgtgggcgtggcgaggcgagacggccggccgagccgagcctgcttgttgctctttcattttgtaacagacgagaataaagtcactattaacaaatcaaattcattgtgttgtaacctccaaagcaaatgagagatttatttgttgtaacctccacaacaaatgagagattcattgtgttgtaacatccacaacaaatgagagatttatttgttgtaacctccacaacaaatgagagattcattgtgtggtaatcttcgcaacaaatgagatttattttgtggtaatcttcacaacaaatgagatttatttgtgtggtaatggagatctctctctatatataatgcaaggcagaggctctcaaagatcgagtcttcctcctgctgctgttcctaggcgatactctccttatgttcctgcgttgtctctccatttccccggttctgttcatcccg

SEQ ID NO: 57102 - DNA, 1501 bp, Oryza sativa
ctggtaacgattcccacaccacaaaaacttttcacaaagcacaggtaatcaaatctacgcaacgggaaccacctcacatctgcccatgaccgtaggcatggctgttcgaacagttagttaacctctgcagaggggtacactttacccacaagacacgaacttaccccagacactagccggtgtcagaagttcgcgacaaagcctttcccaagccgacccagggttacctcatgccacatagaaggatcaaatcctcacataaatataggacattttaggcattcacaaatcaactccaaccaccttgatcggtaagtgagcaagcttctcgtccttgccttaccaggaacccagtttgtccgaccccgccctggcgttcccaactattggcatgcgaggtttccctgaaccgactagttacttagccagggtgtcccattccaccttgtggttgcactttgattatgttcgatgagtttcccacaggaatcggtccttatatgcgaatacaggacagtgccacataggcacaacccccgcatcacgagttttcacaattcattttattttcaaacacaccgacaccacatgtcgggttttcaaggcttctcaaacccatttcccaaatttttgacaaacaacggtgtatgtgggataattggtatacgcgctcagagagcacggataccaaagtaccacaatggtggagcgacaagggatcaaggtatgtcagcctacaggaagtagtgcgactacttggtaggtccgtcggtttagcatgcaaaccgaggccaagcaagttaagtgtgtgattctaataatgcaagttgcaaacaaaataataattatttttcaattataggagcaattgatcaaagggtgacttgccttgctgaaggtcttcactgatcttcacgaatcttcgagaaatccacgatcgacgaaaatccggtaaccgtaactatacgcaaacaatcaaaaacctagacaaaagaccaagaaaaagaccctatttagactaaataatagtgccattaaatagatctcaattttacggaattatgggaagtggaacggagtcaatcgaatgaacggttgagaagatatgaatttcggaagcttaattggaatttctggaataggagaaatggtttatggaatttttggaataaataaatgatctattgaatttatggaaaagagtattcccaagaatattctttaattactcattgatatgtggggccaacaagggggaaagatggacttttgtgtatgagaattgatttggtggagggaggaaatatagactttttaggccgagcgtgaggcacggcccaaaggagattggcccattagggcttgggtggggagagggaggcggtctggtggaccggatccaccgcgtgggggtcctaggacgggggccacttggcggcgacctggttcacggtgggggaggagtgcacgtggggtgcggtgctagggttagtaggctcgg

SEQ ID NO: 57103 - DNA, 1501 bp, Oryza sativa
caaatcctaaacataattgattttgaagaaagttgcatgagtatggtgaagcaaaaacctgttccatgataacttcagcacgcatcatccaagttcctctgcttcactctgcatatatatatattcacattaaaattgtgatattcaatcgatgtgctgcaacctattcatggtgatggaaatgggaaatgtagggaggctagcaagggtgtatgcacgtgtagtagagaaggaaagaagggcaaggttggacattggacaaggcagtggtgaggggagataaggtgcttttaatcccttatgctgtcattgccagtgcatctaactttggaatcatagatattaacaaaaattgttgccatattaactgatcagtttttcttttttctttagtcacaaataatggttcatttttggattttttttgaggggaaacacatgtcttttcatatctaaacataataaggcacatgattccttacatcatgactacttcacaggattcatttcaccacattatatcttgtctggagaaatgacatgaaaaataaacaggcgatattagaagatgattctttggaaattaaggagctgtcacaagtgaatgctacatgcattgtgtttgatgaatttgggtaagtatgtatttgcatgctgaaaatgataggtggctaggaataaatgtcatttattaatatatggcaatttagtgcccccggcaaaggataaaatgaaattatgggctgtttgaaaactgtagtgtgatgatacactagtaaagctttgcttcatatagcaacaattatcaatgatatcaagatacctgagttttggctgtgccttgatgttgattgttgagaccaaaagggagggggccaaaaaggaaatggttaattggatctatgtcattgcaaatttggtcaattaggaaaaatgtcttttatatctgtgatacctgttacatgtcattgtaattttgtaaaattgaaactatgtcattgccgttgaatattttgtcaacctccgtctaaggtcatgctttcttcctccttggtcttatgtgtgtcactataattttgtaaaattgaagccatgtcattgtagttgaatattttgtcaacctccatctaagaacatactttcttcctccttggtcttcttcttcctttgcagatggggaggagatgggctggccgcagatgtggtctcatatttgagcacgcatgaagggagggagggggggattgtcacgccctgaagtttcccccttttcttgctaaaaaaaattggttaaataaattgctcgaagaaattgtttaattaacctagagttgaatccctaattaatcaatgcaattaataatcggaaatggcgtggtggaatttttcttgagttccccatgttgcaatatattaacaggatttttagtggaattttcagagccttgtaaataatttttaccaattaaaaatcactaaagtgcaattttaaatcccaggg

SEQ ID NO: 57104 - DNA, 1501 bp, Oryza sativa
ccttccacggctttcgccatcgtagatccttgatggtgactgccacaatgattgcgggttgtcggcgtcgatggttgatgaggactgcacggacgccaccgcctcactgtcgtgtcagctcacgtttcagtttgacctcaacctgccgcctatcggcgtcggcgtcggcgacgttggttgtgtctacgacaacgacgagctaaggctagaacatatcccgtcgttggtgaaagaggaaaaggagaaaaatatttggttcttcccttctcttgtagccgacatgatccctcacccctcctctctgttgtttttgtttacctgatctggtgacgattaatgtgccctgatctacgtatctgccaacttgttgctggtgatagatgatgattgttgcttctcgcagcagctccctgtggctgtggggggaggaggagatggccgctgtttacacccaaatttagcacctatggacgaaatagaggaaaattatcaaagtttgaaaactgacgggtttccttcacagggccggtcagaccacaggtgtgtgggcggtctgaccggctagtagggccggtctgaccgcaagtatgtgggcggtcagaccgtcaaggtctgagtccgagtttgttttcatcgggtctcgggtttctttgcccgggaaggtaggttttgtgtttcctttggtttctatcccgagttggacgtggagaagggcctgtagagggcaagaccaacctctatttaagggacaaggccggttcattgtaaaacccccaaatacaattcacttgaatcgttcttttactatgttttttattttaccctagttttaatccatctttgtcggtttgcgccgtaaaccgtccgccgccgctgcgagagtgcgacacctctttgtagatttgtcctgaaaaccttccgttttgcctatgagacaggttagttatcctcatatcgatctaaatcggcttagaggctgatttttgatctctaaatcggctccgctaaccggtttagctgtttttctacaaaacctatcttgatttggccatttggctagatcgaggtggttggcgactccatatcaccgcaaggcgtttaggtgctgcgatcgtaattgtcgacttgtcacaaaaagttatcaacacaatttttggcgactccgctggggaacgatctaatcggccatactagggccgaatttcgtttaatctaataattactctttcgtcgaatcatcgaattagtttcggctaaacagccggaattaacttacactgtaattattattgtcgccgacattggttttgtcttcaagcttaattgttctgttcggtcacggctagacgttaaactgtgttcacacagggagcagcggccggattagcaacattgtttcctttttgcttcacacggcaacagaaagatttgattgatcaaagctggtactgtgcacgtgctaaaaaaagatcaggctatctaagccgatctacttctgttc

SEQ ID NO: 57105 - DNA, 1501 bp, Oryza sativa
gcagaagaaacgaacagggctttaagactagattaactgaaacatatgataaataggcaggcaaatatattaatcaaatcagagcaatccaagaagtccaatgtactgatgctgaacggcgccaatgtaaccaacacaattgcctgggccggtggaatattggacttaccccttctgctctgataaaaagtaaaaaaggtaaaaggtagcgatgcgccgaattgtatttgatcatggagatagtttacaatgactctgggtacatatatttatacccatggggaaatactagtccttacaggacaagaaagaaacatttctaaaaaaataaaaggaaaacataaagtacttatgggacacttgaactcggtcacttctgtataagctattaattttcttaaccgaatatagcaggaatccgactattggcggcgtgataattctcttaggggcttaccaaatttcactgttaacaacggcccattaatgaaataaattggaaatgaattataaaagaaagtgaacactcactccatgaattattagtgacggcggccgataaaagaaagtgaaccttcactcatattgaaataaaaaaaatattagttttaagacggcgggcaaaaaaagaaagtgaaccttcactcatagtatgttgaaataaaaaagtgaaacatcttctcagtctctatgggggcaattaacttaaaataaaattaaaacgaatcatcaccttaagcatcatgttgcaatgaaatttaaacattgtctcaagctcaattagtgaaataaactgaaaagcatttattatgggtaaaataaacttaaaatcatttgatatgggaaatacaaataactaaaacatcacctcaagctacaatcatctcaagcatatgttgaaataaggttttatatattttcatacaacccgtcactaattacaagtaatatgagaagagatgatgctattaatatttagctgaaatatgaatggaaagggaatcttccaaaaaggttgtcatccaagtgagatcaaaatagtttgcaatggtggtagcacgcaaaatattgtcaagatctcctaaagatagttatagaagtatttgaattgttattttatatgaataatatatatgaatagctcatagtccatattgccgatgagttagatgccctctgtattaatctatgcagttttttctaatatcccatcaactaattttcagttcttttgatatatgactagccgctatcctttgcatatataggtataccgttgcattgctagctcaatagagagcgaccacaaccttatatacacacacccgtttatatatacacccgtttacctaaaccatgtcatgactcatgcaactcagattgttgatcatgcgattgtgcggagatcacggtgtcacgcaaatgaaaaaacctcatcaacgcgaaaggcccgaaggatgaaagtcggaatatatatattttctacgtctctcatatcagg

SEQ ID NO: 57106 - DNA, 341 bp, Oryza sativa
gcaattaccctgcaggcttttttattatacattatatcttttagttgtacagtggtattcattacaacagatttttttcacactgtataagttgatgttaccattgcttggacagcgttattcattcctacctgtaaagctatttttgattgataagatctaggggtacaatcaatatgaaaagaacttaacatagacaaaattcagttttggtgtagatcaatatttcaaatggttatgaactacagagtgctaaatatatcccctttagtgctgtttttttattaaaaaaaaatcgttggctaatatctggttggtgtacgtatatatccctctctagg

SEQ ID NO: 57107 - DNA, 308 bp, Oryza sativa
ctaccatgattcctgggtattcccgggaatacccaacttatttttttttatcaaaaagcaagtatacttctagtatatacacatgtacacatattagtgcacctaaatcctcaattcttcgatccatacacagcccaaccggcctcttgcaacgcctcctaccaacccgacccactccgtcatgacccatttatcatacatcagttgacccatttagccaccactcttctagacggccccctctcactctccctccgtgacccatccctccctggctcggctccttcgcgccgctccccatacctagg

SEQ ID NO: 57108 - DNA, 221 bp, Oryza sativa
gagtttaggaacctagatgacatacccctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttt

SEQ ID NO: 57109 - DNA, 229 bp, Oryza sativa
ttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatg

SEQ ID NO: 57110 - DNA, 541 bp, Oryza sativa
tgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagta

SEQ ID NO: 57111 - DNA, 1501 bp, Oryza sativa
tatggaggtcacagatcaccgcggcgaaaggtgaaaatctcgcaaaccggggcttttggtgtgtattcattaaaattgctgactgattagaggacaaaaagaacaatgcaggagccttgcagttgctgcagctgcaagaggaggcctgccggcagagcggtaaggacggcttggccaccgagagggatgtcgatctgcagatgaggatgaacaaagacctgatgatgagctcactgtggaagctgaatattgttgatattgaagtgacccttctacacgtttgtgaaatggtatgcctcaagatatcatagaaatttgcagtgatatgattaatagttagttggtagtatctgaactgcgatcgccaagtagcacgacatgcctgtcttatcttccaggttaacatgtcaaaatgattagtacattaaattgaattgattctcttgtacttgttaggtgttgcatgaaaacaatgtcaagaaagaggatctcaaggctcgtgcaatggcactgaaaattcttgggaagatattccaggtatatgttacttggccttttcattaggataattcataccgctacatgagatttattttatcataatttgcaaataccatattaattcaattggactacaaacagagggacaaggaggcattgccaggaccatcaaaaccgaccattctcgatgatgacagcagctctgatgaaagttcagatgacgacgtggctcggacagtgccttatcggactcctgcagttactcaggcaattactaaactaagcagcttttatgttgcatagcaaagcattgcataatcaagtgcctgctaatattagttcccatgttttgtggttcagggaattggcaggttattcagatgcttatgcaacccagcatatgatgttgacgatgactttgaaccacgcaaatgagtggtaaagtagcagagaggttgcaactatttaagagatccctgaatctttccagattatgtgcttctgaacagttggggatcatgcatcaccataatttgtctgggtgtgcattgtagattctactgcagcactggtgatcaggccattagctcaaaatcgttctttttctgtccatgaacagtagattctttcttggtttttgatatagattttatcgaattgtgtggtgtttatgtaattgtttggtttgggagttgtcaaaagaaagaaagcaagaacaagtgtaactggaagtccatttctctctgattttaaaatcacatgtaaaactctgacatgaaaaatcaacttttgatcctatcgtctgcctactgtcaccatcctctgctctaaagatcttctatctcatattgacatccctgattgctgacctgccagatgaatgctgtcaaactccaaaaagagtgatctactgaaatttctttgagcttctgctagaaagatgctgtacaaaagatgaacagatagctcaaaaagctcattcatgcaactcaagagcagt

SEQ ID NO: 57112 - DNA, 1501 bp, Oryza sativa
acgaaaataggaaggacactattgcataggacgtccaggtgtggatgctgttgtagacaacgtccagatggggacgcttcttacaagggcgtccataatgctgcagttgaagaccccacagagccgtccaattcaccggactaagattggactttggatccaatcacacaatggtcgaactctgcctcgttactcctatgcagactattgtctcttgttgattgcttgcttgccgagtaggcaccgctctctacctgatctgccagacagggtcgccatcccccggctctccttcaatgcttccgctgttccgcatgacggacactctactcggggtcatatgtgaacagccaccacttttattttgagatatttgattagtttggtttttgttctggtccattgtttactacgcatcgagctctctgctgactgaatcttgagaagcggccgccagatgaactgcatgcgaggttttcgatcgatgctttttttccttttgcaacaagccagagattggaagtcatcgggcgacagatgatctgatagaaggaggatgtttgcgtcctacccttcgtaattttgcattctttgtaaactttctattgcagaacatatacacctgaataccaaaatctatgaactgagcatacttgctcggccagccacctggagtgaggcgatgcctggacttgctgttaggaaccaagaggggcggacagacgacgcaacacaagccggcacgagtgggttattgttccagcatgactcaaccagaacgtggatagcggctgcgacctcccggtgtgaaggcaaaaagcggcggcgtcctctccggattcgagagccttcgaggtgagttgaggtgaactgcaatggcagattcctgacattgtggagacggaagccggaaggcggctgttgcagtctcccagagtcgaggtgaacggcgggcatggcagcaccttgcccgagccctgcaccaacattgggcctgaggagaggagagtcgacgatggcgcctctccgcatggcggcatgggcgccccaaaccgagcctggacgtgcttcggtacagcgtccacctctggacacttcttggaacagcgtccaaatctggacgccctttgaaacaacgtccatcctatttttacaaattcaatttaagatttaccacttatttaattcaagacttattaattaatataaataaaaaattcggttgattaggtcttatttttccagcgttgcatgccgcggttagggcccacctgtcagttagtagcacgtgtttgaatacgaaaatggcaactttaagttaaatgttattatttaaatcatttattctcaatatctctaattttattgggtgcatgtattgtatttattatgatgatatgaacaagaaaaatgataataattggtttttggtctttggactaaggatagttatgtcttgtattttaaaatagatggagcattgcccagttttgaacaatat

SEQ ID NO: 57113 - DNA, 1501 bp, Oryza sativa
agactacggggtcaaaacaagtcactcattcttcgtcagaagttgcaggcacgggtggcgtggcgcattgagagatgctgtgtcctaatgtgcgcccccacatctcattcgaggcggcgccggttgccgatgaggctaccaccccgagcaggtgcattgcccacaaagtggtgtcgctcgctagatccagcgaacccgaggctagatctggcgagcttgtcggggcggcggcggaggaggaagaagaggtggtggatctgatgacctaacctcgttgtcgtcgccgttccgtgccactgagtaccacagcaacggcagctcgacggagaggaccgcgccgtccccccctcacgcgccggcgagctcctgccgcgccctcccctgcttgggctgccggtcggaggaggaagaggagaggtggagccccaccggcgctatcacagcttcgaccgtgccgccagattaaccccgctgagctcccgctgcaccatccccccctcgcgccagcgagctcctgccgcgccgtcccccgcttgggccaccggtcggaggaggaggagaggtggagccaccgtcgctgcttcggccatgccgccaccgctctgcttggctttgtccccagagacaatccgacgctaccaccttgcttcctctatgctagggaaaactggaaaaggcaaacatgcaaagtgatgaaaagtgaaggagaggggatgaaaagtgaaggagagatagtgctgagacccaccacaagtgacctgcactgtagagcatgtagcaaatatggttcttagtctacgtggtatgtgaggaccagcaaaaaaaaaaaactatggcgcactactattgcccttaccatgagcaactcaaacttggattaggccgtgttcgaacatcccatttcccaacttctactttttcgttttccacggtttcctgaaccgctaaacggtgtgctttttaacaatgttatatatgaaagatttttttaaaaaaatattaatctatttttttaaaaaaatcactagtatttaattaatcatgtactaatgaactacctcatttttcgtgcaagagaggtgggttaggaacccacaggttccaacatagcctagcttctgtttctactatgccatctctttttttcagtaaatggttaaagttgtgggaggcgtagctagctcttattgtggacttgcagttcagttttggaaggtccctgatagtggtttggtagaacatgaggtcatggtcaagatgatttgatgactttgcaaagacatcgtaatgacgcatgccaggtatcagcatgtcaccaagaaacatattaaggctacacctccaaacaactttaacttagttaaaatatttcaaaaaatgcattaacatgttttttaggtactagtgtccagtgcttgtagtgttttgtacatgtatctacatcatggagttgtatatagtttgtggcttttatttttgcctaatacttaaagtccccacc

SEQ ID NO: 57114 - DNA, 1501 bp, Oryza sativa
taaattttttgaataagacgagtggtcaaacactacaagcaaaaactcaaaatcccttatattatgggacggaggcagtaggagtttatgtgtgtaggaaaattttagatatgatgtgatgtgatggaaagttgaaagttgtgggtgaactaaacaaggccttacagtatgagattaccatgacaagtactctctccgtcctataaaaaaaccaacctagtaccagatatgacatatactagtactgaaatatgtcacatccaattctggattcgttttttatgggacggatgtagtaccagataattgtgtgatattgaactcaaaaaattgttcgaatttccctttgaaactcttgcaggatccccttgaccacttccttgctttgcttcgacctactaggaatctccttatatgttttcagaccaactaggatttgatattatcaagtactataaacctgaacgattgtgtctaatccgatattatattgttatgttttaaaacgaaaggagtacttcacatatgtagaccttctaatagtaaacaagcaacaaatatatagtttcataaatcatgcagagtacttgttcttatcatacttgttcacaaatcacaatccttcttatcacttttttcatatcaaacccccaaaaaaaaaataaaacgagtataagtatactctcaatccatatattccactcagactagattgatttgaaaaaaacatggatttcagttgggccttcatgtaatggataatggaaaatgtagtttttgtaatggataatggaaaatgtggtttttttcagttcatcaggaaaaatgaaaaccatattcactgttctcttctgtctaaaggttcctttcaaacatatgaatgtgcaaaaaatcaacgaagctaacgctaactggaaatacatggactactttgaactaaacttcagttggctggattagcaaatgtaagcacgtcaactgaaaaacacacgactaaatttagccgatttaagccaataccgacatgtggggccagggttcactatacccccacatgtcagcacaccatgattgatccaacacgaaacgtgatgtttatcaggctcctgcaggaaatgtcagggccgcgcttttctttatctccagcttttgcctccttttctcatccttttatttattcttctctatttattctcatctttacaagtccaggttaaccaggactaatatttgcagagactagttactgaaactttcaattagattagagagaatctattctataccacttagtttatagtagttcaataatttaccactgactttctctctttctacaatatactggcgactttatcaattgctctacaatacgctattgggttgagcttatttttcaataatgcctaaaatacccttatggacatatataaggataacagttgatttatatcattaaaagttttaaaaaaatatgaaaacatttatatggactccttac

SEQ ID NO: 57115 - DNA, 1501 bp, Oryza sativa
ccggggcggcgatgacatttacaggaagcgaagtatatggaagatcagaagatggatggattgaagcagcgcgcctttatgggacgcagctcttggttggtttcttgggttctcgcgctcctctttgcgcagctgcggccgctggcgcagtgacagcgggtagctgtatggcttgtgctgggcgatagagtggcaggggctagctacgtgcctagtagtaggctagtaggcttgtgaagttttttagagagagagaagagtgatttgctgtaggagaagatggtgagaggagaggagagagaaaaggaggcgatggccgatggacactgagatgtcacatcagtgtcgttgttttttttttctcagtatctatctggttggcctagagttggtaggagtagaactcgagtcgcaagtcgaggagcatggtctcactcgcctatgacatgtggtggtccactatatttttcatcagtcgagtatactcataagtgtagcttacgagtagctgatgcagtttatacttaatttagtctctctcattaaaatataagtctttaccatatggacttatatttttataagagggactaaagtttagccccactttagtccctccaaccaaacaccaccttactccggtattcaactagtagctagcaagcgcatgtttagtcggtgaaatttgtacgtggtttgaacggatgtcggaagtgttttcagacacgaataaaaaaattaattttataactcgtctagaaaccgagagacgaattttttaagcctaattaatccatcattagcacatgtggggttactgtagcacttatggctaatcatagactaattacactcaaaagatttgtctcgtgatttacatgcaaactgtgcaattagtttttctttttttctatatttaatgctccatacatgtatccaaagattcaatgtgatattttttggaaaagtttttaggaactaaacagcccctaactgtatattggtgtcctattattacctctgtccacagttactccctccgtaccataaaaacccaacatagtactgaatatgacatattcgagtactatgaatctggaaatacatctgtccagatacatagtagtagaaaacatcgcatccaatcctagattcgtttttttgggacggagggagcacaatagtactggatatatctcatccgattctactctcttactctatattttacgggaaaaaatacccgtacattgtaacaggtgaatgctattttaatcatattattgttattttttatctaaaaagtatatgggatttttaatttgataatattgatatctaattcagaacccttattaggatgatagctatatcttgtacgttgctttcttatgccagacaagaattccaaagaaattaggactacgactctcgttacaagatagcatgtgagtttttttaaggattttttatatgactccttatgtatttccaaaagcga

SEQ ID NO: 57116 - DNA, 476 bp, Oryza sativa
aggcaagatcgaagctgtgcggcgccagtgaagtgttgggggggaaggggggaaggattggtgggttcttggagaggcgaggagagggggagagaattccacgagattctcttctctcctctcctcttcttgtctcgtcttctcttccccgcgtaggcgtaggtgtgtgtggccctctgctgctgggtgcctgtgccagcctttctacctgggcctactacgctatagaatgacctgcccatagttaaaaaacatgatacaccttttttttcggtttggaccctgggtttttgtatattatcattgggtcggcaaatctactcctcccaaaatagaatttgttatattttagaacgggggtagtagtattttttttataaaagaaatagggtataacgcaggtgctcacatgagtacacacctacctctatgaacacgtatgtgcatgctctatctctatgagcatctctaatagg

SEQ ID NO: 57117 - DNA, 1501 bp, Oryza sativa
ttagcttcgcagccagcagagctgggtcctccaccagggactgcccaagaacattgtccttgagaatttcacctatatccaacactgtgcccaatgatatattgaacggcacccgaatccgaacaacctcaccaacaagggttgaagctgggcatatcgaacggcacccaaatccgaacaacctcaccaacaagggttgaaggtatggctgcgtcgacatcctgtgcactctgtaccgtgactatgccatactggggaatcggtggtggtggcggcggcggtggcggcgggcggtgctctaatcgggtctccagaagatggctcatcgtccctccgccgttgctgccgcgctcgacgtcattgtcgccatcttgacggggagttaccattgaatatattttgataatatatttgttttgtattaaaaatgttcctatatttttctataaagttagtcaaacctaaataagcttgactaagaaaaaagtcaaacgacttgtaatatgaaatgaaggaagtactttaaaagaagtagcggtggtggttgtctggctgacaccaccatctgctctcattgtagttttgtaaattacccccgtaaacttctatttactaaaaatcaatcaaatctatcaatagatttgatctattgaaaaatgataggtaacacattttatggcaaaacacatgttatttctggtacctattaaaattataatatatattttatccgcaacaaagaacgagcattcagctttttttaaaaaaaaacttggggaggaattctgtacgatgtaaacctgataggaacatttggccctttggattgaaaccaagggttagagtttttcaaatataaaatactagtaagttcccaaagaattgctagatatatgtggatttcttttaggaaagtcccttgttacttatttaaacaaagtttttgtagataaaaaaagttgagcattaaattattgtagcaaaaaaaactaattacatgtaataaacttaccgttcataacatttacaaaattacaggcataaacattaaaagtctttaaagttagataaatcgtagttaaaatgaacaaaagttgcacattgcatatgcgcctaaaatctagaaaaatactccccttttctttcttacaagttacaaagggagttaaacaactctattaatcaacgtttcccttagcaaattctttagacaaaaaacatcacgaacaaaggtagtataatacaaatgaatcaaggaccatgtagttttgctatgtacaaattcagtttgtttgttctatgtactcatcagatcacactcggtgggctctccggtcgtttcaccctgctcgcgtaccggccgtcgcgcagcgggctctccgcgtgcacggccgacgtgacgtgcttctttccccgccggctccccctcgccggctcgtcgtcgccggcgtcgccggcggcgctactcccggccgccgccgccgccgcctcctcgccgccg

SEQ ID NO: 57118 - DNA, 1501 bp, Oryza sativa
tcactgtagaactcctcctctgatgaatgattgcaagatgagtatatgacatactcagcaagccacgcagcaaatatgcaagtgcaatggataacaaatgatggcataatataggctcatttgcataaacagcatttaataagcaattgagagaatagtaaaacagttgagtaattaaacaatattaaatcaacactatacaacacacccgtgttgcatagggccaaccattctgaacaaccaatcccggctgcacagttctatctccaaaccaggaatataccattccaaaccaggagctaaacaagttattaacatcatcatttaatatagtgagaagtgtgagactaatcactaaagacattgttagacccgctcataacctcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcccggatcataatcacccccttaaacaaggcatggactccccagcgacccccgtggccttatctccgccacttcacagtctggtgctctactatgaaccatactatacagaaagtaaagccgttgcccacgctggcttgtggttggcacgattaatgtttcacaactaaaaatcgtgaaccggtccttaattgtcatgagcacgaccatcaaaaccatgtgctcacaacccaccattatcagattttagttggcaaattaattaattaaccaatcatgattaaccatcatgagctatcattaagccatcattaagtagtagtaaatcataagttatcccatttatgtgagctagtgtctctaagcatggctaagcatcctaatcactttagctaaaaccatataatgttctagctaatcaaattattaaccaagtgacaaagaatagggaatcaatagcaaaagggctataacaaggcaataggttatttcgacccaatgacattcgaaaataaatgcaatagttgaatagaaacaatagctttaaacgggatcaatatgctcaaagggtcgtttgggatctgtgtgacttgccttgctagccttggaactctttaaagtcttctcctgcaaattcggactctccgggaacgtcggaatctaaagagaaaagaacaaaatcaccaaaacagcacataaacaagcatgaacagtacatgtggatatttttaacatgtaggtctcaattttagaaaaatttagagacttgaaccaactaaattcgagctaagatgaattagttatgaattttcaaagatttaatcggattaaatcatttatatagattttaattgaattatgatgcaataatgaattatttttgaaaagaaaaaggggattattgcgtcagcggctagggttcacggcggtccacgggacacggcgacga

SEQ ID NO: 57119 - DNA, 1501 bp, Oryza sativa
tcatttaaatccttaggcattctattaattgacagaaaataacagcactagtttaggaaatgtgattgaaatgctcaatatttagtttggtctgaaggaccatgttgaagttgccacttgcacatggctgaatctaacagatcaatcttcacctttctcacccttcatgtcatgacaagaactaacacccaaccagaataatatcatttgaatcctgatgcattctattaaatgacagaaaatgacagtggttcagcaaatttgattgaaattatcaatgtttagtttggtctgaaggacaaggactacgagatgttgccacttgcacaggcttaatctaacagattaatcttcacctttctcaccctttatgtcgcgatacatgctaacaattgcaataatatataggttcatctatatccctattaaaagcagggtttgttactttgttagtagtgctttggtttatttgtggcatagaaatgcatacgtttgtcttgactagctttgtggcttgaattcacatagtgtatgagacagttttgcaattgatcacaggttatcaatcgagctttttgggtagttgaattgttgtaaatagctctatttccatgaagtttgatcagtgatacaccataccaccttgatgctaaaactgagccaaagattcatgtcagatgatggaactatatcttaatcaatgcagcatcaatattgaactgtctcgtgatgttgtaaatatggaactataccttcgtaaagtttgatacaccatacaatctagtttgatacaccatacaatcttatgttgttatactaatattgagccaaaggttcatttcagatgatggaactatatctcacccaatttcatcatcaatatcaaactggcttgagttttttttccccaaaaaaaagacttcatacaaaactcctagttaaaaacctgccattaaagatgacccaaaagtgccataacactataacagaagtcttgttcatgatatagaaattatagaacaaatatgatattattacagatgatattcacaacagcagaagtaccaaatttctacattgttgtccttgtgatttatgagtatcaaatgaaaaatggattctagcacttgatagagttgatcccaactctccttttgtggccttattccaagtttgaaacagcaggctgtgattgcggttctatgtggttgtttgactgattatttcttatcattcatattgttttaaactgcatctggtagggctaattgatcagaagcagcatggacataggtagagcagaccaatcttatgtcctagagcttgtcagttaaatagcaatatgagcatacaagtacttatggtatctgtgttcatcatgatccatttgctactctggacctgaaatatttgaatttacaggataaaggttcaagtagctctatggatgacagatactcacaacatgctgatcaaagacgttttactgaacgaggaagga

SEQ ID NO: 57120 - DNA, 1501 bp, Oryza sativa
attgttgcatgcaagaatgacttggcatgctcatgtggcattttttgtgggtccaaggactatattaacccaaatgattaatttcgaggacttatttggacgttttgaaacctcaaggactaaattgagcccgaagcgaaactttagggaccgtattagctattctcccattcagtaaatatctgtaagactcagaacaatcaatcccatatcctaatctatctagatatttttctttttttcctccactgtttcttttcatcaagtcctttcctcttctcctgatttgattttttgatgattaaaagatctccaggcaaaccatgatcattgttatattctattttatgagagaattctatttttatgtcctctgattacgtactacatcctagtatttttccaaaaaaattgggtataccggtgccaaccaggcacaccccctaggtccacccatgatcttctccctaccacgccatctctcttgacacggggaccaactttggtcctcttaatcatcgtctcttttccttctctcccaccgacgtggtgagagtcgatttggctgtagcaggagttgatttgggagtatactatagttatagtggaatgatctaaatgtaaaactttcagacactttggatggccgttcttgagctgcaccatctgttgtctagattccatgtgatacattacacattttataaagcacaaagatgacaccagtttcccccaaaaaaaggaaaaagtataagtaccagttgtgtttcttgactgtgcattttcaatcggatagcaaagagctgatgcaaattacagtctctcttcatggattcaattccaatgcatatgtcggcagtcagcacaagctgcgacaagttgagcaatagggtggttttgatccgaagaggcgaagaatcaacgatcttcttccggttgtttctgcagtcattcacgtacggatattcagcactgttgactcaccattttgggctcatttgaatagtaggattaagaaaacataaaaatatgaaaaacataggattttaatatgaatgtgagtgtaaaacagaagattgcaaaacatagaaatgaccgtttcatcggaccgtaagaaaaaatgcaggaattagatgagaaataaaaaactcaaaggaaagtttccatgagattctacctcatgttagatttccaacaaaatttacatgccattaggcattacataggaaatcataggatttcataagatttatttctttaattcaaagcactataggaaaattttctataggaatgaaattctctaaaatttttatgaatttcctttaaatcaaatgaggccatatactcttgtttttttcagacacatcacacatgtatatctcgaaaaggtatcgtgctctctgttagattttagccagacggaaatagatatacacgaacaatgttttgcagaagaacgatgggcgatgcaacaaagttttggaacaacgcttatttc

SEQ ID NO: 57121 - DNA, 1501 bp, Oryza sativa
gagtatatatatattcgtaaactagtgggacttgggcaattatgagttggaactattttatttactttctcatgtttatgtagtaattgtggcaaaagcaggacaactttagtgagatatatttagtatgcttgatttaaactaaaaaattttcaatacatcatttgtgcttatgctgatgatattttcaaatgccatagtctgaacccgctcttcaatttcagcattccatgtcagtagtagaaacaagaaccacctttatttgctgcaatcaccacttacaacagttatattacctgtcatgacaggttaaggaaatttgcagcctgcaaggatcatatggtgatattttctccttattactgaagagcctgagagtctgaaactgctggtgggcacccatacctataccggatgttttgttaacataggttctgctatgaattagcattgcagtttaattttgaaagcttactcctaggtggcaaccacctccgttgtcttgtctgtataagattgcaccgttcatcttttctctctgtttttgtgttaatcaatgcatagacccatgaataccacttccctttttgcattcatacatcatgcattcgtctcatcgatgtgtcgtctctctgaaattccttttgcatgcttccgctgttcgcctgtatgttttttgacagtgtggtgtacgcctccattcatgaggaatactagtagtgtatactaccttcgtctcaaaataagtttactttgtacactgtctagattcatgtacaaaagcaaacttattttgggactaggtagtatatctcattgaatacaacaattttgtgggcagttattatgaactagactgtgaacagagcatcccaaaagatgtcctccgcaggtaagattgaagtgcaagaagagggaaatgcatatgccattctactgtctactgtactgaaacaagcttactgctatggaatttggagtactccctgggatgcctatccttcagattttattaaggggtttcccatgatgcaggggtgggagctttattaacctttgtgtgctgtaaattctttcactactttcagtgcacaccagctttatctctctgccatgtatggtctgtctgctaaagtgcatagcctatatatttgctgttactgcaaactttagcttgttaaaagtgttcatctgtagtatcagagttcagagttccatggaacagcattgcagcagccaatctttctcactttccttttttttatgtactattgttttaagtactcttggtctcaacccaatgatggccctatgtgtggcttcagtgctttgagatttatttaattctgctttgtttgctgaaagcaaggcaaattcgtacgggtgattcaggcgattgttgcctggtccttttttttatgagaggatttttatttatttatttcttgggtatgagaggaaacctagcagcaagccagaagttatggatataagattcttg

SEQ ID NO: 57122 - DNA, 1501 bp, Oryza sativa
tgggaccaatggctttggtgatgggtgatgtatgtgagttgcatccatggatggatggcttgccatggatggtgacacactaacacccactgaaacttccttggtggaaaggaacaagaggagtggtttgttcttatcaatttttaggggagttgattgctgtgttttaggtgagtgatcctggcccttcaacttaatatacatggataataagatcatattaggtgatctactgatgttacaagttccaacaggagacgaacatgattggctggctgggtgtttagaattgttacaggcctcaccaatttttcgtactccgttttgtttttttttcctccgggactgaagtctttgtaataaaggaaaaaaaattagtggcaactattttttaaacatggctattttttttcccaaataaattctagtatgggtggtaaaaagtatgttcggcttttcaaatattccctttggttatatgatgttttagattagatttgaccaaatttttaactttggactatcaatgaagtttgaaatacatagtttaacgaacataaaaatgtcttgtgtaaatttgtgttgaaaagtactttgataatctttaactttattttataaaaaatattgtggtcaaaaccacaactgaaagaaccgttaaaaggttcaaacatgattttttttcttttttttttttacccaggggagtaacgcattgaactcccaaactgtaaacatagggtactttgaatactccattcatacttgtaataagtttaggcatgttattatagacttcggttcacgtttgatttgaagtttgtatattaaattatagtgctttaaaactttaaatttcatcaaaatagaaacaaaatgatttgtcaaaatgttattaacgtgatcatagatctaaatctatgaaattataaggttagaaatacccagtttaaaaactttagatctgaagctgtgtaaataaaatcttattcataatggaattattgttccaatatgttgggttttttttttacagttctattcaaaatgtgacgccgccgtttattgcatcttgcatacttgttcagttctgcatgcttcatgcgcacaagtcgaaaaaaaaaacgcacggattcttccacgaccgggtcaaatggatcacaggaatgtactgtacagatcacaattctttatgaaaaacaatgttcagttttttttctgaccgaaaagtacagattacagtacatgacaaaacttgatgccaactcgttgacacgttccgttccgttccatgacccagccaggcagccaaacgcccaaacgtaccccggttagttgaagaagaaaaaaaaaagccggcgctaagggttttcctgactgataaaaactggcaccgtgacacgaatgataattataaatgctgattctgtaaaaaaatttggcactgataatagttatatatgttggttttctattaaaacacaacaaaaaaaatagtgcc

SEQ ID NO: 57123 - DNA, 1501 bp, Oryza sativa
agcaaagaattgcatatgacttcaaaggtgtagcaacaaacctcgagaggaacatagacatccaaacagagcggctgaacacaaggaggcacacttgggagagtagtcagaggtacataggcatccaaactgagggactgaacacatggaagcatacttgggagtgtagtaagagcatcctcaagatgtacagagccaaaaaaatgaaggcttgcttccttcagtaccagagcatgcccaagatcaataggatgtcgcatcccatcatacataaaagctttgaggttgatggcattaagttataacttggttatatcacagtatgtgactcgtaagtatagaaggcgcggcaatggatgtgtcacctttatttcaccaccaatatggcatctaactaaactcaaccattcaatattaaagcattgtgataacaaatcttgaagatccttctgagtagatcgtattaagtgaaggtcaagattccttaggtttagaaaaccactgaaatggggaggtagttccaaagatgcaaagctaagctgaatatgctgtagacgggagatgcttccattgtcgaaacgctcaaagggaaatctgtatcgatcaagaagaccaacaggattggttggcactaaatcaaaagccattttttttgtctgtgatgatacaacaaaatcaaccaaaccattgaggtgatcaactagcttgctgtcgaattcaaacttcacctcaaactcttcaacaatcttgccagagtgctgctgcaagattgcattaatattatccctggataccataacaccatcgaatcttagttttgtgcaacaagtccacatgtgcctccaatttcttgacaaaacactggtcctcacaacatccttcagtggcaatttttgagaaaattgtgcacagcaaatcctgcacaagagggacatggtagaagttattttcgataagctattttttgaaaacagaaacctgaagaaggtttctcgtttctaaacacacctcaggaagatctgcaaactgaacttttgccctgctttgtttgaagggctgctgatggcatcgcttcagcctttttgttctacgaatcagattgttctccattcctgttctgcaacaacatagatggccagatttagtaagggcgcagactggaagggaggagagagaaaaatcaagattaagagaaatcctactcaaacttcctgcctagtacctattgtaatcattaatatcctgcctagtacctattgactattgtaaaaagatcataactcactgatgtgtttcaaccttagcattttcttttcaatttccccctaatcaaataaaacaatttctagcaaaacaacaacaaaaaaaaaaagattgttccatatactgatatgcagataggtttgggggagaaatcagagcataattgtggctggcagagagagattacctgcgatcctctagctgctctccgagctggcaaccggactcctctgaactc

SEQ ID NO: 57124 - DNA, 324 bp, Oryza sativa
gatcatccaaagtattgatccagtagaagattttcgatttaattcgaccagggtaattgctaatggatatatcacaggaaataccatattggttgctcacatactgaaggactggaactcttgcattaggaatgaactccatatgtctagcaatacctaaataaggaatgaaaacagataagaatatcctgtaaattcaacaaaaagggttgcattgaatgaagtacggaacaaaaagaagatcgtgaatagcttgatcaaaacttattcattacagtgacttcacctctcacaagatatattgctttcctttttttttttaga

SEQ ID NO: 57125 - DNA, 331 bp, Oryza sativa
ttcctgcagcccatgctttgccccatgcttttataaactctaatacaacgattgtttaaaaataaacttattttagaataaacaggagcgaataaaaataatcttatttcgaaacagtgatgtactagtttttaggaatttggtcagtatttcagttcacagtttatccacaattaaaataagtggttactgtggctgggcctgcgtgagctgggctgactagagagagggagagaccgcaacacagaagatggcgatatttttgggagcaaaccgctgattccacagatccgggagcccatgtggaaagcgcccgttggcggttcggcga

SEQ ID NO: 57126 - DNA, 209 bp, Oryza sativa
aaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagt

SEQ ID NO: 57127 - DNA, 618 bp, Oryza sativa
gattctcgccatgtttgtagagcatacggacatccatatcatggctcaaaagataaggaaatagcacaatcatactatgcctgtggcacgcctttggtgctatggaaaaaaatagtattcctgaacaaagctagaattgacctgtttctcacagagaaaaaatgttgcaagaaatctttcgtgaataaggtgcaaatcaaagcaaaaggcatggctgaatacctactaccaacaataattcagggtgactatcaaatgtctgttagcctgctaagtaatttgactaatttcagtgaggaacatgagtatcaaactaacgcctcggtacaagaaaaaatgatgatgccaaaggacaaatagacaaacaagtagcatgggataaatgatgccagaggcgaagcatacaaatgacatgatccagtattattcagaggagcgctaatacgaattctaagggaacatgatgctgctgatcaagcaggttcattacattgaataggagctcaagagactcaaacaccatacattagataagcgtaaattcgtgaaaaaataatgttcagtgagagtgactggcactaacgtaagctgactgcatctaaatttcgccgtcccaga

SEQ ID NO: 57128 - DNA, 1501 bp, Oryza sativa
ctctttcgtgttagttttgttctttttccccccattgatgtacggagtaggcccttcaaaagttgcagattctccttttcgtttgggttcgtatgctcacatggtgattggacaccaccaccgttttttgtcaagtgagaaagtgagatgagcagagcaaaatgagtttttggcgaaaccttcttccgtttgaacgtccccctgatgcttgattgtcccttgccaagaactgctcctagtgcgatgacatgtgacatgtctgcctgtaaaactccagtgaaactccgtgtgtttcacccagatgagtttgttctaggttccaaacttaacaaacgaactttagctgcctgtctgtaagctaaagtgaactagtacgatgctactacttggatctctgaaaaaatacacatgctttgtcatactatatgtcttctgagctgtctgcgtcctaggtggtgccatggtgcagtggggtgtgcttgtggtggggaaagatggctgccgctctcgtcctgaccatttgctttactaaataccttaatctaggaggagagaccacttcttcaggtcaaccactggctgctgctcaatcgagctttcccctagctctcgcctctccatgttccggggtcgccaatctgcgagctcggttgcagatttggagccggtttccatggccggagctatagctgagctgaccgtgcgtgccctgcagccgttacgtgtgcagacatttcaggtcagtgcagtgccctttctctggtctctggatttcagtgctcctttcgctctgcatctcctgctcgttttctagtacttctacggttctacctgtgttaagatttgccttgccttcctggctttctgccatgcgacacgattcagctggggaaatggagagtagttgccttttagatccggccaattgctctgataaaaacgtcaagtactcgtacatggtgcatagccctgatttaaaacgaggaatttgttgctgccgtatgtcttctgcggcagtgaaatggaagaatctctcaatccaggcgctcctttctcacgcgaatcatgtagatgcaattgatgtgtacggtgtaccgtgtcatgcgcctttctgcgaaagaacagtgaccggttcatggagtaaaaatccgtcagaacaaagccaaaattgacaagttgatattagtggatcacaatcactttaagttagttatttacacccatctctagtggtcatacgggtagtattatctcagttaatatggatgaaagataaaagcttctcgaaacgaacccctaaatgtagtgaggccaattacccaacatataaaggggagcgtcaatgtattgggaagaaataacaactttatgtactgttgtattgctgtggagtcatttctcggagcatcaattgatttttccacacgtggagaaaaaaacaagccacaaccaaagtaaaaagagcctgtatactctatatatataaaaaaaaaacaggtgt

SEQ ID NO: 57129 - DNA, 1501 bp, Oryza sativa
agtaaggtggtgtttggttggagggactaaagtggggctaaactttagtccctcttataaaaatataagtccatatggtaaagacttatattttaatgagagagactaaattaagtataaactgcatcagctactcgtaagctacacttatgagtatactcgactgatgaaaaatatagtggaccaccacatgtcataggcgagtgagaccatgctcctcgacttgcgactcgagttctactcctaccaactctaggccaaccagatagatactgagaaaaaaaaaacaacgacactgatgtgacatctcagtgtccatcggccatcgcctccttttctctctcctctcctctcaccatcttctcctacagcaaatcactcttctctctctctaaaaaacttcacaagcctactagcctactactaggcacgtagctagcccctgccactctatcgcccagcacaagccatacagctacccgctgtcactgcgccagcggccgcagctgcgcaaagaggagcgcgagaacccaagaaaccaaccaagagctgcgtcccataaaggcgcgctgcttcaatccatccatcttctgatcttccatatacttcgcttcctgtaaatgtcatcgccgccccggcggtgcctcgcagcggagcagcagtggccatgacgccggcgccggcggccgcctcctaccgcgctctcgtcgcgctcctgctcgtcgccgtcgccgttgccgatgatggtgggtggatggctggctagctagctggctgttggttttcggttttggttggtttcttgctggggggagtgtgtggttttgtgtactggggagcagagagattcaggggggagttggtttgatgggattagtattttattagtgttgcaagtactcttcctttttggaggcatggtgattctcttgtgggtgatagtcctactactattttttattgtcctaagatctccctaagaagagtctaatactttaactaatccttgtgagtgagttgtgacaagtgccacttccatctcttctcttccttcttgtactagaacacagttgctggcattttgtttatggtggtggtagccactaggtaatccaccaatatttcataatgtgattcttttttttttcactttctgttttgttctacaagggactccgttctgctttggtattctgttacttatcaagaagtcgtctggccatttttgaatctttgtgctcattgttcaaggaaggagctttatttcttcttttgtatgttactaccaatctgatgagccgaatgctgctgcccgcgtcaggaatctttaggctttgtagcaaccttttactttactattgtgctgatttttgtgctttccaatctgatgttcttgaactctttttttttttgtcttgaaggctaagaaacataaatctttatttattagtactactacgtaaatagattttttccggggcgaacaaatctgtgcagattg

SEQ ID NO: 57130 - DNA, 1501 bp, Oryza sativa
gaatcccagtttataaaattattttgatttaaattaatgcattatcgctttatttaaattcccgcgttatcactgttttatttagccatacctatttatcattgttatgaccttattattattgctattgttattattaccttgttcaccctagaataaacaaaaccccaactagtgggtaccctatgcatggtaccactagtatgaatttaggtagatgcttcgctggttaattaggcaacattaggtggttttacaactctagactttgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatgcagatggacgaagtcgggggtcgatggacatctctagggcaaatgaaggctacacgagctgcggcccggtagtcgagatgtcatggcacggggctggtgtcctgctgctaggggctcagtcctgcctacctgtcccggaggttccggccgtaggtggggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcgaatagtcgcgccctcggttatgggcaagcctagcaatgtacccaagttagtgttttaattcttaaaacctgcttaacaactaaaatgtggaatggttggcctgggttggcttgggacgagctgggacccagggtcgggttgctagttcggtctgaatcatcgtaggccttgggttaaggcaggttcgtgtgggttcacggccttgattaataatcttgtatagctctaggatcatcttcataaaatagcttttggcaactaagtgacttttaaatgctgtttactgcaaaacttaacccctatgttataactcccttgtactcccttgcatttattctacacttgtgggtgtgtcttgttgagtacggtggttgtactcagtcttgctcaatttttcgcaaacccagaagaggagttcctagaagatgaaggctttggtgtctaactcgtgcctgccgtcaagcgcctgtggtcgtcgccctagtcttccgctgtttttcgtttgtcttcttgtgtgctgggccttcgctgcccatgtaataaattatctatatacgcttccgcttgttaaactctgaattgtatcaacttttggtgtaccttgcctcctgggacaaggaataatacacgcacgtaaggaacgcccgttgggttatttccagt

SEQ ID NO: 57131 - DNA, 1501 bp, Oryza sativa
actccgccacttcattgagactaatcgcgacaagtttcgtctgaactgaggttagttcaggtagaagtgcaataggtggagaagcaaaggcatccattacattgatgctttttgtctgcaggcaatggcaaggccggtttttacagcactcacgctcgtcgtagcccctgttcttgcctggagaactgtctacaacagccggatacaatgccttcctgcagtttgttgggctgctggtggaatttgttgggctgctggtggcatcgtcaacagggctcagttctttactctgtgacttgttcttgtcgacagagcttggaagaagacccttgcgcttcttaggggatggaacttccggtttagtatgttgagaagacaacacatcatccttagcactcacaaggaaactagacttgctattgtcgaatttggtccctcttctcctatcacaggtaaacaataaacaagtcagcagaatggaatatatatgtcttctattaagacatgaaaaaggacctgccagtaattgctattagaccgagattaacgagctctcaggcaaatgtaagaaatgtgaagaaaattcaaggcaagtgcccaaaaatctaaatacttagtacttaataatgtttatcaacaatagtttgccagctggctaacatatgcatgtgaaagaaagtctttttgtctgtttgatcctgtgcttgcactaattacgtgccaaacacacatgatcatgttcagaagcacatgataaatttctgcttataattaaaatgccatataaggtcaattaaagttttatgcgaataacattgttggcaggtatattagcccattaagcactagtgctagtgctactgccaactgcagaagcaaagctacatgtatttaaatcagcaataaataactcatgtcgctgtaagaaaaagcaccggcagcagcaatattgcatggacattgcttagaagctgcatccatcgttcaaatcaagaaataaaatcattgtgatgcgtatagattacattaaacttgtttataccagtaatattgcagagtgtccaatggacacgagagttaacaaaggttgaatgaattagagaactaattgtgcttcctgtaacatgtctgcgggataacagcatgatcacatattctttggaagactggaacaatgtagtaatagtgtaatactaggtaactgcagagtgctcaacgcaaatataattaagcaatgtttttggattcttgagcattcaaaaggtatcctgctttactgtagtgccagacaatctgacgcgagatgttcctatggatcgatgggaacaatagctagcaaatttgtatgtatattcgtgaaagagaatactagcaccacctaacaaaactactccttcagtttggagtaccaaatatcaagcctgcacagctaaacagctccttagtccttccgaaaaccacgagctccttcagtaaaagttaatttttccacaatgtttca

SEQ ID NO: 57132 - DNA, 1501 bp, Oryza sativa
cgccgtggttcagcaagatcgtcgcagaatcttcagacgccactgtacctctgtacaggtcattgcgtttcaccaatcactatgtatcgcagaatttaactatgtcagtactttcttaaaaaccataaaattactgtaatatatttttttcttttgaatcatctctgagtggtgtgatttattgatcgacagacggtgcgtgcaccctcgtataccacagatggcgatcattgtttacgcggagagcgcggcgaacatctacccgtacgagatgatggccaagtgggtggcgcaccttctcgatggtgcattccagctaccgagcattgcacgtatggagaagagcgtggtggagtgggtttgttgggcgcatgatatgaggaggtgtagcggcaactacttccgcaagtcatgtattggcaccatcacaacgtgggataatgatcagttatgccgcaatatgggatacaacccaagaagaaagaaagggatagttgcggagtggatagagccctatggagccgctgactatgctgatatctagtcaccatgtgtcacaaactgaataataataataataataataataataataataataataataataataataataagtggagagttaattgtatttcaaatgttgcacatatagaccatgacaaacatgtggcagcaatggtgaaatttcaagtataacttaaaagggataattgaagagagtacttttcatccgttctataatataaacatttctggttataaatctatacggaagctttgtcagtgcttaaaagtggaatatcgttatcccatcccagttaaaggaagagatgtgtaaaagtacccaaaactgttgcttgccagtttatgagcgctgcacgaggaagcatgttgttgtgaaccttttcagcttggtctagagcatggtgcttagggctgtgtttgcaatcctggatttccaacccctctccatcatattccgcgcgcatgtttttcaaactgctatgttttcataaaatgtttctatacgaaagttgtttaaaaaaaatcatattaatctatttttgaaaaaaaattagctaatatttaattaatcacacgctaataaatgtacactgtacatgttgggaacttaggattgcaaacacagcccggtggtaacggagccaaactttttaacctacaaaatataaagaatgggtccaaagagattggagtaagatttaatagatttttaaacttcccagaagtacggatttaaagtattgagatgggttctgaaagggcccgtgacccattaccacctactgatgctcgatggatgatagagttgttgtcctcattgtttatccgtagctttctgtaagacattattcaattattaatccccaaaaaaataagaaggatatggtgtaaaataattctcccttaatgccctctaatcccttctctaaggggattaaccccaacaagggcttaggccatgttacattac

SEQ ID NO: 57133 - DNA, 1501 bp, Oryza sativa
ctttgctcaattctttcttactatcaccttttcaggtgtcctcgctgctgaagaacacgtgcaagttttctcatctgaaatatttacaactaaaattacgtctatattatcatgattcgggcaacatcctctctttggcctcttttctcagggccagtccttgcatagagaagttagaaatacatgtgagtactatatgttttcctatttgcaggaaatgcgtttattccatatttcttctttaatcattctggctgttagcaatgcagtactaagattttgatgatctgtcaattaattatccatgcaatacaagtcttcttatcaattcccattttcactcattgcagttcaattcgtatgctttgtcacacttgtattatcagcctatcaggaggcttccacaaggtgaatacggctatctaaagaacatgcatattactggatttgttgcatcgacaggcgagcttgaatctctgctacatgtcgtggaaagtgcctctatacttgaagttttgactattgaggcggctggcatgttagggaaagatatagattatgaaggaagattaaaagttgaggaattgacaagaagataccttgatgggataatgttacgaaatacaaagctctatatggcataagttattgtagtatagaagaggtgtgcttgagatgtatttgaggattcctgtgtgcaaggatctgttgttagctgtgtgcatgtattccatggatcattagtaattttcgcaggccatatccttgataactctatcagctgatggatcatttttgatagctaattgtctaattgattagaaatatatagccataattggaaatgatgcgatatttgttttttttaatattaaatgatgtgttgtttgtaaaatgctatattttgacctacttaattatgttaatggcgtaagaaaattaactcaatgcatgaatttgaagggattggtgagaagatcaatgaacatatttggagggatcgatgattatagatttaagatccttcaaaatttacttggtgcagttcaaatcatttggcctcagtaattttgttgaccccatagttcgttgatgtcttgcttatcacttgttctgcttcatcttttgcttataagaaatgtctttgtgcctgtcggtggatggcgagcgaaaaaagaagttatgtttttcaactgagaaaaatctttgtgcatcttttgctgtccttttggatttaggatctgagttgtgctaaactctaaaacccaagaaatccatttgataaagctggttattttatctttctggaaactgtcaaagaactgactatcttgtgcaggttacttgcctttagtttggtgaaggatcgatacttgcactttggtttaaaatgttctatatattgttgtctcacttgatttattgtgtaaccatagctgctttcagtttttgtaagtgctaatctgtaaccttgctttgcagttcctgaagttgtgagtca

SEQ ID NO: 57134 - DNA, 1501 bp, Oryza sativa
cagcacagatgactcaagaaaaatggctcaaatcgcttaccagcagtaggaagaaactcagctcgtcgatcagtcggcgtaggaggcagcaaggacggtggaagtgagggtaagaacgaccgtgacaagcgcagcggcgaggaccagcttggcgaggagctccacggtggtcgtcgcgatcggcacgttcccggcggcggtggcggcggcgccggctcccccttcaccgcggccaacagcacggacatgggtgtagatgagcgtcatggagaggaagaacgtcgtcgctgcagcagctggacggagcacgtggacaaccgcgacggcgaggggtagcaaatcttggccgccgtcgatggcgcctggctgaggagccaagaagacgtgaagcacgccggaagacaagaacaggatgaggtaaacgacctgcgggcggatcatcctgtccacggcaccgccgcctccgccgccgatacgggcgtagatgagtgcgacggatgtgtggaaggcaaccatcgccgccgccgccgccagcagcatcgtgtggaccgcggcgtcaagcggcggagctcgaacgaagcaactctcgccacccgactgcaggtcgacgtaggggaagaatccggtggcgtacatggacaccagcagcccgaagaaggcggtgaccgagggggcgctcgccatgggggatgagcacttgagcagcttgggaggatcaagattctagagaggtgcggggttgcacgagtggagaacggtttggatcggggtaaggttcgcggaggaaggaagaagaaatttaaagtgaagggtctcccacaaaaagcacaagaagaaatcgcgagcggcaataaggcatccgcggcctggaggcaaatattgcggcaaaaatcctctctcaagttaaagccagaggaattgaaagggacgggttgttccgtcgttgggtggggtgccgtgcaacattgcactgcagccagcaggtcggctgcattttcaggcagtggctttatttttctaatttttttatggaatactactattattgcatggcaaccatgataaggttatgctatctttgaccaacacttttgtagtatccatccacttattagatttaagcaaaatttgacagtaacagttaattttggagatttaattgagtctttttctactgtagaacataagcttattactcagatgtacacccttcgttaaaaaaaaaaaacaaatcctgagagtacacagaggcagagtcctagaagatggaatgtgctctttttacacatatatatatatataggcacacctgttttttttttatatatatagagtatacaggctctttttactttggttgtggcttgtttttttctccacgtgtggaaaaatcaattgatgctccgagaaatgactccacagcaatacaacagtacataaagttgttatttcttcccaatacattgacgctcccctttatatgttgggtaattggcctcac

SEQ ID NO: 57135 - DNA, 1501 bp, Oryza sativa
agtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggca

SEQ ID NO: 57136 - DNA, 363 bp, Oryza sativa
agtaattcatacgcacacaatagttcaagggtaattcagacttttcccttacaaatatgttatttcagataaatgtcattacaattcgtttattcaaatcgtagtcatgtcattgaaattttataaaattagaaccgtgccactaccgtcacatttttcatcttttttttctttcctataagtgggacccacccgttagattaatcttctttctcccctcttttcttggggtctgtttagattgatgtcattttcaaccataccatttttttttgtcaaagttacttaaaaaatgtctacatttagtttgctgctaaatttaacaaatactttgtccataagaaatcctgctaaaattgacaa

SEQ ID NO: 57137 - DNA, 1501 bp, Oryza sativa
ttttaaattgacacctccttctgaagcttaattgattctcattaactagctataggatggatatagtattagtaggtcgacacaaaacggtggagtatagtataacagcatattggattatatgatagtactaagcggtgaaagactcaaaagtactggggatgtgtcctgaaggaaaccatcctatttcatcccataattagttatatatatccatatgcataacaactgatgttaggggtttatgaatttttttctccatttccaattaattgtacaaatatattgtttttatatggtcatcggcatgtccttgtttgctaaaggaatagtatgtcatcggcctggccgtgtcattgaagatacatgtttctgtgcaatctaaatcgcacttattcatttgtacatggctaattacattgtcaagctcgatcagattaagtgatggatactgctctgttctgatgcattatagtacagaggactagctaataattgtgaatcttgatctttgagtaaatagctccatgtagttcagatgggttactcttttgtgatggcagatcttttaattctttagtgcttattaggaatagaactatatttttagatgcaagatgaaggttagatctgactgccggcaaacaagcctaatagttcctaagattcaagccatgaattttgttactagctaggtgttgcttatgtgggcattggtttgctggtactggtagaagaagcctcatattgtcgtggcaacgagaaagagaaaacgaaccttgaaacataaccggagtggaaccactacaaccaaagaagaaagagatggattttgaaacaagacatggatgatgctcaattgataattcattcatcaacaacatgttgatttgtttgtctgtctgctcaatgatgtacagttgacaccattgttctcctcgttgcaggatatattgacttgttgaataccgccatcgtcgccacatcagcctggccgccatctggtttcttttgccctgatgtgatgaacacatctgaaggagagcagcagagtattcacgtacatgtggcaaagcagcaggttagtacatgtatttttctactgcaagatcattcagtgtctaaaattttctactcgtttgcaggtgaggataatcattttatcaccatagtcaaaagtatgccccaaaaattattgccagtggttgattaggagacaattagattgaatatctttatagaaatagatggatattgtgtacttcagtccttgcatgctttcagatttgtatgctaaattttcctgtagatgcatatgctgaatgtttcctgtaaatgcatatactgattttttttatatacaaaagtatatactgcaatgtctcctatgtgccattttttttcaccattacgagcatatatactgcatttttctatagagaggatatatgctgctttatttcctataggggtatatactgaaatttatataacaaaaaac

SEQ ID NO: 57138 - DNA, 1501 bp, Oryza sativa
atatcatttttttcacaaagggcactagtgattggggaaatttctaggtaattactaattagacgcggctacatgttatttgcatctcctttttccaatatattgatgtgatgaatcagtacgtatttcgaacaaaagagaaagggagaataaaaggaaactggaggagcaacgaaattagcggaggaaacggggggggattagggttttaccgaagacggtggtgaggctgtctttgaatgcggggacctggccgaagggctggagcttgaggaaggaaggggacttgtgctcgcccttggacatgtcgaccggctcgacctggaacggcacgtccttctccaggaggcaggccgccacgcgcgccaccgccggcgagatcatcggaccgtacaccgtcacaggcgccgccatcgccgccgctccttcttcggggacctgccggaagaccagagattggataggaactggaagcaaaccactagtgaatgtactccactccactagctggccggagacggagggacgcgagtgagcggcacactgacagtctgacacactgacagatgggctcgagtggccttatccacggtaaaaactcacagaaaagcttttaattagacattctacctaggatatcaagttgtgctaagcgtttggatcccgtgactaaagttttcttgtcacgttggatattggatgtttggacactaaatatataagtattaaatactctatagactactactaataaaactagataaattttttaagtctaattaacctataattagcacatgttactttagcatcacatatgctaatcataaattaattaggctcaatagattcgtctcgcaaattagtctaaaattatggaattagttttatcattagtctacatttaatactttctaatttgtatcgaaatttcggatgacagggcctaacaccggtaaaaaaattcctgctcagtagtagtacatttttactacaaaccatactgtatagagacaccattaactgaaaaaaaaaatctattgtatgttcgtctttcagtactggatcaaaacatactacgcacttttttttttttggttttgctccggagagtggtgcggctcaacctggtttcggtggctctacagccacaaacgaggatagtgagaaacaaacaagcggatgtatagcttacaagcttgtttatgctaactacggcaaggaaactgaaactaactagaggtagtggacctggcgctttaccaaagtgatcttttgatactaacatatgatgaagcacatgtcgcataacaaacaattagagcgtatccacaataaaggtgcccacttaagatatcgtataagagccagcaatcgtaaacatcttatatggcataaggtcgataaataacttaactatgagaaaagctgaaacctggaaaaagataccagtacaacatcaggtcaggaaagcaaacaatgtacatacataagcccaggg

SEQ ID NO: 57139 - DNA, 1501 bp, Oryza sativa
gggcgtcgcggcatcggtcctcaagcaccctcatggcgtcactgttgtcgccgcgttcctcccgcctcgccgccgccgccgatgctgtcgccaccgccaagccgacgccgacgctctcttcctctcatgatgccgccaccaccgccaagccgacactgacattagcggcgaccgtgggaaggcgctggcagagctggaggaggacgagatggcgctcccagtgactgcgccgcccaccccagcagcatcctctccccctctctcgccggattggatcgaatcactggcgcggatcgaatcaccggattggatcgaatcaccgacgccgacgctctcttcctcttgcgatgctgccgccaccggcaagccgacgccgacgccggcagcgactgcggggacggggaaggacggccgtcgtcccgcgctgtccgcgtcatctacatcagctcatgggagctcgcctcttcgcgcgtcgtcgtctcccgccttaccggcttcactcgatacagagaagagagggggtgagagaggagaggagagaggaagcaagttggagaggagggaagaagaggctgacatgggggcctacgtgggtcccacgttgactcagccgtcacgtaggacaaaatcggggtcaaaaccaccgaaggacctatgtggccggttttgattagttaagggacggccgatatctagttttgcgattgggggaaaattttgtaactcgataaaagttgagggaccttcggtgtactttttcctaatgaagcttacactggctctgctaatcgtcgcgcggcccaacagcccgtgagggataacgtgcgccaacgatcttgctggttggagcaggaggcccaggcccagctgctagtgatcgggagtagcagtaggaatgtactaggataaaggcattggctgctcgttgaaaggtttacgcagcaatggtcatatagttctatgtagttctataaaacaactatagcgaacagagcgtacacgatacagcatgagaatgtattatttattattgtgtttctaccttctaccaatactgccttgactcttcatctgacctgtagtgtaggccgtgtcctgtcctctacgacatcatctttatttccgtagaagctgtcaccgagcttttacacacaaaaatgtccgagaagtgacgagtccatttcaaaactaaacaaaatcaatccgaatttaaaacaaacaaactcctgcaagccgggagaaaactttgcgtgcgcgagtcaaagcccaacgtgcggcccggcccgcaaaacaaaccacccgccgtggcactggcaaggaagaaagagaaagaggagagagagagagagagagagagagagagagagagagagggggatccccgcgccgcaaccaagtggggcccgtgatccgaaacgaagcttccgcgaagcagcaacggttatgcgtgtcctcctcaaaaaccgccatctctctcactcccaccaccaccaccaccacc

SEQ ID NO: 57140 - DNA, 1501 bp, Oryza sativa
agagcaagggtgagtacaggagtactcagcaagccatgggaattaagtgtttaatgcaggcttcaaaggaaaggctgttgtttttgcaactggttttatttaaactcctttttgaaacaactaagtgagtgcttctcaaacgacacggatgagacagtgtgtctcgtccggtcggagtatgtgcaacgtatcagtctttgaattgattcaaggttagcacctggccaacagctttcaaacggccacccgggcctggctgatcccatcagccgcagatttttcaaacatcgaacccattccacaacagtaatttcacaagcagtagtcaaacaaaactacgctaggaatcacctcacatccgcccatgaccgtgggcacggctgttcgaacagtttaataacctctgcagagggggtacactttacccacatgacattactagccttggtcacccagcctgtgcagaatagccacgtctggtgactttggggctttcacgtcaaggcatttcgaaagccgacacagggttaccatatgccaacgagaggggtcccagaccaacaacaggttaggtcccagaccatactgtgccaggaagcccgggggttctccccaacaccaccccgttgaatcgacatgtctcttggcatcatggttcccccgattagctagttactcagccaggggtgtcccattccacccatgtggtcgcacttgccttatgttcggatgaaattccaaggaaacggtccttaagtgcaagagcaggaaaccgtactcccggtacgtcccccggtccgcgattttggaaattcattttagttcgcaagcaccgacccaggtgtcgggttttccaagtcttttgtaaaaccccaagttttacccatcattggatattttaaatttgaggggaggtgttccgatgcccgtgcccaaaggcccgtgcatcgaagcacaacagttgacaaaggaggtttaggtgttcaataattcaaggagggtaattgcagcaattaggattgcgaccggcaggctatctcgcaagccgcggccgatttacttgtgttaatcctattcatgcaatatttgcagaaaagaaatacttagttttaaattataggtgcaagatgatcaaaggtgacttgccttgctcgagatcttgagcttgatcctcgaaatcctcgcactgcgggtcttcgggcttcgaaactacacgcgaaacgggacaactcaacaaacggcgaaaataaagccctattgttgacctctaaacgtgccattaaatagatctcgagatttgaggaattttgcaagttgaacggagtcaaacggacatacggttgagaagatattgaatttctaagattattggatttttggtctaaaggaaaaaggatttaattaaacccttttgaaaagaaaagaaagagggaggggaaacagacttccctcgggtggctagggcacgacccgagagaaaggggcggtcggccgagcttaa

SEQ ID NO: 57141 - DNA, 1501 bp, Oryza sativa
tgctgcatatgtatttaaggtaatagttgttccagctactatactctctatacgatggtggacgccctgatgcaggatgagcacaatttttaccacaatactatgtgaatccttctcatgtttttgcctttcctacaggtttgaaccttttggcattggcgaaaaaaaaaaggtttgaacttttcgtattttctgaaaggtattgccctactttgactaatatatatatgcttcttctaaacaaattgatggaaaggaactaaatttttttcatgcagaattttagtaagttgtttcctatcgacaatattccccataaaattgttacaccaatcctttttctgatgaagtggaagaaaggctcttgatatttctcaggttagtgctgccttattattgccatgttttagcactaatccttcatccttttttgcatgactcatttctcacagtcagattactactgtgaccacaacctaatccttttattagaactcatgtattggttaatttcttttgaggtgcctggatttaaccttctagccactttgaaaaaggaagttgaagtaaagtgggatttttaggagagcagagtcaacaactgcacttttctgtggtccttacatagggatatgaacacggaagttttggagtgctttccgataagatttgaatatttttggagtgcttctatagagtatagagtttctgatgacgacaatccaacggctcctcgcctccctcccgatcaattaatctctaacaggtttggttctaggtgatgattaatctcttccacagtttaatttgctgcattgattatttagttgatatttggttacagagctttttcatagctgcacgcaatggcatctatggcagcatatacattagtctaaccataataacatgaaaatggttcgaatgggcataatgcttggggctagcggcagctcaattgtgaccaacaacagtcaacgattattggaagggtctagccaccatgattacttaataccatgcattttattttccgttgcaaattatttctgtaatttgaggataatgaaactttggccagacttctataatgcatgagtcctatgtaaattctgaatttgatgtgagacaatatccccgcctctccctgttatccaaacaatcacaatcccacagtggagggcaattgggtggtgggagggaatctcccctgagaaatctatgcttgccgatcaagccctaagtgtcctgtaaatatatatcatcccttcaattaatatacttcaatatcatgaaagaaatcaaaaattgatatttgttttatgtcattctttgtcacaattagctaaagtcatctgttaatcaaaatattttaactcttgccggtttaaccattacctcttgcatggagtccctggcttaattcacatgattctaatatgttaatttgattcaaaaccctggcatggtgatttcagatatcaaagtaaatggataatat

SEQ ID NO: 57142 - DNA, 1501 bp, Oryza sativa
agacaaacatgccaatatagaataaagaagtaaagacaaatttcagttcagatctattacaattcaaattcaaattacagtaaagtatggtattggtatacttaaattccatgcagctttgtaacatactaacatcataataaaatagaaataacaaacaatactacagcggtacagacaataccatgcaaataccaatcttgtaagctgaaatattgggacagaaatatgcaaatttggttttactaggatctaaatataactattatggaggaacagaattgtgccatcaatatatcaactagataaacaaagaagtacaaaaaagaaaggaagtttaagttacaaagaaacctaagtaagttattagagaagtgcaatctcacagcgggatatgattcaagagctccatctccagctaaaaacgaaacatgattgaaaccattttctctcataaacttttctcctagctgcaatacaataaaataactaggtaaatgaacagcaaattaatgtccaagagggggggagcacttgaacaactttgagtttattcacgaccatacatatccaaatcctgtaacaacacgcaatggtctctcttgtgtccattcaggcatatttgccaaatcctccagagtatttatattctcgaaaatgccttccttaggaacctgatcatgcaatttgacagtttcagacagatacaaacttcaaccaagtaacaactagtacgcatggatgcaattctagaacaccataccgcaagggacaaacgacaatgtccaaactcgagagcatcatgaacaactactaaatcatcactaccctgccacaggaaatctcagataagtacaagtataaatctattaaagccttgctaagaaagtcaaataaatattaaattaagaacattatgtatgctataaataagtatagaagaaacttagtatgaaactagaggtatgcggtatgcactgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacacagcagccccccggaggtgcgcca

SEQ ID NO: 57143 - DNA, 803 bp, Oryza sativa
tttcaattgaattcccaccctgaagtcgcaaatccttgttgttggtggctcgcctccagggactgcagtgtggatgtggttcggctgtcctcgctgtggatcggcggtcggcagcgaccgcggaggagatagtcggcgtggagtagatcggcgatgcgggcggcggaggctgtcggcagcgcccgcagaggaggttgtcgctggcttccttggctgtcctcgatgtggatgtggatcggcggtcagcagcgcccgcggaggagaaagccggcggtcgtagatgtggatcgacgattggcgtgagggacgaggcagcgtagccggttggcgtggggtcggggcgtcggcgtgagtcgcggcggcgtccgggatcgggcgaggcgaggcgacggcggcggcgtccgggagcggcggcgtcgatctggaggcggtcggcggggaggggcgccggcggcaaaggcagggcgtcggaatcgacggcgccggtggctgcgctgcagttggcgtgagagggacggagcgaggaggttgggcgaggggaggcggagcgatctgggcgagcggcgtgattttcggctgaggtgcggtggtttctgctcgcggaggttgagggggtacgtgggatgataggagccattggattggatgattctggaccgtcggatttgatgaatgaggtttgtataggagtgtagttggtgaattatatggtagatagatgatcggacggctcacggctgggaggaggagtagcgcaaccaatctcgaaggttcgtataggtccacgagggcgggaccagctg

SEQ ID NO: 57144 - DNA, 1501 bp, Oryza sativa
atagctcacctcgttttgcgtatcttctcaatcttctcaatctcctcccactcaaactcagcctaaataagttttggtgtgcaccacagaaaacgttgattctgtggggtgacaaggaccaggtgttcccgttggatctcggccacagactgcaaaggtaaaattggacatcaagtacctaatttcaccacttcggtataccgcattaatgcagaattgatggacgcttgattgcaaaaaaaagcagtgatcactgtgccttcgcatggctgtggctgcaggcatctgggagacgtgtcacggctagagatcatcaaggacgcagggcacgcgttgcagttggagggagccgaccaagtgaaccgcttcatcaagtctttcctcctggactcgtgaaatgggccggaagttgggagtggcccagtactagagccctgctaagaagtactagaagcaggagctctcggaaaggcccaaaccaatccaactgtaacccggatttgccctctatcctcagatgccgatagtgtaatgaccctatttgggatgtaaaaaatatataccgtgaactattgattaattgtcaaatatgaaatctcccaataaaaaaatgtgatgctcacggactctgttttttcctcttgactatggaactgcaggcagatggcagtaccactaaagtggctaatttattgttgtgatcattctgagatcgtcagatgcatatgttcttgacaggtcgataaagtaattaatctgttgctgcttgctactgcccacttggtattatttagcacagtgcagctcagatggcaatctcatgctgtccttcacttgacgactatctttctccttttgttgagaaggccagtgcggcaatctcttcccttggccgctactctctcacctccactagcggagtactagtacaatgcaccactggcgatatacacgtgtcagcatcatggagcccgccctcaccaaacggacggctctccttaaccccgtcaataacatcgcctcccattcaaagaagcccaccaccaactaacgaaccggaattttcctttccttaactcgcgattaagtttggtacacgcccaaccaccagtgttaagtgtgagccttacgttttttcctcgaccagacgttatcacacgaggcgcgctgctgctgcgtgagcgagactgcgagagctcagtggagggagaagaccatcaccaccatgggcgccagcctgagcctcgtgccgctcctcgactacttcgcgcgccgggagttcgccgccgccggcctcagccccggcgccgtcacgctgccgtacccgggcgacggcggcgaggcgacctgcaccgtccactactgggcctccacgggggagccgctgctgccgccgctgctgctcgtgcatgggttcggcccacgggccacctggcagtggcgctgccaggtgggcccactgtcccggcatttccacctcatcgtgcccgacctcatcggc

SEQ ID NO: 57145 - DNA, 1501 bp, Oryza sativa
tggatcatctacaaagatatgcacagcagggttttttttttatcagataaggcagataaacaactttttggtgtatgttgcagacaacggcaactaaaaagtaaaaacatgaataaataatatataaagggaacggaccggaaattttgaagatagatccaaagctattagcatgtcatcatcaattccaagctcctcaagttccagccatgctgcaaagtcacttcccttctcctggattctagtcctttctttctcaactacctccaaggcactctccaaactccctccattcccattgtcctgttcatctgcttcttcaagttcagttctctcgtccagatccacacacatcaatgctgccattctttcagccagtcctggtacttccctcaactgcatatcaccaaaataagagcataagagcactcatggaagtaaaaagctctgtaaatgaacactcacaaaatgtgtatttgttggtcagtcgacatagctatcagatgatagcatgaaaagaataaaacggaccctgattttgcagtgtcgaccacttattaaccagcataagaaagctaataagtacaagacgttaacagcacccaaaaaaaaaaactatgacactcttaagttagttcgaactgtagctgcgctcacttaactagtcaatactccaattcacagtaataacacattaacaatcagcaaggaccatgctaaaatcgttccatgtatccaacataaaagtaaatggcataatagtacagcataaaccctacttgaagtcacaagagtaaacaaattaaatcaacaagtccgttataatgtcgtcattgcgctcccattcatcagtaatacactacgttatgggccataatacagctaggcagcacaaaagccgccaaaatcgcactaatcacttcccaacaaactagcgcaactgattccacagaagtaaaccacggtcccagggatagtattagtacctgcttaagcgcatcggagaggcggaaggaccaggcgtggtcgacgaggaagacatcggactccctccctagagtccactcagcggcgagaacgagcctccgctgcctccctccctcgcagggctctaccgagaaggcctccccgccgtcgaacacctcgtcggcgagcttgcggtaaagccgctggtgcagcgacggcgggatcccggatgcggccagcaggtacgcgtgcaccctcgcgaaatcctcgtagctccggatgcgatcatccggtgaggcggcggccggcgacatggcgatagcccccggcgagcggcgtcggcggcggcgaacggggtgagctggggagaagaagggtttagaggcttgagctagcgactggtgaaaccgcctcacaccctgacccatgggcccaatagcaaccaagcgctttttgggccgcgtggtagtagacatgctgttggatgggccttatccacaaggaatgggccgagttttttaaactaaaatccaca

SEQ ID NO: 57146 - DNA, 1501 bp, Oryza sativa
atataggtggtcccttctatagtccattctttcggaggactggctgtggtcgttagcggccgtcgctttctttggagaatttttgggagcgtagagtggctctgcccccgcccgctgtttggagtagagttaccgtcgtatcaagttttttcctttccttccttgttttttttatctttgtttttcttccttccttggcataggccggtctagctaagtgcatcgtgtaacaaaaactctattattctaatatattgacgtgcaattcttttacgtgttcacgaaaaaaaacatatgggattatattctaccatctcagccgttttaataatcaagttacgttaatatccatatatgatcatgtcatggaaactcctatagtgtccgggcatcaaaacaacatttttgtgaggctaccatattatccatgcatggaatagcccaagacattttcttttcgtgtctctttgagcgtttgaccttagggcaaaggtgcaggcagataatcctattatatcagtattgcatttcaacagtgatgtatgcaagagacaaaaggacacgtcctgatcaaacccttcaacattttaatgatggcaacaccgtaacttgttggattcaggtaactatcctaattcacccaagcggctgcattcagcttcaacgtgtcatcaatcctcagcttagattatgcagacaaaatgatcaacgaacggtgtcagaaatcgcaagaatatcagcaccaggcttctagaacatggatcataccccgatcatttggaagcatcggagcatttttcacgcattaattatgtcaacgagcaagacgaaatttacaaaactcacagaagagacaaggacatcttgatcaagatggacaaggccaccatgcagagtggctgtgagcagtttgccagttaactcaaagtaggatgcaacggcagcaaatgcttcaggtttactccatcttcagacatgacttcaattgtgaccaacttgattagcacaactcaagtatgccgacctgtgaattaatgcgtcgacatttaaaatataacaggaaaatatcactagctccagatccattattttctccaagttcgcacttctgttttcattgcataattcaaattgaatgatgtctgcaccttttaaaattcctgccttttatgatgaaatttcttccagtatgaatgttgtagagtctaacctaatagaaacgtaacgatttcgtgtatttgtcaacaaccaaataaaggaaaaataggtatgtttccgaagccgcccccagatataatgattttagttgaagcggctctaaaggaaacgaggcgtatcaatggaagaagcagggtaaagcacactgcgattagaatcgatcgtagaattgtagtattgcctatgacctttccaaatttctgtgggaaaattttcgcttcagtgatagcaacttattcgatcactctgatttgtctgatttctatctctatcagaacaccta

SEQ ID NO: 57147 - DNA, 1501 bp, Oryza sativa
cgtaataaatttattttttgcttcttcagtttgtcctaaattaaacgtatttttagtaatcatttaagtcgaagtatataaagtgagaaataattgcattaacatttaataaagtgagagtattcttttttttcctgtataggtatgcgtgaaatgagtgaaaataaatttattttgggatggatagattaccctttttttgtcaaaaaggaaatgttcttttatgatgtaagtggtatgacgagagaagaatcgatgcgattcacccatacaccattgccaccttccaagaaacgttgctgcgtgttacatattgttcacgaggtgagactttcaaagtgttcaatttctctctttcccgaaaaaaaaaagggtgtttaagggctcgatgattcttcgttttggtaagctactcctatcacaattcaagagccccatgacgctggcttcttcttcaactgtaaccattcacctgcaacaacaattacaatccaaactcaactcgtcctgccgttaatttttgtggctcagttcagccagcgcgatggatcatttggctaagccactgtacacatgatgtgcgatttatcagtgacctcaaatcattcattagccagcaaaggaggagagcgatatattattcgtaccgtcgcatgcacgaacacgacgtgggcaaaatggacggatcgatcatggagttgatgaaaaaaaaagggagaaagtgatcagaggggggactgattggagcgggtgtctgtcggtgccatctcggacaggcatcaaaatccaatccatgtccaccagcacttgtaataggagaaagttgtagctggtgtagtggacttgtggtgtggtagaattttatttatttatttataagatttaataaattattattttaaatttttatagaaatatactcctcctataggacgggaggagtatatttttgtaaaactttgaaacgataaaaaaaatctggtataatacatgttgtgtgttgcacggttgcaccaagctcgtttgacctgactgttctccagccgcgaatgcgagccggccacctgaaaagcccagcccatatggcagtagctcgtcagtcttgaggcctttggagttgaagctatagcccatgggcttgagaatttgattgctttttgtactacttgtgacatgagagtaggtggaattttttgtttatatatttattaattaaataagttacagaaatatatatttgttttaaaataccgggaagatgatatttatttttttaaaaaaaaatcgctctctaggaggatgagaagaggcttaaatgcaaattttcccgtataacttgtcaactttgtatttttttaattacaaatatgtcatagagaaaatccctcgtatacacttgaaattttagctgatcccttctatgcccctattttttacccccaaaatttgattttgatctctttcatgcccctcctgtcaattgacagttagttgaccgtct

SEQ ID NO: 57148 - DNA, 1501 bp, Oryza sativa
aaaacaattggatttatcaatggaactaagccatacacgttcaaaaaatatatagcaagggccatatatgttctgacaataagttctattatgagctcccatatcagatttatcttttgcgctgacagcagtgagaatagcacagaaacatcttttgataattactcatataagcacataaatataccttttactacaacattagaaaatttctaaagataagagacaattgcccacatgaaacagaaaaggaaaagggagaataaggggagataggcacacatttccgtttaaaagtattgaggtaaaatatcttacagatctcagctgttgaatggacttgtaaagagacttctgtggaactactacattaatcgcataatattccacagcaaccttcccatcacgtgagcggtagactggacttatggttgggccctgtttaaatcaaaatgagtgaatcaactcataagctttagtgattttccacatcagtatttcaaactacagtggttccagtcagataatcatgagcaaagcttttgctataagtttgaaatgcaaaactagttttatttcaaaggacctaaaagctttaaattgcccagattatgatgaagattaatcaggtctagatattagagcagctacaatacaattatatttccagttcaagattatagagtgctaatttatgaatgtggaaaataatattatttttaaagagatattttagcatctgccacataagtgcacatattcatggtcagtatataaaaaggtaaaatactactttggatacttttagtgatacctgtaatccacataacgatgtttggctgagaactctttccgccacttcttccgcactgttccccctcatgtttgctgtgaccttatatggcaatgtaaagtataataagtaagcaattaattgagtaatcacccaatttaagctacaaaattggtttaccattatctccccagttgctgtgaggtgagcctctaatctttcaagcatctcatgcgtaatctccaagacaccattacgtttgtgtagcgatctcctacatgcgacaagcgtggcctgcgtgatattacatatcttgtaaatgagcacaatttatcttttgatgaagcaaatgtcaattaaaataccaggcatctgctctcccacatgcatgtgtgcacgcgtgagaggaagggagggagaggttaggcttacctggctttccaaaactactccaccatcaatttccttcaaattattctcacgtaaggttgttccactactcacaagatccacgataacatcagccatacccatcttcacaggaggaaaaaagaattcttagcatttgttaaccttgataggctaattgtgtattatgtaagaacacacaagttcacatatcaagaatcaagacaaacatgccaatatagaataaagaagtaaagacaaatttcagttcagatctattacaattcaaattcaaattac

SEQ ID NO: 57149 - DNA, 1501 bp, Oryza sativa
cgtaccatcacggccacctcacccaacctgcgatcgattcgggccgcttggctgcgtaacctacgtgtgcgcgcgtttcccgcacacacggatgcgcgcccgattttttttactctgagcaggatgagaaatatattttttttgttttagcatcatagaaattaaattagattaataagcaggacgttgtggtcatgtagcgtcctgttgttttcatggggatgctaccctttgccagcgcctaacttggacgcctggtgtttaccgtgtccttgaacgggaacctggacgcggaaacataatagcggccttgcccgagcaactgcacacacgcaacaaagataacgaaacggatcggaattgcacgctgctgagttctggtacctggcctattgctgtctttcttcattatcctacagttcatatccctaatcttctctcctaattttctcttactggagaactaataatgcccaaatcttacattagatgatcagaattcaagtggggatcgcagattatttgctctaaggtatttcttttggttgtttcgaattgattagacatcagtactaatcaagtagcggatttttagatttattctatttatatcctgcaatggttgcagcgctagatggagattatgattaaaaactttagtgcatcgatcaaataactatcatcatcaccgatgctgctagatgcagatgtactcctttgtaatatgcacagtagtcctttgcattgagtatacatcgcttatacttatagactgcacatatatacccattccacccatctaagcaacttgataaaatccaagcctcttcaatagcggctcacataaataaatggtatagaatgctaccaacacgtacggtgaaacctgacactcttacacaccatcattagcctgcatacatagggtaaaaattagtcaatcattttattttattttttggaaacaagtatacgaaacaagctataacttacatttttctaaacttttgagattttgagctggcaatggggcatccacagcagtgctactgaaacgttctgaaacactttgttcagtttgctgaactaaagtttgatctccatctaataagcctagctctccatcacttcttgcactccatcacttcttgcagctgaccgacttagcccatcttgagtagccctcatcttactagttaccttaaaaaaattaatagagcgtgtcaaacaatttacaattggtatatttttttctgcaactcaaaaattaggattgtatggtgattggtcctacagtaaaactaaatcatttttccagattatgtgcacactattgtctattgtctccttaatcatcttgctatgttgagaaaacaggccagaatggacagacaaattagcttacaagcacttgctacgatggctgttgctcatatttcggtcattgtcctctaaaacataagcacgaaacagctatcgcctgaggcagtatcagtgcaat

SEQ ID NO: 57150 - DNA, 1501 bp, Oryza sativa
ggactagggcgtattggataactagaggatgccccgcacgttgctgcgggacttggttaacaacaatttgttagataggaggtacaatctcaagaagaaacaaatagattttttggagaaattctttttaacagccctattcaaaatttgtagataatttagatagcacatgtcaactgaaggggtgttcagccataaagctcttttatacggattaacgggctggatacatgtagatgtgtgtggagatgggccaatgtgtttatgtgggctacatttggtactgaggaggcgaagagactcacccggtgactaatgggttgggctatatgttacatttcatccaacgtctaagaagcgatctaatacattcatccaacggttacaatttaatgatggcgtggaagcacgaggttaactttattgatagaagggattagatctggggactgcttcgttttcgatcgatttggtttgtgccgcgttggcgtgtcggtgatggtcgcctcgacggtgatgtagtgggcctcgacgggaagcccgtattactgattctagaataggccggcctctgggatttcggcccatcttccttgtggagaataataacaacagattccctgagttatgagtaccgcgcgttatgatcttctctgcctgatgcgaatgggggtgcgaatgaagctgaacttcggtacagactgaaggtaattgatgctgaggtcaactaatttcagctttggcactacttttttcccccgaaatacggtacagacgcggatgttattatacacacgcatacttgcatttataaacgtacacacgcacacccttatctctattagcacctctaaaaattaagccagcatataaatatattttaatattgacgaaatcatcatagaccgacgtcttattattcagcatattttaatattgacgaaatcatcgtagaccgacgttttattatctagcatatcttaaaattaacaatatgtatatcttgaaattaacaaagttagcataagcatctcgttgtacgatatatcttcatattgatgaagttgatacaagcgtgtcgctgtcgatgcatatgtcacctaccaagctaccactgaaataataattagccgcaaatataaatgcatgtgtctagaacttaaactggatggctcagattcaatcataaggcggggtttttttcctggtggttgggaactaatttgcggtgcatgtaaaacggagcgactaattaatgcataattaattaatagtttttttaaaaaaagattaatatgagtttttcaaacaactttcctatagatttttttttgaaaaaacgcatcgttaatagtttggggagtgtacacacgtaaaacgagaaggaatgagttaggaacttcaagcaacgaacacaaactaagagcaagtttaatagtatagtcaactggtagcttcaaattatctatagccaatttaataatctattcatgcaatagtt

SEQ ID NO: 57151 - DNA, 1501 bp, Oryza sativa
gagggaggcgaggagccgttggattgtcgtcatcagaaactctatactctatagaagcactccaaaaatattcaaatcttatcggaaagcactccaaaacttccgtgttcatatccctatgtaaggaccacagaaaagtgcagttgttgactctgctctcctaaaaatcccactttacttcaacttcctttttcaaagtggctagaaggttaaatccaggcacctcaaaagaaattaaccaatacatgagttctaataaaaggattaggttgtggtcacagtagtaatctgactgtgagaaatgagtcatgcaaaaaaggatgaaggattagtgctaaaacatggcaataataaggcagcactaacctgagaaatatcaagagcctttcttccacttcatcagaaaaaggattggtgtaacaattttatggggaatattgtcgataggaaacaacttactaaaattctgcatgaaaaaaatttagttcctttccatcaatttgtttagaagaagcatatatatattagtcaaagtagggcaatacctttcagaaaatacgaaaagttcaaaccttttttttttcgccaatgccaaaaggttcaaacctgtaggaaaggcaaaaacatgagaaggattcacatagtattgtggtaaaaattgtgctcatcctgcatcagggcgtccaccatcgtatagagagtatagtagctggaacaactattaccttaaatacatatgcagcaagccaccacgaacaagtttgattattttgtttgaagtcattccacaaacacttccgaagcacttcttggtactgttgcagatgcagtgatgcaaacaatcatctcggacttatttgggctagggaaagagtccaagctgtgcactgatttttatctcgtgttctaatcaaaacaaatgaaaaactgagccatgctcgggccaagacaatgaagatataccaatcaatcagggagcagcaaatcgaaatgctcacatgtgttacttgcctccatgtgttttggccgccgtaggtggacacctcccattcttggatggctgcaagctcgtccgttccggttgtcacgtcggcgctgggagtcttgccggcgaccgtggtggcaggagactgagcgagtgggcggccatctggctgcgtacaaccaaagggttcagggacagccgtcggtcgaggtgaatctgggatggccgccggtgaaggcgatccgatctggagggaggcgcgatagaaagaggagggagggcgcggtgattttactgggggaggggaggggaggcgaggtcggatcgggagggaggtggggagccgttggatcgacgtcatcagatgattttcgatcgttggatgtgtcacacgattaataagtaaaaccatttatttaattatagggtagattttggttggagtaaaacatagccatccatatcctcccaccgtcgactccgcgagtgctcacagtccaccaaacagcaacccac

SEQ ID NO: 57152 - DNA, 1501 bp, Oryza sativa
caacttttccgtcacatcgttccaatttcaatcaaacctccaattttagcgtggaactatacacaccctaaagttactttatcccttcgacagtatgagtgaaatactgccatcttatacaatattatatttttagtttatttcttcccttcaacaattcgaattttgtctgaacttctggtgcactgatggatgaagcaacagaaaatttgtcccttaaaatgattcaagcatccttgtcaatttaataccccatcgatcacattgtgtgttcacaatacaaggagatgtccttttagaaacagtagtcatttttaatgaaacctagcatagttattgtaccttttccacacttgcatatggttttaaagtttggagagattttagttaatttatttcatttaatatgggtagcattagcagctttaccttcctatgactttgtccctgcatgatctgcagctatttgtggaaatgtggctgcctgtttagaaaattagtattggaatataacggtgtaggagatagctaaggtaaaaagtcgcagtgctatttaaatcacatgttttgatttttttctttcctttatgcaggtcccaaacttggaggtttggtttcagaggcccaaagatattgtccgcaaactacaatctggggatcttgaccttggcattgttggttttgacatagtcagtgaatatgggcaggtatattttgggaattaatgctcaatgttttagctcgggttgtgcatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgctgtcttgtgggagagttgagccatcccgatccgggagcaaagctcaaggaacttgatcctcctaaggggtttggtgagcaaatccgcaagctggtccttggtgttgatgtagctcgccttgatgctcccttcctccaagtagcttcggatgaaatgatacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctg

SEQ ID NO: 57153 - DNA, 1501 bp, Oryza sativa
cctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgca

SEQ ID NO: 57154 - DNA, 1501 bp, Oryza sativa
ctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccttcgctgctgctgcagcggtctgagccgttgctcgcctgcgctcttctgctgcggcgagcttggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgaga

SEQ ID NO: 57155 - DNA, 1501 bp, Oryza sativa
cgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccttcgctgctgctgcagcggtctgagccgttgctcgcctgcgctcttctgctgcggcgagcttggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagtgcataccgcatacctctagtttcatactaagtttcttctatacttatttatagcatacataatgttcttaatttaatatttatttgactttcttagcaaggctttaatagatttatacttgtacttatctgagatttcctgtggcagggtagtgatgatttagtagttgttcatgatgctctcgagtttggacattgtcgtttgtcccttgcggtatggtgttctagaattgcatccatgcgtactagttgttacttggttgaagtttgtatctgtctgaaactgtcaaattgcatgatcaggttcctaaggaaggcattttcgagaatataaatactctggaggatttggcaaatatgcctgaatggacacaagagagaccattgcgtgttgttacaggatttggatatgtatggtcgtgaataaactcaaagttgttcaagtgctccccccctcttggacattaatttgctgttcatttacctagttattttattgtattgcagctaggagaaaagtttatgagagaaaatggtttcaatc

SEQ ID NO: 57156 - DNA, 309 bp, Oryza sativa
tgttattttttagcaagtatagtttgatgttttaaaggccaagttcctcgtttggttgtaaggcactcccttagtgccatatattatcggcatagtataagatgtggcatattctagtcatgcgcatctgtgggtaaattcgtcttcagcggcttctatggagagctttctttgctgtgtcatatgctggtatgtgttatgttctatggctattatattaggtatgtagtgtaggccgtaagggtatagagattgggggtagcggatgaatgcttcctgacaaaacctctatgcttcttcatgtttaga

SEQ ID NO: 57157 - DNA, 393 bp, Oryza sativa
tcatcacgatactcatagtggcctgagtgagtctggaaggctgtcttgggcttcttttcaaggtgcaaccctaatttgggaataccctgccttaaaatcaagttaaaaaaaatacttagctccaaaaagctcatccagaagctcatcaatgacaggcaaagggtattttcccttaattgtaattgcattcaggtgcttatagtctatgcaaagtctccaggtgccatctttctttttgactagcagtgctggtgatgaaaaagcactattgctgttttgtatgactccagactgaagcatttcagttacttgacgctcaatttcatccttgagtgctggggtatgcctatagggtctgaggttgactggacttgctccttccatcaccctagg

SEQ ID NO: 57158 - DNA, 1501 bp, Oryza sativa
ttaaactattcgaacagccgtgcccacggtcatgggcggatgtgaggtgattcctagcgtagttttgtttgactactgcttgtgaaattactattgtggaatgggttcgatgtttggaaaatctgcggctgatgggatcagccaggcccgggtggccgtttgaaagccgttggccgggtgccaactttgaatcaattcaaagattgatacattgcacatactccgaccggacgagatgcactgtctaatccgtgtcgtttgagaagcactcacttagttgtttcaaaaaggagtttaaataaaaccaattgcaaaaacaacagcctttcctttgaagtctacattaaacacttaattcccatggcttgctgagtactcctgtactcacccttgctctatataaataatcccccctagttgtggaagaagatgatgtggatcctgctgatgaggagttcttccaggagcaagtcagctacgatgagttttagggtttcgacctagttcccaagtcgcgcctgtgatgaatggtccaagtcttggcttccgctttcccttttgtaatgcagttgtgagctcgggaactatccgcagcccaacatgactgtactcctactctgtaataaagagacctctgttgccgtgatattatgtcttcttgtgataccgacactgtttcctgggactgttatcgattaacaggttaatttggagcgtcacgggctagctccgttcggggctagttcggggcgtgacacactgtcaatttaactatttatttgtcccactgtgtatgagctttaaacattggattttccaaaatttgcttgttcggatcagtgccttcggccgattgtgtttcgtccagtgcattgtcacgaaccaaccaccatcgcgaagttgtcatcttgccgatgcgatctgttcggcaacacggtttggaacctgctgtcgcgcacctatatcaacaccaaccagcagcagtcagttgtgtcgccgtgcaccgaggcaagcagcaagacataccattgttgatttgttgatttttctctacacgcacactgtatcgagaagaattcctactgtgtttatcagaaactcaatccaatacgatctgctgtttatacgtgtttcaaaaagattttaaaaaaatcatgatattaaagccgagatctattactacccacatatcgaaaatccacgcgtgcagcaagacgatcaagaacagcaaccgatcgatcacggttgccaagagaaatacgaaaacctaatcagagaaatattcaatcaagctactatgcacatgtatctttatcttatctctactatttatataaaaattaaaattgaagattttttgccggtactgtcgtataatgatacgacatccgtgtatgagtcggtttttaagtttgtttgcttttgaaaatatagatccgtatttgagtcgggattttaagttcgttcgcttttggaaatatggatggagtcgtataagaaa

SEQ ID NO: 57159 - DNA, 932 bp, Oryza sativa
  unsure (1)..(932): unsure at all n locations
tttcccctccctctttcttttcttttcaaaagggtttaattaaatcctttttcctttagaccaaaaatccaataatcttagaaattcaatatcttctcaaccgtatgtccgtttgactccgttcaactcccaaaattcctcaaatctcgagatctatttaatagcacgtttagaggtcaataattgggctttattttcgccgtttgttgagttgtcccgtttcgcgtgtagtttcggagcctgaagacccgcagtgcgaggatttcgaggatctagctcaagatctcgagcaaggcaagtcacctttgatcatcttacacctataatttaaatctaagtatttcttttccgcaaatattgcatgaataggattaacacgagtaattcggccgcggcttgtgagatagcctgctggtcccaatcccaattgctgcaattaccctccttgaattattgaacacttagacctcctttgtcgactgttgtgcttcgatgcacgggccttcgggctcgagcattggaacacttcccttcaaatttaaaatatccaacgatgggtaaaacttggggttttacaaaagatttggaaaacccgacacctgngtcggtgcttgcgaactaaatgaatttccaaaaccacaaaccagaggacgtaccgggagtacggtttcccgctcttacacttaaggactgtttccttggaatttcatccgaacataagacaagtgcgaccacataggtgtaatgggacgcccctggctgagtaattagctaatcgggggagccatgatgccaagagacatgtggattcaacggggtggtgctggggagaacccccgggtttcctggcacagtatggtctgggaactaacctggtgttggtctgggacccctctcgttggcatatggtgaacctgtgtcggctttcgaaa

SEQ ID NO: 57160 - DNA, 1501 bp, Oryza sativa
atgcattgtatcttacagtctgtgttgcagctggctatagatctgtagcccgctgtttttctctctcatcttttatctcactaaaatatatttatagctggctaatagtctgctattgtacctgctcttagacggagtcttttacccctatgccattaagaaagttggaggttacgcgtgtgccaaaaaaagttttgagttacatgtattaccatgacacaaactttcgtttacccgtgtgccattccatccaccatctgttagagaatgagctctgacatgtgggacccacgtatgaaaatgactaaattgcccttgaagcattttcatctctactactcctctcctccagtgcgcctcgaaccctagccgctgctgccgttcgtcgccgtcgccggcacggtgccgccgcctcgcctcgtttatccgccgccggttgtcgccggcacgccgccgtcaccacctcgtctatccgctgccgcctctctagcagccgccgccgacggtcgttgccgtcgccagcacgccgcctcgcctcgtctatccggcagcgcgcctcgtctatccaccgccgcctctctagctgccgccgccgccagtcgtcgcagtcgcccgcacgctgctgccggtcgtcgccgtcgcccgcacgctgctgccggtcgtcgccgttgccgccgccttgcctcgccggcacgccgccgccaccgccgcaaaagtggctgaaatagaacaatggcaaaatagatctttcaaacctccgttagtctccattagtgctgattccatccaaagtggcgcacagttaaacgaaagtttgtgtcatggcatacaggtgactcaaattttttttatggcacacacgtaacctccaacttttttaatgacataggggtaaaagattctcttagacgcggtttatctggagcgtccagtcttccagcggacgcgacgttgttatagcgtccaaggtttctaaaaacacattcatctgctcacagtaccccaaatcagaaagggaaaattgaaaccatgccattataattttgcaaaatttaagatatgccatcctgacccacatgtcattgactcatgtgggtcctatatgtcattgagatatcgatggcatatctcaaactttgtaaaattataatggcatggttctaaattacccaattagaaacccaccattgaagcaccgatcatgagcctcggcggccgcggcggtggcggctaccagtggcgctagttcatcacgatcgagccttggagtgtgtgcccgtggccgttctgggtgcgcatccacgagactgagtctctcggcctcacgcgcggcgtccggccatctggttaattagtcatcctcttacacggccatgtactggttgtatgattacctcttttcgatttttgcattcaagagtaaatgagtaaatcccgtgtggtattcttttctttattcatacattgcactgatactgcctcaggcgatagctgtttcgtg

SEQ ID NO: 57161 - DNA, 1501 bp, Oryza sativa
agcaagcccgccttgcgccggagctcgggtacgtgaccgactgctgggagataagagatcgcccgagcccgggattaaggcagaaaataggggagaggaggaaggagtctctgctactttggcggcgtttttttttctctattgctcatgaaagccggcgtgatctagggttttgggcattggactcggtgagtcgttccaggtgtggttgcaagatgttgtagtcagacccagagttttggccgtggcaccatgtcaaagagtgggggattgtgcgcaagcctgacgccaatcctcttggaaggagcaaggggacatggctgttccgctgatttcgtaccttcgtgagttttccggttcccctccatcatcgttatgtgcttttgttatcttaggtcctgttcagtttaatattattttcaaccattttttcgtaaagttaccaaaattttggctatgtttagtttgttgccaaattttaataaatacatatgaaatcttgctaaaatttttgacaaccttaccaaaatttggcaatgtcaaaacttggtaagattgaaaatgatagcaaagtaaacaagcccttatttcccttggatggatattgtcaaattactctaagctccatgcctcatgtactatctgtcttttaggacaaacaaatggttgcaattatatgcagtgtgcttgcgctaattgccaaacatcagttcaactatattataagttcatctatcacgattatttactcttatttttctgtactagtgatcaaccgcccttcatttcagaaataatgcatcaaagcaaatatgcggataagtagaactagtacaacttatgctgtaccacccatccatggctcacatgttacatcctcccacgttgcttatacaaacaatgaatgaataaactacagtctgttcgatctcacgcgcaaacctcaaataaaacgaccataccgacgggcgacggcccgacgccactacgccagctttagagttagaggcgcgcacatcgcttggatttgctctgcactgactcccatatataccacttcgccggctaggcgacccagccatcctctaactcgcaacacgtaagcctgcaccaagaacgactcttgcttgaccatgccgagagcgcgaggtctttcctgcctcatgtcgccgctcagcggcaagcgccacgccggtgacgcacgccgcagcagcgccgcgtgcatatgctgcatcggcccacaccacaagccgtcgtccgccgtcggcggtggcggcggctgcgtgccctgcctcgctccccacgccgaccacagcgtgagagcgcctctcaccagctgctgcggcagcggcggcggcggcggtgacaacaacctccgcggccgcagcagcaccaccaccagcgcgcgcacgccgcgcacacccaagacgccgtgcacgcccacggccaggcgactctgcggcgtccgctcccgcaccccgcgccgcgggcaggtcggctg

SEQ ID NO: 57162 - DNA, 1501 bp, Oryza sativa
tcacacacacatatatatgtgtgatattttgttcaatgaaaaaaggcattaattaaagttacttttttttataagttacttctataatatatgtaaattacttttaggctttactgattttacttttatatgtctaagaagtaacttagtgaaatctaaaagtaatttagacatatcataaaagtaatttgtgatttttcatcaaaatataatcatgtgagatcttgttataaagatttaattattacgaacacaacggtgtaatcggattgtaaatcggatgagtaatttaagagaaaattttatttgaatcatagatgataggaatatttcccctacttgctcaatggattgatagcaaccaaaactcctaaagtactagcacgcggatgtctctggttaaaactaattagagaggcctctctaattagatttaccgtttgctaaaccagaatgtctgttataagacacgtgacccactaaatggaaacaatgcacgtttgtctgggaaattggaagctattttcatgagtacaatttatggcatagccaaagtacgtaaaaactaattttaggataggatttttatgcttttaccaataaattacacactagacactacatttttgtcgagttccattttaaactaccttttgaagtgttttttctcattaaactagatactgttggcaattattgcactttttaaaccgagcgacccacgtagacataagaggtggttagtcattgacatgcggccacccagttcaaagtgcaactcctatatacaaattctttggacgtaatagtttgtcgttgacatggccatacaacgagaatccacatcctaacatatattaagcatacctagttcaagtgaaaaaggaccttcttatatgataaaagtgaaatttcggtaataatatgtgacccagagtgcaaattactttgccctttactcgtagcagccaaaaattacaaaagctgaatataaaaagcaagaaaatcctcaattaattctaaaattaagttattccaattcaaaatgaggcaggccagataagcaggcaataaatgcagcatttgaatttcatccaaaagcattcgattttgttatatatttgtcgacaaattttttcccaaaaatttgacagatgtaattacagtacatcaattgaagtgtaattacactgtaacttgcatgtaattacactgtaactatagtgtaacttgtatgtaactttcaaaaatctctccgtaacatgttatttcggtaaaatggaggtcgtgggaacaaattctttcacatatgtgtgttttcctcaccaaaacaaatctagtaatagatctaacgattcaaaattatgtgaaacttacatataagttacactgtagttacatgcaagttacagtgtaattacatataagttacaatgtaattacactatgattgtactataattacatctgtcaaattttttgggaaaaatctgtcgacaaa

SEQ ID NO: 57163 - DNA, 1501 bp, Oryza sativa
agcaaggagtagaaagaacaaccaaccaaacacggaaatgtggacgtggacagcgcgagacactgagatggctggcgccaagtgatgaactggtcgtcgcgtgcgctgctccgtggacccggtgcacgaaggccacttgctctctggccaagctcctaggggtaggaaaaaaaaccgaaccgaaaagaccgagatcgagaccgaaaaaactgagaccgagaaattcggtcctagacagtgaaagactgaattttgttaggtcaattcggtagtctcctcagttaaccgtatataccgaaaagaccgaattttaaaaaaaagtctaattgcaacctacaatccactaagttcaataggattaaactctaattttcacatccctacttcttctagacatgcaatctaataaaagtctttactcaaacatgcttacgaatttattttgtgttaaaaataaaatgtcaggaccgacaaacgtgatttttgtgttaaaaaatccattatttctttgcatatatgaaaatgttgcggaatttcggtcagaattgagaccgagacggaaaaggccgagaccgaatttatcgatcctaacatttttgcgttgaaattcggtcttcacttttgaaataccgaaataactgaaaaaccgaagaacgagatcgaaaccgaatacccaccctacaagctccaggaggtgtattctgctggtccgtggactcggtccacgcaggtgctcgtgccggcgtacgtgcgtgcgtgcgtacgtgcgtcatgtggctctctctctcctcgctagattgcgctgttcacttcgcggagctggacaactggcaccccccgctactgacaggtgggctccacagtcgggtgggccgtgggcccaccaggcagtggatgattaggtggcaattagttctttttcttcactaatctgattggattagccacctacgttaaacaaagcaaagcccaggttcatgcgcatcgcggcagctgctttccgtttcccggaagctgcacctgcatcgcagtgcaggcgcgctgacgtcaccgttccgaatattaacacgagaaaaaaggattataaatgtgtgtaaatttcttggcatctcgactgcttctgcttctgcattgggccaactcagctagggcagccattgatttgtcctgatttaaggtcgtgatgagtgacgaccatgtgtaaaaaaaaaaaaatccgtcccaacataaatgtaaccggagaacaaaatactcactccgtccataaatatttgacgccgttgagttttttaaatatgtttgaccgttcgtcttattaaaaaatttaaataattattaattcttttcctattatttgatttattgttaaatatacttttatgtatataaatagttttacatatttcataaaagtttttaaataagacgaacggtcaaacatgttgtcaggattacggataaggtataccctctacccttggatatatgttgtataccgata

SEQ ID NO: 57164 - DNA, 1501 bp, Oryza sativa
gcgcaccacgatgccgccccttcctccgcgcgcccaggccgaccgccgtccctccctttgctcgccgacaccgctcctcctcttcctcccttcacgaatcacgccccggccagccacgccagtacgccactgagacgtgggatgatgggatgaagggatttgcaacttgggacaagtaatcaaggtcattttggtccattcatgttagtaaatttattttttctttttgttaactgaaaccctaacgggctagtgaaaacagggtcaaacggtggcttcgattttgaaaagtggggtcaaatgagcaaacatgaaaaagtatggtcaatctggtagtttggttttaaaatagggtcaaataagcaattgtccctttagagtatgtatactttctataaagttatagtccactaagtctaaagctcaacatgcaatcataccacatgatcacccaatagcaataattacatattaagcctcatacaggtatacaacatcatctacaatttatttatttctacaaatcaatgtgtaagcatttccaatcatcaccctcacaccatttgcacaatattttaacaaatccatctaccatttttataagatctaatatatacttataatatgtttcacattaaggcgcaatatcatttgtttgtttcatgattatcattgataaaacctgatgcttcatttttactcctagtttgattgtcgaaaaaaatatattgataattgctttgtaattatcgcagcaaagcgcggggaatcacatagtgttcttaaaccgtaataccaatacagatataacgcgtctcttaacttataaatcgggtgctttttgccatgtgtggcccgctgctcgacagacgcagggagagaggatgaagaaagctaggaggagagaggaggaagctaacatgtggggctcatcagttgtttcttaaaatattaagctgggttttctaactttttcagattctcaccagctatcttctcaccggctgcttctcagaatattcggactcccacaaacaggaccctatacacattcgacagcagaatacgtattatgctcaaatacgccttcgcgtggcggtcgcgtaagataaactgtgacggtgctagaaccttctatccacccacgactatattacagtccggtccacgtgggggcccaccccacctcccttccctcgcctcgccgactcgccgtgggcccccaccgacgcaaaggaatcacagccttccatctctgtcgcgcacttatttccgccgttaatctctccgcccaaagttattccgccgcctcctcttccccccctcctcgttctcctccctcccacaagcccgtgcagacgagacgcgacacgcgacacgggaagaggaggggggaggggaacacacgccacactcctctcgcccgcatcgcactcgcaccgcacgcgtcgaaggatcgggaaggcgcagccccgcgtcggatcgagagctagggttatga

SEQ ID NO: 57165 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgctgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcaagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccacgtgtttctcggcctctgcaaaagaccgaggctcaccgtcgtcgcacgcaaggtgcaactgtgcctctaggtcgcgaggcaccagtcccggcaccggctggtcgccgagaagatcctccatcgtacagtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggtggtgtcgacgaagagctcgtcgtagtcgaagtcgtggcccgagggtgtgttggtgtcggagtcggtggagattcgggggctggggtagacacgctaggtgaagaagagctgcctactcccccagctccctcgaagtggacgtactcaacggtgaagtcgtcgtatgtcggagtcgaaccatcgtccaccgccttgtcccatacccaccctcgcccttcgtcgaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagatccttggcgaacgcgaggcagccgaagacccgcaggtgggagaccgccggcttgcgcccatgccaagcctcgtacggtgttctgccatcgagggccttggtaggcgagcggttgaggatgtaggcggccgtcaccaccgcctccccccagaagatggccggcatccccctctgcttgaggagggcccgagccatccccacaaccgtctggttgcggcgctcgacgacaccgttctgctgcgggctgtacggcgtggtgtagtggcgctgaatgccctcatcagcgcagtacgacgcgaattcagccgctgtgaattcgccgccgttgtcggtgcgcagcacgcgcagcttgcggccaca

SEQ ID NO: 57166 - DNA, 1501 bp, Oryza sativa
gcttgcttacaaacatcaaagatatggtaagtaccttgccgttgataatccatgtcggaaaaccttctataccagcagctgcacattcaggagccattttctttcccttgccagctccattaggaaaacattcaacatagtccagaatttttgtagcttctcgaccaaaaatctgcatgaccacatgataaggtaagtaaaaacttttctacttccagtttggagatttagttgtgcacacaaataaaaaaacgaaataaaaaatcatagcatcagcatatttacagaagcattagagtagagcatgtaagaagctacagaaaatcatccggtattctgtacagtggattcaagagcttgtgttgtacctgtttttgttcgttacaatgagaacaccagaatgctccatacatcttagcgccaacagagtgcaaatgttttgcaagtgcaatagcaaatggggttgattcggttgttatctctgtatcatatcgttctaaaacaaaatcatctgtgctgcatatatagaaaaagaaaactgaaagtcactcacttttggcgatgaagacaatgcaatatgtaagataaaagttcatatggtattaatcagggaaatcccacaacaaaatattgtaatagaaagagcggtgtttttcttaacatgcgttttaattgtcaagaccaaaacagctgctccaaacaagaatttatgatggaatatgatgttagaatttcaatggttactctcactgagaagaggatggcactcgagatggggcaattttctgattttcttcattcactaaacacaaaagccatgcctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcaactgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgcggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctg

SEQ ID NO: 57167 - DNA, 1501 bp, Oryza sativa
cctcgggtgccattcaccttcttgaaggcgttgcttttaaagcccttgtttcaactccacttcaagggaattctccgagtgaaaaccttagattcgttaggatcggacgttgtcgccgtcttgtcggcgttaccttcttgaaggcttcgttttaggagtttcttctcttgttggactactcttatttgcgttcagtttgtcaatgccgggttttcgccggtttttctaaaattaaccgtgctgttgtaaagtttttgggtctgatttttcttatatcaactatcttcttctatagtgaaattgtaggagctctctgcatgtccctaaaaaaactattaaatttgctcttaagaagaaaatgtgtggatctaactacccaattagagaaagaggagggagatttttagacgaggtctactcattgcctggagatgaaaaagcaggtctacgaggcagtgccaacaaacaccgtcaagatcaagatcagcacatgtcgttccaacaatccccatttatctcactcctctcaatctcttttgccgatgcttgctaaattattgccatcacgttggttgccctttttttcgctcagtccccacggcaaaactctagctccccctgtgccacactgccacataacttgcttgacggcctctgtgtcaaatccggcatgtttggtttcttgccggcatgctggtcagcatcggaaaacttccccttcaagagagggagagagctacaaatcggattaggcggatccagctcgtcatgcgaaccagcgccttcgccgccagatcgatctccttgaccggaatcaagtccagtcgatgcatggatggagcttcttctttgtgtttctggacgtgacccaccatagattttgctctgccatgaatcaagcaccgcctagctgcacaagcttaacttctagtttttgtttatgttgtcaatcgattttaaactaaaacagggtgttgtgatctggtctagcaagaaacggagagaggaaatttgggttaagaaagatgagctagcatgcataaaaccaaacgcacaactgccaataaggagtacacttttgattgtacatgttaacatatttatacaaatttaatcatctaattattaatatgtacttacttccgtttaaaaaaaagataacatagtactagaatatcgaatttagatatagaggatgtgtcacattctaattcaattgtcataatttttttttaagtagttggctctcggtatagctgcaaatctaaatgctacagtagctagtttccgcgcgcggcaacggggacccgaaccccgatctccggtgggaaatgggcatcatcgaccgtttggcggatgtgaatagcactactccatctgtaccgtccatgccacaaaacgagtggctcagatcgcacacaatccaagagacccatcaccttatcctcttctccctcccgaatccaaacccatcatcctcttccctccactccactgccac

SEQ ID NO: 57168 - DNA, 1501 bp, Oryza sativa
ttacgacatgattcctaatttatccgtttcataatataaatcattttagtatttcgtaaataatataaatataaaaaatgctagaatgatttatattgttaaacgaagggagtacctttgaaaggtgaaaaacaaaaacctctgtactgctagcatgcttattccatagagtcgaaccgcaggttcacacgttgcgacacatgctacttgacaagtcctcaatagtacacagtcacccagctcaaatctcttgtgatgttacgtaagtatgcagatcagctgttgatttatcacctaccggttttaattatattcgtttagaactcacgaactaatcagtggagttgacagaaatttatgagccaagcatgccttaactagagccaatcatgtgttaatccaaaaaataaaagagataataatgtacttgtacgcatctcgtcgatcgtcgcttttctaatagtatacccatatcactaacactggtggtcaccatgcacgcacatatacattttcctacaggaaagtataagacggatggcagaaagacatggtaggaaaagaaaagaaaaaaacaaagcaaagaaagaagcaactgtctgatatctgaagaatttagggcgtgcgagaaaagggatcagacagttgaatggagttgcagaatgaggctgagctgaggtgatgctgagtagtgggggttggggggataagaatgaacggaacagaagtggctgcctttgcatgatgtggagaggaagcaaagcaaagccgataaaagattagggcttatcatgttcgtacggcacgcaccaccaacgccggtgcggtgagatgcgctgccacgccacacgaccacgagactggctgactgactagctgaaaattcatttccgttttgttctatataatatcatcataaatgtgaattatgagtgcatgcatcatgtatgggtatggcccctctgataggtcgacgtttttggatggataatgccaagcttttaatttcgttaagcatgtaccgcatttttgagttcttatttcgtaggccacataattggaggaatggagaaagggacttgggagctagccaggatgctcatgagtcatgacggtataatttcgtcaactatggaaagaaaggtcttaattccaaagaggaactcaagtcttagttttgtgcagtgttattcccctttcttttccttttcttcttcacttgcaaataagccagcaatggcatgcatgtatccggtgtccaaggatcatggctacacaatggagtgacgtgcaactcagtcgcaattgacaaaggctaacaactccattgactgattggtgttcaatttaatcgaccttagctccagtaaacaacagtttccgttacgtcctttgtgatatatactagcacgttctggtcggtgtttctaaaaattaacttgtccatataatataagtcttatactatcatcacgaatcacaacatacaaaaacaagattt

SEQ ID NO: 57169 - DNA, 1501 bp, Oryza sativa
tattggttgtgggtaggctgaaataaaattttgatccgtgcttcgtggaaatggattttcagccgagaggatgtctctcgcatgccatctaacaaatgagctttgacatcacaaattaatacgtgatatatcgcttgaagttaaaattcaacccaagtcatcgcaaaagaaataaattaaactctaaatagttcatgtacttgtgtaagttgaatttaaatattcatgtttgtaaattgatatatcaaatactaacttctctttccatttgaaaaaaaaagcgtttagaccataagaaacgagtgacacctccttttggagaaaaatactttcccagtgcttcatacacagtagcttttgtaactagtgttatacattacgaccgctaggatctctttgattcggcaagaagattgcaagggctcgggtaggctgtgcatgggaaaagacttttcatacaaaaggaaaggattaattaaagagaaccagagaattgaataggtatggaattaatcttcttcatagcttttgatttatttggtaataaaaggattaaccgaccaagaccaggaaaggaaatggtggcagctcgcgagtggtggccggcaatcgacgagatatttaactatctgccatatttagatgtggcaattaactatttgacactagacccacatgtcatagacacgtgtggatccacgtgtcattaagataggggtggcaaatagttaattgccaaatctaaaagtggcaaatagttaaatgccccgcaatctacacgccttgagccatttaggcatatctttgatgtgccgccgctcgcttgtggccattgcgctacgaggagtaggcgtagtgaaagagaataaaactccgaccttgtcgtgtaacactccaatcgttgtgtgggccgttgggctttagcttttctattcagctttgggctttaattcttctcggacttttttattttctaaaggaataagttcacttagtgaccatcaaaagtgattgaaatctaatccgtaaccctaaaccacaaaaccggatttggaggacggttttgctgacgtggcgcctatgtggcggtattgaccgggtctcctttacaagtggcgttgaggtggcatttagaatttaaaaatatatgtgggacccatttgtaagtgacacattaaaaattgtgggacccacgtgtcccttctctctctcccctccctccagttccttctccctcctcgccgctccctctccctctctcctgcggcgggcggcgagggccggagcggcggcgggcggagacggcggaggcgcgggcgtggcacggcggcctgcgactgcgagcggcggagatgcgggagtggcggcggcaggcactggacggcgggcagcttcaccgcctcctcgccgacgacgaccaggcgtttgagcaggaggacggcggtgggaggcacacgcggcaggttcgacgacgacgacgacgtcctccaccgtccagatt

SEQ ID NO: 57170 - DNA, 200 bp, Oryza sativa
cttcggcatcacgcagccagccgggcaggtggtgccgcctcgccggtggcgaagttgggggtcagaattcagatccccgcgcccttgacagtttccataccgaggcgtggcctctgcgcgcgcgcgaatctgagctagatcaccgcgcccttgtcgattttccatatttggcgtggacgggcgcgtgcgagatcgcgaga

SEQ ID NO: 57171 - DNA, 194 bp, Oryza sativa
cagctgtttctcttgtaacaaaaacactgtgcaacagacccggaaaaatggttgacatttattactccctctgtcccaaaaagactttaactttggctatgaatctagagaagcatgtccagattcatagtgaaaaatgaagtctttttgggacgaaggtagtagtacctaagtatctgctcttccttttcaga

SEQ ID NO: 57172 - DNA, 1501 bp, Oryza sativa
ttgggaggcagtggcgtggcagggatgaaagaggagaaagggcggcggctctcgttcctctctagggcgccggatccgccggcaaggagaatgggatcaccggatccggcggccctagtctcctcactgggagatctggcggggagggagcggcgatggcgttacggcgagatggcttgttgagggagtggaggcggcgatggcggcacggcgagatggttgagggagtggaggggttgagggagtggaggaggagggagttgcggcggcgacgacgcacgcgaggaaggaggagggtgaggatgcggcgcgatggggggagaagggcgagacggcacgcatgggggaggagaggacgggcggctagggtttggacgtgttggcgaaatccacaccgtctgttagagatccaacgatcccacgggtgtggaagggccgccaaagggggaacgtgacggccagatcgagcctatctcaagatcggacggtggacatagcaaggaccggcacgtaattaatcaaaagcatggggtttattttgcaaaagacggctgaggtggcacgctaatcttcagccattcccacggcatttaagtaaactaatatatgactttcacatttttttttacagtagatgacaactaagggcttcatcggttggcctttcctattattaaagaataggagtatataattatcgtttatttggtttttttgctaagtaacttaagtatgacaattactactgtactagttttcaatgagataaatgatcagaagtagtactgttcaaaagtcaaccaagcgaataactgtttccaacgagagtcgcgacaaaccgtttgaaccggctaaagtggagcggaatgggccgattcagcccatggacggccacaaatgatctcggcctggatctccagctgattggacattggcctccacgaagcgcagaggggtgggaggaggcgggaaagccgaggtgcacggccgagacgggggagggaaatggaggctgacggcggcgccgccggcgaggaggcggaggagaggaggaggaggagcgagctcgggtccctcgtggaagccatcaagtcctccgaggtgcgtgctcgtgcggctcctcgtccccatttgctccgttaggccacttctagggtttagcttgatacattgttcgagtgctgcggccgtgattggtttccacgaatagagagttcggtcgagtggaatggatgtagatttggggggtggggatgggggaatggatgtttctgggtgggatttaagatgaatctccgcgaacttctgtaggtgttggccgttggggtttggggatttgtgcgcgctctagttaatccatactcttccaggcattaataacaacatgatctgtatataatagcaggttttggagaacagaatttcccttatcaaccaactcgaggatccttttcagttgtgtgcagatgatctgggcctagtggttgaaagtctgatcgta

SEQ ID NO: 57173 - DNA, 587 bp, Oryza sativa
gtcatctattaaaaaacggaggtagtatttatttttattcttagaggtaatagtatgcacacaaactgagcaggtattcttttcaggctcttttgaagaggttaggtgtttttatgtgatctctgcaaattattgattctataatgaggttgcgtaaatatgaagtatgatattatctagattccaattacattgtgggacatagtaattctcattgctattgtaggccatagtgtattgattcctgtgcatcgcttctttctggagttcagttaccacgttggtgcttcatatgcaacagcatggaccaatttactatgccatgtcctaagaaggtttgtgcatgacaagaaggtatctaagataacactctttcgttaatgccaactgttaaacatagaaatcaaagtaatttattttgctaccatttcctttaggtggcactcacatattgttcaattgtactggggacattaggctttattactgttattgggatcaatcagatatgcgttttctgctggttttgctcatggctatgtacacaagaaattttagattataaaataaatatgatggaccaatgt

SEQ ID NO: 57174 - DNA, 1501 bp, Oryza sativa
gcaaccattttgtcacttggctctgttcgtagtagttatattcgattggggttgcatgatatatatttctatcttgtcatgatcaaaacaaaaatgtcacctaataactgtcacattggtgttagcacaattacaaaactacaatggagataccgttggtttaggtaggccaccaatttctcttcacaagtcacaagatggagttcatggctcccaaataaatccactcatgaagctgatgcgtacttgccccatctgtttcactagttgcgtcctaatatttttagataaagaaaaataataataagaacgccctgtcctactaatggataagaagctcagaactatgcacagtactcatgattctgacctgtgatttctgttatccgaaacagaatcagaatattacaaatcagctgtccatttttttgttcactgaaccaaacgagaacattattagcttcggctcttaggattatcctaatgtctgaatgcatgataagacttaatatatatctactaagtacaagacttgcctctgctaacttggcaacagctcttcaatactactgtcactagtatttctgtgcacctaaatgagcaaccatctgaaacacctaaccagaattgtacttctgaatctaattgggcaagaacatggacctcaaaccaaaggctcatgtgtggaaacaagcaaacagagacagtaacaagaactattcaaaactacccttcgtgattaaaattcagttgttcatttggagttctcctaaccactagattcgagtcctctttcttgtgctggtcggctcgtatgatgattgattatacggcagcaaaatgccaagtgttggaggttactgaattcctactgcaagctaagcacaaggggacagtgaattataccgccgggccggccgctctgtctcactcgaggctctcacacatgacatacttgctttagtgatcatcgtgttgcttgcctacaaatgttggagcctcagtgatcggatcagattgttggctgctggtgctgcaaatcgattgatccatgctgctgcacgcatggtgtacggttgaccacctaaccttctcaagtgctagttgctaagttgctcggatgtttgattgctttggcgctgagcagaattgcagaaccctcggtttcaagtactccattttaatttgatttcaactaccaccggttttgttgtttgtgaaaaaattagttcaaacgtatcgttttatatgcgttcatgagctgtttgattagaagccatgacctggtcctaggccgtggagcgtggacagccaagttttgaaaaagaaaatggacaatttgggcagcagaaatgaagaaatgaagtgcttcgaagtctgaatcactggttcacttgcagctagtacctagtttcagatcgaaaggcagaagatgctgtgttgatccaaccctgtaccatcacgtagacacgatcactggcaacgtaatgcgagggaaatc

SEQ ID NO: 57175 - DNA, 1501 bp, Oryza sativa
aataaaaactagaatattagggaagaacctaatatcaaataattaggaggggtgaggctttgaacccaggtcgtctagcccaccaccttgtaaagctagccggaaaacccctgggcatttctcgagagcgactagaatgaatatgcagattcttttatgtcaaacgccaccggccgccgatttggtcggctgagttagttaatcacggctgcggcatctgtctctagaatgtgagcatgttcgtctagcggaaaaatctatcgatgaatgcagccatgtgctgcagctatcaagcttgacaatactagagaactggtatcccggtatagcaggagatcgccagatctgcatgagtgcaaacaattgtaaccgacaatactaatctgcatgagtgcaaagaattaactaataccagtatcaaatttagtatttatttaaagcttagtggctaattgcacacctgcattttcagtaatctgaacatgacaacatacttgtgtgtggattctgaatttctgagactgaaattggcattggtgcaagcagcggagaacaggtgggcttgaacacgagcaacaagaggtctcagaagtaagagcccaatctaaaacggcccaagataacgacccactaacggcccaatataaagcagcccaagccgccagccgccggccgaaacacccaccgtcgccgacttctcgtgcgcaaacagtgcggttgctcgcgcactacgccggcgagccgcgggcggcggcggcggctgggagtacgggagacgccggaatactagcctcgcatcctcctccctcgagttcgctgcgggaccgcgccatcctcgtcggagccccgggcccaggggacacgagcttctccgccctcttgtccttcggtcagcaccgacgccgccgtctcgctcgctcgctcgatcgagccgttgcttgtggccggaggaaaggtatactccctcgtttcgatttgttgccgtagcttcgcggcccgttagaagtgtttccaactttccatacacgctacgagtatcatcaggttgtttgtcagatatgggattaggctgctgttgcagttgagatgtgatccttttgctgtatgttctgcactctgtttccatgttggtgtaagcagcttgcatttggattttggagagatttgcgagacaaacgtagtgattgcctttgtagggggttgctttactgtctaggtagttcctcaatttagcgaagcaattttggcagctcgtttgattttttatttggggattcaagtcgatccgttatcaaactcctcaaattagcactagtgtttactaagtaggttgttcatatagattcccccccactctcttcatcctttggtatagcagttttttttttatttggaacggatctggtatagagaatctgaaatctataaattaagggtccgaaaagctactatgaatctacgatgcagtcatgattgaatactattttttaaaacgcatgat

SEQ ID NO: 57176 - DNA, 1501 bp, Oryza sativa
tcatgctgcgccaacccttcagcaaacaaaagtgtgcaagtaaaatgagatgtggccgcctttcccggaataatacagcaagattaaccagacgttactctctcttcttccttttcttaagaaggaataaattagggtttcatattactatcattcaactttataactataggttagcgcggtatctcgaagagaaacagaaaagaatgtagtacatgacaatgacatctttaattttggaattggtcgcaatctctatccgacaagcttataccaagtccaatattccattgatgtggacatcgtatatgatctagtccggtcacagtttcgagaggctcaacaatatataatcgcctaattaataagaccatgcagtgttacatattggtttagttaacatggtatcatttaattatatgatccgatgacaaggctgaagtttattgtggaattacagcagaaagtctaattaagtatgtagatatccagcttgttgaaattttgcatggtagatcctttatgagttttctaaaaaaaatccccactgatacaaacacaatacaattatgcaacgttcacacaccattgattacatgtagactatttatctacgtggacaaaatctcttatattttaatatggaggtagtagtaattaatgacaagttatgcaaaaaaaatcacaaattaaattactcatttagacgatatcatggctaattacctccacctgttgagaaagttacattctcggacgacatgaacttcgtaaggaacacttaatttcttatgcgaatcacgaaaattctaaacgatcttaatcaagtagtaaaacatgaagaccaataaataaaccgagagaatgcctgcagaaatgattgcacttcaattattgagtaaaacagattatttgtaaaaaaaattatgtaaaacagatatcgttttcaaatttaaaactgtggaataactctcaccccagcagccaaattggagagttactcataaatattcggcacagcaaaagggaatgaataggccataatgccatatgtttcaggtgagtgaaaaatgagtcaatttgtgtgacctgacaagtctcctaatgcacactcacaaataagcaaaaccctccaaattaaatacagttaaataaattttactgttaagccgcccagattattttttactactactgaagccaagcactggagactgcactggtcgttgtcaccagtgctaagaaattgcgaccggttttctccatgaaaccgcgttaaagtattcaagcaatgcaatgcctttcttttctatataagctcgttgcctccacatccacaaccatctccacctcacctcgtccatcgtctccagtaaaaatcaagatcggcaagccaagtgcagaggcaaccaccaccaccacctggagcagagcgagcgagcgagcgagcagagcacactgtcatcaatggcggcggcagtggctgtggctgggccgtcca

SEQ ID NO: 57177 - DNA, 1501 bp, Oryza sativa
cacaaaaatgttgttcttgtaagaatattggagttatccttcttttgatgtttgacatagcatagctggatataaggtagagtctaaaaaaaatgtgcaacttcataatacacctataattgaattggtattttagagcaaaccaccatgtaaatggtacttcgtaggagataatgtacagttagtaaaatcattaattagaagcttctgtcaagatgttaattattaagtgatggtacctccgggaatgtctcggcccaatcttggtacaggaattgtggctagcactggaatgttcgattcaataactctcattacagcagggaagaatgccgaactaaacagctccattttacccacttcatcaataatgaaaagatcagtgtcgtccttgacctgatgtgtaaaaagagttattaactccagatcacatgataaataatttttaaaccagctattctgatcattgtacaattaatattacatgtatcgcatgaatgtgctaaaacaatgtgcatcccttactttattttatacatctttagtcagaatggcttacctgcagctccggcaatgctagagactccagagaagctatatctactttgtacctcccaacagtaggccatctaacagactcgcggctgcaggaaaaaaaaacatagatgacatggacaggaattcagtaagcacacataaaaatcggattgacagtgaattcaaatataagtatttaacaaaggtcataagtcaaaccttacaaatttagttctgagataataagtagagcagaatgttagagaggacaataaggaaccgcggaatttcatgtacttataaatcagtattttgcatcggaactttcagaaggagtaatatcaaattttcctggtgatggccagtgacattaactttttttgcaactacggtggcgatgagaagcgtgtaactttaatccatttttctagttggatcatttccttgctatgtatacaatttgtcagtcaaacggatccaagttcagcaaacaagggaaaatgtcagatggacatgaggctgcacatgatccgagacatgaataagtagcttaataagctggataccagcagtggggcgatattctaccatcattgtcattgcataagtgtgcaggtaaaaaaaatacaacagatataggtaactagattataccgagtttatccataagtaagaaaaggcggcactatttaacatggacatggatgttagctacctaggattgcagctaaagtgcctgaaacttgatcatatgcaggaatacagtactccagattttgaaaacgaaaatgtccaaactaccacatcacaagtaggtggtggtggcacaggaaattgcgagcattctatcacatattcttttagcttgtcacaacagccagatgcacttgatttcagtgtatgaaaatctctcgcttcatatatgtcagaaagggaatcataatccaagcatggtagcaagatg

SEQ ID NO: 57178 - DNA, 1501 bp, Oryza sativa
cccagacaaacgtgcattgtttccatttagtgggtcacgtgtcttataacagacattctggtttagcaaacggtaaatctaattagagaggcctctctaattagttttaaccagagacatccgcgtgctagtactttaggagttttggttgctatcaatccattgagcaagtaggggaaatattcctatcatctatgattcaaataaaattttctcttaaattactcatccgatttacaatccgattacaccgttgtgttcgtaataattaaatctttataacaagatctcacatgattatattttgatgaaaaatcacaaattacttttatgatatgtctaaattacttttagatttcactaagttacttcttagacatataaaagtaaaatcagtaaagcctaaaagtaatttacatatattatagaagtaacttataaaaaaaagtaactttaattaatgccttttttcattgaacaaaatatcacacatatatatgtgtgtgtgagagagagagagttacttttagatttgattaaaatacttcctatacattcataatgctatgagatgattacttttatttttttagttaattccataatttgtgctgattaatttaatttctagatagagtcatgtttttatctctacaacggatttacttcaaataacatgctaaagttacattcgttttgttctaagtcacttctataatatatgtaaattacttttaagttttactgaatttacttttatatatataagaagtaacttagtgaaatctaaaagtaatttagacatatcataaaagtattttgtgatttttcatcaaaacataataatgtgagatcttgttgtaaagatttaattgttacgaacacaacagtgtaatcggatcgtagatcggatggatagtttaagagaaaattgtatttgaagtataggtggatgatgcctcttatagatagagtggtagctgatttagacaagccagctatcactagctgtgtagttacgccctttagcaaactgttttgtgtgtatgtgtgaattggtatggcagagttttagcatcaactatttgcactatcatgcagtatggcgatttttgaatgtcatttgcctcgatacaacatgctgagacacatagaagtataggtatagcattaatatttatccgtatctccatagtatactactatagtatcttctccatttaacaacggtgatctttttcagagagcacaacagaacacgcacatgttttttttagccctggacacgcacatgtagacatgtatttagacatgcagtaacagcatcatgtctcaaaatttcgtgctcgaggatctgccttctcacactcattttgtctgattaagcactcttaattaaaaaacggtctgcctaaaacaccagacggaaaaatgtaacaaaaattgcgggtaatagcaatataacagttgcaaatgtcaaaattcttttgttccactgaca

SEQ ID NO: 57179 - DNA, 1501 bp, Oryza sativa
taagtaacctactcaactactaatgtttattgtattaatgcaggacctcggtttggaacgtgtccagaagtttgttggtcttcaattatcagtagcaattattgttgctcttgctctgacaaattcctacagttcagctacaacacagttaaacgggtgaggctcttgaaaatttgtggtgccaaatgtatttgtttctctgaaattggttaggtcttaagcgtcaaataatgaaatgcctgactaagtatatggcatcctcatttattacatttcgactatgtgttttctgttaaacctttttattttttttcttttattatggcattttgtttcatatgttggataagtctttgtggtccttggtcgtgattcttctttttgcttttgggtagtttcacctttttcaggacagcatctaccctttagcatatttttcagttgctaggacagctgcggttagtaggacagcagcagttagcatttcctttatgcctcctttatgctttattcagtttggatgccctctaggacagcatcccattcaaatttcgaattttagactaggagggtgcagcaataggctagcagccagctatggctatatatatgtatccaacttccctcgggtaggcatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcagcgagggcggccagactggcggcagcggagttggcagcagccagggcggaggcggaggcggaggcggcggaagatgcggcacgtgcggcggaggtagaggttgagaccttgcgcaacagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccaacgggaacccagacgggcgcgggcgtgccggcggtagcccggagcccgcacgcggccctcgcaggcagcacggctctctctcccctgaccagcgccatggtcaccacggcgtccagacggtggtcagggactttggtcccggcggtgggtggcctaccctcaccaaaaccaactacatcgagtgggccgcggtgatgagggtgaggctccaggtgcggcacatgt

SEQ ID NO: 57180 - DNA, 1501 bp, Oryza sativa
ttttttgtccacacgcagcgtagcgcgtgtctattgctagtagtaattagacacagagtagatatgttccaaaggtggtgagaattaggccttgtttagttgaagaaaatttttaggcttggttgtcacatcggatatacggatacacatttaaagtattaagcgtagtctaataacaaaacaaattacagataccgccaggaaatgcgagatgaatttattaagcctaattaatctatcattagcaaatgttgactgtagcaccacattatcaaatcatggcgtaattaggcttaaaagattcgtctcgtaatttacacgcaatctatgtaattggttttttttctacatttaatactctatacatgtgtttaaacattcgatatgatttcataaaaaattttattttcggaagtaaacaggccttactaatgctagatcgatctgacagaggccgttgaccattgattcattgaattaatactcctatctccaggagtgtgaatacggtgtggtgtccagcctctggatctgtcggtaagacagtaattaggagtgcactagaagcgcactaggtcagtaatagcccaaacctaaacggctagaagtattgacgagttcgtcgcatctgcattgtctaattttttttttcgagacgacacgtgttcttacataaatatatatacgctcattactataaacacacatagtaccgtataagcatattaaaagatttattgaaaccgtattgttttgatatttttgaagttgtcatagacatctcatcaacaatagccaaatgcctcgaaaaaaaaagcgccaaatgcgagcacccgtaaatgcaatgcctagattttggtaagttaactaaggctgtattcgggaggtgagatggggaactcacctcctgtgcatgcaaaatagagcgacgcattttcttatgattaattaagtatttattttttaaaaattatattaatataatttttaaagcagcttttatatagaaaattttttaaaaaaacatatcatatttagccgtttgaaaagcgtgcatgtggaacacgaggggtgtgagttgggaaactcaccgaaaataatacaacctaattactccttgaaacagcgaaccatcattttcattcggtggcggagctagacccggctaccatgggcaatggctcgggctccgcctggcaaatgcagctatgcatccatagattaacacttaattagcttgctaattacattgcttagttcactactaggccgtatgaagcaacaccacatcgacagatgtgcttaacacaaacttataaagcaaatgctcatgttaaaatgatctatgtattatatagacttgtatattttttttttgtttgctaggtttgctcgagctcataaaatattttgaatccgccactgttttaattaaatagaggagtaaaactgtacaagtgtacaaagtgaaaaaggagataatgtaatgctcaggaccttc

SEQ ID NO: 57181 - DNA, 252 bp, Oryza sativa
acacattagcacgccaatgcattagcatgccccaaagtagtattttattgtctccaaacacatagattaatgcattaatccaatcctaatcatagacatcctcttatataccttcctacaagtttccctccatttctctattgcttcaaacaaggcaatgaaaacacaaaactagaaacagtgtgtgtgagagagagagagaggggccagaggagtgtagaggacaagggaggaacagaagaaccgagcatg

SEQ ID NO: 57182 - DNA, 924 bp, Oryza sativa
gaaaatgctcttggaattattgagagcttcgggagacatggcccatgtggttaagagaatgtgcgaaaaggggattgatcactcgtcattggagagagaattttgtcttgctggtttaaacaacgagaattgcaatcattgtaaacacagaacatggaagttttcattggagccgattccctattttcgttgtgtcaataacatggttgtttttgcagatataatacatagttctaaagtatgggcatgaaacggaattgctgttcaattgccgacggcctgaaaggagtacacattcattctagtatatttctactctaccgtgttccgtattggtacatactaattttcagtttgttctgatcaatgttcaagtatgacagcaagcagttttttccaccattttcatcttttagaacaaattaagctttaagaaattcagttaaactcaaccatcatatatgaaagaaagaagggataacacaagtggtggtcttaatagttcagtagtctgaacaaatggaattttactaagcggacacgcacggttaacgccaagattactttagttgaatactccctccgtccaaaaaaaggcaaaccatggattttcgtgttcaactttgactgtccgtcttatatgaaaattttttataattcgtattttcattgttgttagatgataaaacatgataaatattttatgcatgacttgtctttttaattttttttcataattttttcaaataaaacggacggtcaaatattgggcacggaaatcaggttttgtcttttttttttattttaggacgtagtgagtatgtgtaagtagattttagtgaaggcaggggtagagatgcaagcgtgtcctggtgttaaacaaatgattgaccaaaaattagtatgctattcttatcttgcagg

SEQ ID NO: 57183 - DNA, 1501 bp, Oryza sativa
ccccgccatagcgaaggacaagaggtgcacggatcgctccggataccgtggccgcagccgcgactcccccgccctcacgacggcgccttccgacataatcttgcgggggaggctaaggtgcctatccgtcgtaatgcgtgatgccgggagcactgtgtcgccagcatcttgagccatgatggccggcagagaagcggcggagggcttggcgcgcggaatagtgtgaagtggcgagaatgttagggcttaaggagcgagaagacgagtgggcggatggcgaaaggaaggaggcaaagtccctacctctgtatccttttatcttcgcctcacccgcgctcacctcctcgtttcacgcccccacgattgcccccacgattctcgcgcccgcggttgtctcttcgtttctcgcgtccactcatcacgtcgcccatggaatccgcgccctgcctttagtgcgcctatcagcggcacactcggagtagggcgcgcaacagtcatgggcacatcctgagcgaaccgtcaccactaccgccacaggagtagcaggcgagggaatcgatgcgtggtctgaccgaccccctaattttcgcgccttaagcatcctcatcattagcgcggtcagtggcggccaaaccgctgccgtggttggcacgccaacttggccactcggtaatatttccttggattccctgccgggcccacaactccagcttgagaagtcgtgaggcaccacgtcagaccgacctcaggaggccaatgtctgatatggtgctgggggctactgtcggagatatgggcccgggggtatgcgaagtgaggggaagttaccttcccatccagccgcgtggctctacagcctagccccactcccgcacctcgcgaagtcacggaagcggccgggggggggggggggactttcgagcgaacgggcacttgggtctcacaaccccaagcacttgtgttctacactcaatcaatcaagcacaggagtagggtattacgcttcttagcggcccgaacctgtataaaccccttttgtctcatcgtctttgggggattgaaccccctcaagatcacacagcttcgctcaccgaatcctcgaatctcacccgctgcccccggccgaactcacaaaggggggcctcacggttccctggtggaggagttcattccccgacaggcttattagacgataaaaattaatttataagtaaaacttttatagatttgttcgtaacgacttaaaagccaacattaaccaaaaaaattgcgttaaaagcatctcaaaatcaacttcaaaatcaagttcaaaaattcaaattttagcttattctttagctgtttaggccaaacgatggggcttgatgtcgtttaattttttttcttgcaatgtttgaccatttgttttatttaaaaaattagtgtaaatataaaaaagataaatcatgcttaaattttttataacaaaacaagtaacaaacaaaataaatgataattttat

SEQ ID NO: 57184 - DNA, 1501 bp, Oryza sativa
aacatcgtaatttttcagtagtgcgattgcgcacgaactcgaagatcatacggcgccactccctctagctattatactaatctttaattaattggatgccacaatcttatagtattaattaatttgtttgtttgtttgttcatggccgacttgaaacttttctgtgagtcacacaataagctgcccttttaattgtactagtagttttttaagtgatcaagaagcgattgatgcagaagagcgacaggagaggaccagaaactgaataaatccaacgctctacaacaagggaagctcaccggccaacaccagctagcaaagctaggcgacctactcgctcaatgttcatcagtaatactagtatttggtttttctttgcgtgggactcgacttttgtcttgagctgagattcgtgaaatgcatggtactaataattaaaatcctggggttctacacaaatagatctcgttcaacggaaacaggtgattctgaatgcgcacagatgcagagacaggaggggttaatccgttagtataaacgccccaggattagcaaagatcgattttcatatggcgtcacgtaaccgtcaatattaatttcacaagcacatgaaaaggacaaatagaatcgaaaatcatagcgattattaattattatttcctctccaatttgcaaccggctctgctagctgtgtcgtccacatccgtttccaggagtcgacgtccaaccgtactacgatgattctacgctcctaacggaaaacaatctaccgagctacgaaacgagtgcacaagaccacgcaaaatctactaacacgattacctcataacctcccgtgaattaatcgttttcagatggccgcgtatctcaaaccccagccgcgcccgtacgatttgacacgaaacttgggtacatttttcagcagcagcagcggggcgtggagccaaaatcttatgggtatctcccgtgcagcgtcgagagatcgaccgctcgatgccgcatcggcgcaagcggccaagcgggccacttcgcgcgcgtgccgcgctgtcgagtggagccggtggccggtcgtctcccgtcccgtgcgatcccctccttttcccttccattttgtcgggcgcggccaccgccttttacacacccgcctgtcacgacgtacacctcctcctccacacatacgcacgcagccgattcgcgcgggatccgtacttttttcttctatgtatatctctcgttgtgggattagttattggtttggttactaagtggcgcctaattacctacttacagttgcagatacggggttggctgtgtgcgcgcgcgcgcgggcgcgggcgcgggcgtgtgggggggggggggggggggtgtataaaaccagtcgtcacgcacacgaatccacctcggtctctctcttctccgaagcgacccacactccccgtgcccgagccagagagtatggccgtctctgtccgttgctgcttcggctcctcctccctttcgc

SEQ ID NO: 57185 - DNA, 1501 bp, Oryza sativa
ataagcccgggcatctgctcggggtggccggatggtaggattatcctacttcctcatataggagaatcatttacatctatggtagtattttctagtacatgtgagcaatttttacatgggatattttttatgttacatgtgatattttggtacataagagttactccatgtgctaatatagtaggagtatgtcggtcgtgaaaaaaaaaaggagttactccatctaagtagctaaaaaacggcattactgtttgcaagccacaggacgttggcactgacttttcaattttcactctccattcagttcaaaaaaattttcactctccataatgtactaccctgctgcacaagcaaaggaaatgaggccacagcaaatggttcgttaaacgagaaaatttaccctagaaagaaacaaataaacttattgaagtggcccagaacagtagtacgaaaaacaggcacagtacactatcttgtcctaactggccagattaccagaagaatcctgtagtccgctgctctccctagcttgttgaacacggtggttataccccttcaggacggacttcagaaccttgtatcgtaagctgatgctgcccaaagctcatggggggagtgaaaaatccaactcctactcgcgccactccgccactggcgcctggctagctgccgaacacagtatacaagaccacaccccctcccacccgtgcgggctctaccaatccacaccacaccaccctataaaaacgcccgcgatccacttgccacaccacggccaccaccaccaactcgatcgcacagcaaaaagcccatactgccaccgcgagcgccgggaagaacacaacagcttctcgagcaagccggaggtgcacgacgcagcaaatggcagcgggattccgccgacggctcaccgcgctcaccatccccaaggcatcgtcctacctccgccggacgaggcacaagaagttatcgtactcccgcgcccgctccgctagcctccccggccgcttccacccggtcgtcaccggcctgcacgagtcggcgagtgctctcctcgggtggactgatgaggcgccggcgcaggctggcacgcagtggatcggcgaaggggtcggccacctggcgcggctcttggcgggcttgacggagctgctccaccacccgcaggcgcaggacccgctccggccgccgcgcaaggcggcgccgtggacggagcggctgctcgacgacctcctcctcctcgccgacgcgcacgggtgcttccgcgaggcgctcctggcgctcaagcagctcctcgccgaggcccacgccgcgctccgccgccgcgacgcgacccgcctcgccgccgcgctgcgcgcgcgccgccgctcggaccgcgacctctcccgcctcgcctccacattgcgtgacctctcctaccgctcctcttccgccgcagcgacgtccgactccggcgaggccgcgctagccgaggccgtcggggccgccacgtgcgcggcgg

SEQ ID NO: 57186 - DNA, 1501 bp, Oryza sativa
cttcaataatttatgctcggttatacaaacttttgtaaccccagatcgaatacaggagaggcgacctcaaatccttttttttacttaaaaaggtagaaaggctttaccttataaccattttactaatggtgaatcaaagattaaaaaagggtgaatagctaatttagtccctcaagtttcagcgaaggctcaatttggtccttcacgtttcattttatccacatagatccttcaaatatttgttttgtcttgaaatcatccttgggtccacttaatatgccatatggctatttctagtcaatatttctattagaaaatgtcatttttgcccttaatttgtatacatctatatactagaaaagagaaagccaacataaataaacaacattacagatctacttcccattatttcgacatgtgcacatgaaacttaagcaattgctatcgtatacacttgctagtacataattttttttcgttttacataatatactatgtattatctataaaaaattcaagcatgcaatttctctcttatatatgtgaatgatgaggggtataagtgtcatttatgaagagagttgttggttcaaggataagtttgaactaaaatgaaaacttgaaggattaatatggatagattgaaacatcaaggactaaactgagtctcagatgaaacttggaggaccactttagctattcacccattaaaaaaacaaaagtaggagaacacagggagaacagtagaggggtaaaaaattaagggcagagaaacaaacagagcaacagaaggaaaaggtagaaagatagaaaagaagaaaaaaaaagacaaaggggctgggaaacagccctaaaattaactcagcttgttcatccattgatggataagatcgcgactgttgtttgcgacacggtgcttccaaagactgaggtcttctttgatgtggtgtataagctgtgaaagccgtataaactttcattccggaatgttagttgcacgattccgagccttccaaagggtgtgcacgcacgcggcaaagcaaattggccagccaggttgcagctggttcggggctgtatcgtcatgacagtctcgacgacctcaagtcttcagtcttctcactgctttggtcttcggcattggcagtgtcccggtctagttcctgaaaaaagttataagttaggggaaagttgtaagttcagaaaaaaaaagttaaaagtttatatgtgtaggaaagtttttgatgtgatatgatataatggaaagttaaaaatttagggtagttaagggttaactaaacacggcccaagctgccgcgtgcatacgccatgctatgctccaaatgctcgcggtcgctgttgcactgaatgtgccgtccttgacgggctcatctagctcgtacggttgcatgtacatcgtttgagttcaatcggacggagtgatcgagccgaccatctcgcgcgatactgtcgtatataaagccgtgccgtgcgctctgca

SEQ ID NO: 57187 - DNA, 1501 bp, Oryza sativa
gatcacttaatttcttctgtttttatttgcaaattaaacggattactccatacaaaaggtggatgggcaactgctcctgatggaccctttgcttggggatactgccgggtgaacgagatcacgccgtcggacccgccctactacggccgaggacccatacagcttactcagtacgttcataaaaaaaaaccgcacacaaacagttctaagttattgcaacacatatcgtctcatgcaatgaaatctattactactaatctacaaataatcaatggatccaccaaaataaatctgatatgatgcatgctctcgtatgtattatgcagtaagtacaactaccagctagccggggacgcgttgggtctggacctggtgaacaaccccgacctggtgtcaagcgaccccgtggtggcgttcaggacggccatctggttctggatgacggcgcagtcacccaagccgtcgtgccacgacgtaatcaccaaccagtggacgccgtccggcgatgaccgtagctccgggaggctccccggctacggcatggccaccaacatcatcaacggcggtgaagagtgcggcaagggctactccaccgacaacgccaaggaccgggtcggctactacaagaggtactgcgacatgttccgcgtaggatacggagataacatagcctgcagggaccagaagccctacggaggaggttaagcactggagacgatcgactgggagtacgtcgtcataagcggattctcctagtgctagtacagctgctggttgcttgctaatggctagcttagccttcgcgtacatacgtatatgtacgtgatactagtacgaataaagctagcagagagcgttcgcggatatcatgtaacagatatgagtatatgacacatggtcgcttatctcacatgttattgtgaaataatattattactggtggaacgatgcccctagttaaactgatcgtgtgaccggtatctgtgttaattttcttcaattgctttcgcatctcagctcccacggcgataagcgatcatgagctagcgctgtctctgccgcgcgctgcactcgccgtacgtacaagcccaacgccaaagttgccgcttggcgccgcgcacctaactggatctatctcccccaaccaccgaaacaggaggcgagagtcgcgaagactggatcgggggagcatatcgatcagtcttctgctagtgctacatcaaacatattttacttgcaagtgtctttgacaaactcaaactcgtacagcgctccgaaggttgtcaaaagcgaatattgtttgcgcagaaattttggcccattgggtgagtagtgtcccctgcgggctgtggtccgaatcagccaccagtttgtttagcgggcttctccgcgcacaaaatttggcccatacatctttcttgtattgctgggttcctaggatctgttgtttcgatctgttataatcggtgcacaaaaaattggcggcgcaaacatgaatata

SEQ ID NO: 57188 - DNA, 1501 bp, Oryza sativa
tatatgtatgttagcgtcttcagagttaatgctgaaaaagaaactacgttgaaaatgtcttaacatcaactttaaaattaagtttgaaaattaaaagtttggctttggctatgacttattagggcaccaatggggctcttagccggtgattaggggcctgtttagtttccaaacaaaatttttcatgctgtcacgtcgaatgtttggacacatgcatagagtattaaacgtagacgaaaaaaaaccaattacacagttcgccaggaaattgcgaaacgaatcttttaagccttattgtgccatgatttgacaatgtggtgctatagtaaacatttgctaatgacggattaattaggcttaataaatttgtcccgcaattttctggcggaatctataatttattttgttattagactatgtttaatacttcaaatgtgtgtctgtatatccgatgtgacaggtaagggcaaaaatttttttccaactaacgccgcgtttagttctgaagtttttcttcaaacttccaactttttcatcacatcaaaacttccgtcttttacgtcacatcgtttcaatttaaaccaaacttttaattttgatatgaactaaacaaaggctaaacaagccctaggttttggaggtcagccatcaagctcgtttgagaactccagtgaggcagcgactagtagacatgaaatttttcagccttttcgaccttagctagctaactataggtgtgtggctgcctgtcgcgttttggtcatcttgaccgactttgaacaaagactgcatgcatattcatcatgaaaaggactagtgtgacgaacctaacgaattcctagtggaccaaccaaaggccccatcgtttgtcttttttcttgacaagccaaaacagcttattagagaataaaaataaatttataggtaaaaattttatatatgtgttcttggtgacttaaaagccaatgctgtaaaagaaactacgttgaaaatatctcaaaattaatctcaaaattaagtttgaaaatttaaattttgacttttttttagctgtttaggtcatccgtgggagcaaaagagcttatatagtttctcactgtttgacagcgacattacacgcattgggtgggtcgtgacaaaaatatttgaacaaaactcggttcctactagttatgtgtacaaacaccgatcacaactgacaggacagaaaggatgaaataatttcctcatgaaacggtcagagttcctgaatttcagcaagaattcagacgggataaggcgatcggagttttcctagctacttcctaaagttataacaggcaaagcgcatgaaggtttatggtgtataaacaacatgtaagttaggcaaatgcctgggaagtcatgcatatgagaatatgattctagtagctcttgtgcttaacttggtaaggaaaaatgtgtctaatgcatgcctgtgtgaatgtcctgaacagatataaacagaagactgcatgctgat

SEQ ID NO: 57189 - DNA, 1501 bp, Oryza sativa
cttgatggattgggtagtggccgaggccgatggctctccggcaatttgttcggcccagccgcgcgtggcgagaccgtgggcgtgggagttcacgcacgcagggagcgggtgtgggttgccgggctaaaaagccgccggcaacagccacgtcccgccgcgcgtcgcacgtccgcgccacgaggcaccgacctatccccgcctcgcgcgccaagcgctccacgcgccgcccagcgccgcaaggcccgcaaatacgtggatcccccacggcgcaacgccgcaaataatttacccgcacgcaagcctgcacgcgaacgttcgcgacacttcgtaccaatccattgtccgtcgaacgccagaactatttaaccaagaccaggcgcgcgaagagcgaacgacgctatagcttcagctacgtagccgttgttcatcactcactcaactcagctcagtagtcagtgcgtactagggaccgatcgatggagaagctggtgccgaacacgaagaaggcaatggaggacaaggaggagaagcccaaggtgccttcgagcgacccggacctcgtcgacctcgtcgccggcgagcagccgcagctgcagcgggagcaccagccgcccaacatctccgagatgaagccgctgacgcgggaggcgtacggcggcgggatgtacgccaacgaggggcggagggacccgacgcggccgcgcgccagcgccacgcagagcgccgacggcccggaggaggccgccgtcaggcccaagcacgcgccgccgccgtccaccggcgaccgcgacctcgacatcaccggccagtcctacatccagtagtttgttgtgtgtgtccgtgccgtgacggtgtatgcgtgtagtcaggcagtttggtccggaacaaagatgtgcataggtcgttccacgctgtaacgaataaatgtaagtttacttgctgtaatttggcccaataaggctaccggcctaccaaccggagatcgttagtcttggcctactaactcttatggaccttgccaatgggctaatctgaccaagtgcccatggatcataataaagtcacgaggaacctctcttatcagcccgcaaaattttaccgttttcatcccttaatatcctttaatataattaatatcccttaatataaaggattttgatattttgcttgcactatttaaccattcattgtattttaaaaaattatataaatatataaaaaaaagttgtgcttaaaagtactttgataataaaaagtactttgataataaagtaagtcacaaataaaataataataattttaaattttttaataagataaatggttaaacaatataaataaaatatcaaaatctcttatattaagatacagatatggtaatttttaaatgattttgaagttttgttttcattatgctttatattttcaccactacctagctaaaataaatcttactaaaataaacgtttggatgacacaaaacattttaactggatagatg

SEQ ID NO: 57190 - DNA, 1501 bp, Oryza sativa
cgtagtgtgacttatgacttatctgatttccaattgccatccacttatctgatttgatactttcaggatggtcaagaacttggggagaagagcattttggtaatgggtatgttccatcatgacgctggtctcgcatttggtttgactgacacttgacattaataaatgaattgaaaccacatgggcttgtccttttctaatacactatatgtcattctgcaatggttcttcttgcaacgatactacctggcattacagtagtagctttcttagatactgttgttctcttgtatttcagaaaagttcataaatacggcaagagcacaactggcgagagctgggatttggtagttgatgaggagacgtactacgagtaagattatgtcttgtttggttcttccagacatcttcggagtattttcagatttacaatttggcgttgatctgtgcattgtcaattagggcggagcctcattacggatgggctgatgtcgttggagactcaacacaacttctgtcgatacaacctgtcgaaaggccaccaggagtgtacccaactattgacttcagcgcttcatctccagctccaccttcggatgatccaccaggcatgcctccttcgcctctggaatgagtcatacctgtgccagtacaaaagagaagcttttctgcataggtttccaattttgcctgtaaggggaacattctttgtagaaaggggatcaaccgcagtattgcgttcattggttcattcattctttcgtagcatgttttccttccgcggcttagcgttttatcgttccggactgctgtttgatcaattaggcgaaataatcagtggctcgcgatcatattgtctctatgcttatccatgtgcatttttgcataaaagctccgtataaataacggaggagaaagctctcaatgatatccacgcgttttttagcattgccttgcgatgtggacacctctgtttggctgttggtttgtgtggcgaagagacgtcaacttcgccctgctgtttccattttcctcgcatccagctccggcctgtctgtcctgcttgtatccaagtgtgctgccgtggacgaggctactcgttcacatttgtgactttgaagtccagattggcctcttgtgcaatttaattagcctgacttgggttgccaaagtcttagcgtagtcaagctccccttgaagacgctaagctgcatgcatggctaacgtttgtagtcaaatttccatcggtaattttgaaatttcagtgattttttgttctccaagtctgactcaaaccaatcaattccacacaagttcaccattttctactttgatgcaatcgaaccaaaggatagggaaaggcccacgctgcaaccatttaagtcgccacaagcactagcatcgaggcatactcctcctgctccagtgtcaacacgacagtcaaacaaacaccaagcctctcattcccacctctcgaggagagctttccccaccatggcgt

SEQ ID NO: 57191 - DNA, 1501 bp, Oryza sativa
ttggacttgtataattagttagccgttgctatcaccggacaaactatctgactttgtggtttaaaattacggaataaactaccaataccaatccacaaagttgaccctcgctactcacaaggtttcaaaatatactattatagtactatcttagatggatcttgatgtttactactattcactttcttcggtaagaatgtcatatgaaacgagttcctagacctagtactaacttctggaaaactggtgtcctcagtgtgccgttcatcaatcagcgatacctcagctgatcacaatctgatgctcctcccggatggcacctatggattcaccgcaggaaactgcatccgctgcagctgcagttcaactacctaccagtatgctcccctattatttccatctccttctaagttgtttctgatcaagcagtaaccaaagaatttacatttcttttcactgtgtcaaccaggctaaactgcactgcagtacagaacaagggatgcccgtcagtgccactgtgcaatggaacgctgaagcttggtgagacgaacggcaccggttgcggatcaacaacgtgcgcctacagtggttactccaacagttcatcgctcatcatacaaaccagccttgcaactaatcagacaacagcctgccagagtaagttgagcccgcaaacctgtacaaactcagagtctctgagtttgtttgagttaaagaaacggcaggtttctaatagttgattttgcaggaggaggatctgggaggtcgcagttcgctaggtccatgtggagcatgtctgttatctccttccacatggtgttgatcattatctgtttcctttgatgttggagactactgcaactctagatggtacatttcaaagagttctctacgatctatgattgttgtatacgatatatgattgttgtcgtaacttagattttgatgactggtttatccagctttgaaatttgagttttgactctgttctttagaggatgagtggcacttgtacggctgcttgaataaaacgtcgatgtattgtattcgatctgcatctgaaaaggaatattcattagataggattattcgaaataaaaagatcccacatgtttttgttataggcgttacatgttctggatggatatataatgtaccatgcggaagtatgaatggacttcccaccttccaatcttccatctacacttcaagccttgcataaagcaaaattgatcttagcaagtctcaggcaaatgctcgaaactagtactagtttctttctgatatcattatttttgttgcgacttgtttttagtattgaagatactttaagcatgacatattttacatatttgcattaagtttctaaataagttgaatggttcaatatcattttcaaaagtccatgtcatgcattcactcctttcatttatatatgacgttggatagttcactaaaatgaattaaccaactcatatataagtggaggagggtgtgttta

SEQ ID NO: 57192 - DNA, 513 bp, Oryza sativa
cagatcattactacaggtaatatagctcctatcagaaagatcaatactattttcctttagttaatgttcaatggtttgccctgttatagatttcattccactttattttctagtcaaaataatcagacagtatgcacacactgcagagaatggagaaaaggtcaacaattttccattattaaaaattgagaatcatggtttttgttctcctcgcgataatacgaaactaaattgtgtttcatggatggaagacaaacatttcgtggagttcaccaagcagtttcacagcaagactggaccctagctctcccagacagagtattcctcctgttggtgttgcaagctcgatcaatcttcaaattgtttattaaacgaagtctcttatttcctagttgtaaatgaagtgctgcacttagaactgttctaccacaactccaggtaatcaacttgtgaacagaaggaaacttggcatatggcagagtcagcctcgatttgttgttttgaatctccagg

SEQ ID NO: 57193 - DNA, 1501 bp, Oryza sativa
cgaaggcgctgacgaaggagtggcggccgaatggcgagcaacagccgccgctcgccgcgccctccgccttgacgacacggagccggtggtagcagcgcgagaggtcttggtggcggaggaccgcccaccagcacctaggcgctgccgtgccgtcatgaccaagttggccacgtcgtccagccaacgttgggctggagactccgggtcagggacaacgggcgggtgacgtaggagcacgcccgcagcttggagcgcgccctggggcgtgctgccgtcgccgtagacgaggaggcgacgctccccatctggccgcccttccccatcacccgtggacgtcgaagtcgcggatccttggaccctctcgagcgcctcctcccgcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcacacacgaaagagtgcgagagctcagaagatcactcgcagagccccctacctggcgcgccagatgacggagcttggggctcctcaccgggagaccgcgcaggcccccctttgccggttcggccgggggccctgggtgagattctaagctcctggtctgtggaaagttcgcgagagtggaaacacacaagacacgggcgatgtatacaggttcgggccgctgagaagcgtaataccctactcctgtgttttggtggatctgtgtatgaagaagctacaaagtgtgagccagcccccgattgttctgggatcctttttcctcccccctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtctcaaatcggtcattcttgtccaccacgtgtcagtttaacaatctgcatgctcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 57194 - DNA, 1501 bp, Oryza sativa
atataaccaaaaataaaaaaaatccaaatttatcatcacataaccattgtcccttagtttggcgtgtaccattattgcatctatacatgagaattaagtatgcatgtatgcatgcagacatttagggatacttaggctattcctaacccaataattaggatgatgtccatagcattaaataagctgccacctagaatgaaaaaggatgtggcaagtgaataaatgaggaaagagaagaaaaccatgtcttgcctaacagatggtttctacacaacatccaagacatcatgtgagataagtagcattaaatttatgtcggtgacatgggaccgggagtatcatgactagaggcttgaggcagacacaatcgcctacgtggcctggcaccctcggggggcgtcgggcccgagggtgatgtgttcgccctcctctttatctccccgagggggtcggaccgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtctatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgagcatgcagattgttaaactgacacgtggtggacaagaatgaccgatttgagaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggggggaggaaaaaggatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccggcaaaggggggcctgcgcggtctcccggtgaggagccccaagctccgtcatctggcgcgccaggtagggggctctgcgagtgatcttctgagctctcgcactctttcgtgtgtgccaagcttttcctgttcagcccaa

SEQ ID NO: 57195 - DNA, 1501 bp, Oryza sativa
atctgcgcaggttttctttctagttgaagaaacaatataattacttttgtattattttttggacgatggacgttcatgcacagttgcacatccattctacctgataattcatttcatatagtctggacgaataaaatctcactattatgtgcaaaaggatgacaagatttctctaagataggaaacaccactgtcgagatggctataagttagaacttagggagcgttcggcacgaggagtttgtgagttagtttgtttcatttttcgcgtgcacgcttcccgaactattaaacggtgtgttttttgtaaaaattttctatatgaaagttgctttaaaaaattatattaatccatttttgaagtttaaaatagtttatactcaattaatcatatactaatgactcacctcgttttgcgtatcttcccaatcttgtcttttcccctcctctcaaactcacccttagatgcactgatttcgaatttacagtttcaagccattgattgatttaatcaatcagtaggctttttagtgaactatacaagcagttctaccctcttgttgttcgaacatatcaatatgattcctaagaagcaactgtaacaattggcaagggacgaaatttccccccaacaattattcatgaaagcaacaccccgcagcaattatgtagcttggagttttaggttttgcaacgaaaattctctccagtttattttttttaaaaaaaaatttgtcacccaaaatcacctccagagtgcccccacattttctttctcacttgttgcgaaatctcaataaaaacttcgatttgaagaaacccttagtgacaaagtattcactgaaagcaccggatcagttggactttggcggctgacacggatatattggttgctggacttaaggaacaacgcctccttcatcaagtcttgggtactaaagacttctaaattgtcttatttaacccttaatccagttaagtggtttcctgttgcatcgcattcctgctgtatatattgtccataactagaattgaaattcccaaacatttcgcgaatgctagacactggggtcgtgaagggagaaacctgtctcaagcattgtttatatatatggaacccgtagatgatcaggcgagatagaatcagttggacttaattaaggatctcatctccaaataacgggtacactactacacaaaagacatttacaagggtctctgatttacttcccattccgagagagctaaagtatcgcgaccgagagagctaaagtagcagctgtaatttcggtgatgcatggtcagttattgatataaccatcaagtatatacatacaaccaagtatgagaaataaaaaccattgtcaaataatacatccgatgaatggaagatctacaagatattaaagtccaatgagttttagaatccagttcggcctccggagacagcattgacttcaaacggacctagcgccttcatgtcaactctgattttggtaat

SEQ ID NO: 57196 - DNA, 1501 bp, Oryza sativa; identical to SEQ ID NO: 39487

SEQ ID NO: 57197 - DNA, 1501 bp, Oryza sativa
ctaatttacgtgatatttttttaagcctaattaatctataattagcacatgtttactgtagcattacataggataatcatagattaattaggctcagtagattcgtctcacgaattagtccagagttatagaatatgttttgtcaatagtctacatttaatatttttaatctgtgtcaaacatccgatgtgactgggacatcccatccaaataaggtctaatagagagagtaaaagtatatacagaattatgtacaggtctgaaaaaaagccaaaagaccccggaaaagggcttttcttcgaattggactattctgcatcagcctctcatctagacctttcttctaatggaatgaatgatagagctttttctgccgatgagctgcggcttaccatttgcaagcgaatacgacatccgttctatttttaagtgtaactatgagttttatctgttctatttttaagtgtaactatgagttttattttccaactttgatcgttcatctaatattaaattattttataattaataaaaattacattttaagtgtaactattagttttcgtgtctaacttttatcgtccatctaatataaaattattttataataattaactttttattgttataagatgataaaacatgaataatactctattattttataataattaactttttattgttataagatgataaaacatgaataatactctatacgtgatttatatttttatttttttaaaaaaaataaaataagacagatttaaaattgaacaaaatattgtttttattttttttcaaaatttttttaaatacgaaactccgtagtaggcaagtgaccacctcgatgggaatattttagcttaatctctcgcttatccgcttagcttcacctcatggtagtagcacatagcacccgtcaacttacttatcaaagggcctgtaagtaaacaagagggaccaaattttaaatttaggtaattggcaggggccgcgcgaacgcgtaccccctctaccacaaattatgacgtccactctcccactcggggagatggtaaaccaacgcgctcaccaagtgcaatgtgagccattgatctaggccacggcccttcttgatcggccgtcgaccccgtccaggtaagtatgttgcaacgacgcaccactagcctcttatatagcaggcgctcccatccccatcgcctcgagttgtcgaggtggtactaaacgagacctggtcgtgcagcattgcagctgcctggttgggtctgcattgtattgggcctaattgctgtggtgggctttgagcctttcattggcgcggcctacttggcaagccggagtgtgtacaacggcgacttgttgctttctggtcacgagcacttcagcatcagatggattcggtgtcccgagtggaattgtcaaatcgatgattttagattcctcctttgctacatacggcgttagaacgccagtcatcacacaaaaccagttgaattta

SEQ ID NO: 57198 - DNA, 1501 bp, Oryza sativa
acattttttttctgatgggttagtacatcaaaagaaaaacatctttacctaataggctagtactgtagaatatacttcacgctactgattcagaaaagaaagcttgcactaagtcttaagcactacgctgatgctactgggattcaaaaaagaaagcttgtattctgaagtacatagttgctgctggtctctactaccagtagcaactatgtactggtctccactaccagtacatagtccttacaaagtaaccagaaaaataaacatcacattattacagcggtccaaaggccacgagaaaatataactggggagcttcaggaccatgggtacctgggcaaaaaagagaagcacccttgcataatcagatacccagtgctgtcctctgggaagaaatgtcgaaacatatgctattcctttgaactgccagccaaacatcatcgaacctttttttacttcacaacacttcctggaaagagaacatggattcagacagggtcctagaattactgtgcatcaaacacaaccacatttcttttcacaggaaggtgtagatactaataagggtgtcaacgactaatccgcaaaacccacttttaggccaaaataagccacttacccgcttagtttgacctataagtgggttcacgggttagccacttacacccttaggtatatgattgatgggttcaaaattgcttatttatgtacgggtgagttgttctagaaatgcaggaagtctttgtaaaatcacatgttataaaatggacaaaaggcaatgtgtattactgacaatagaaaactaaccattagctttgtcatctgaaaaactaacggcaacatgctcaaaataatctcttctggcatctggcgtttaatcagaaaaaaatgttagcatatggttaacatgtagctaaaagttaacttgaaaacattggatcacaaaaatttcacccacatacttaccatgtttcatagttaaagaagggtcttccttatctttatacccaactacctttgcagggtttcctactgccatactttaaacattatatataaaaaaaaaggtcagatcaatttgactgaaatactattgtactcatcaaaataaaaatgatgtaaaaacatgcagcaaaaaaaaggcacacgtgtaaaataaataagcatttcattacaaaatacatattacagcgatcacttggggatttgactatgtaaaggcctgctggcataatttgcattatttttcagtgcaagacaataagacacaactgaaggactccttaacccaggaaatatcgaagagcctttcctagggggtatgccaaaagtgaaagggaatatataatctgctgagcacaagagaaagattcttcaccaggcactggtattttggttgatatattcttagattagtctgggatgaacataaccaggtgtcactaaatcaagcaccttaatgggaaacatgatgccatgagcccatgagaaaaaaaataat

SEQ ID NO: 57199 - DNA, 1501 bp, Oryza sativa
gattcttttgggggagacctcaccagattcagacgaagaactttgggccgagagcgcttcatagcaacaatgttgcattgaagttcttccatgcaacgtttctcttcatgtttcaactccctgagtaacaagaccattgctcaatgatgcagatacggaagaggggttaaaagtaacagtgcactgtaaaaactgtgaaatgtagtacaggataacattacttgtctagcacaacccagcttgcttgggcacgctttgattcagtagccacaccaccaggagatgcagggataaccttaagttttgtaattatctacacaaaaatgtaaccagatttttttagcaaaaaaaaaaagagaaagagaaaaaggtgcttgtgctgaaagattgaagtaaaaacacacagcagctagtgttagctcccttttgataccttgttcggatcataaaaatcacgaagtttcagcatcatttgattacacaaatcagcgacatccgaattctgagtcaacacgctcctgtgggcgctcgcacaaccccctgcaaagagcgggaagccccagaacttcttgcctgaaattaaaacgagaggaaataattgaactagtgaaagttgatccatgaagaccaaatccaaagagctccatgatacagtataaaaatgcatggcatcgtaaattggcaaagctgttgaagaggaagggcatgtataccagagttgtgcggcggcggcatgacggcgaggagcaggatggtgtcgccgtgctggacgacgtgcgtgagagcccagacgagggcggccttggagatgtccctggcggcggcccgcacggccaccacaaccaccgcctccgctccccggcccttgtccggaccggagaccaccgccatgtccgagagctcgagcagcctcctagtgcttcaaaagcatttcggtttcagcaagaaatgaagtgaacaccagcagaaccaacaggtgatgaaaaattgaattcaaagacaccaaaatgagagagagagagacaagcaccgctaggctagctccggggactttaatgcccggagacgaagcaggcaaacagtaaacactagtactccactgttgtggtgactgtggagtagagaaaccacaggacaaaaaagaaagaaaaggccgtctttttttttttttgcagggctagttgaatggggtcagggagggggtccgagcgagtcgctgcggctgcggattgagagaaagattgcaacttttatatgggtgctgcgggcttggcggatagatgcatggcgacgcggggaagaagggcaaaatggtgggcggccacccactgtgtctgctactgccatcgtctctgtccggatttcgggggattccttccatctccatccatggcgattaagcttccttccaatccaaattggcgccgcattccgtcgggaaacacgggaagcttcccctcccctgtttattagtagctgagtggaaacatgcaaaactgag

SEQ ID NO: 57200 - DNA, 1501 bp, Oryza sativa
tgtcaaaaaggctaatgaggaagtgtttatcaagctggtaagttgtatgcttggtgttatgtcctctgaacatgtttcagtacatgtctatttccgctcaacttttattattatcagggctctgacaaggacttgaaaaagaaagaaaaggatgaaaaggatgaacgtaccaagaaggtatttcatttttttggctcattaatcataagcctacactggctgttctggctcacaatattgacttgtctttgtccttctcctgtttggtccattcttggtgaagtccctgagcatcaatgaattcttgaagccggctgaaggagagaggtactacaaccctggccgtggtcgtggccgtggcaggggtcgtggtgatcgtgggggtttctatggtggttacaatggcaacggtggtcgcagacaggctgccgctccggtgatcgaagatcaggcccagttcccctcgctaggtgggaaatgaaacgaacgctcggatctagcggctcggttgtcttgttggttcacctgaaaactgtgtcgtcgtcgagttgagtactgtgttgttatgtcgcccctcccagataggagtgttgtgtttatcgcctgtctgtatccccgtgcatatccgaggtgcacccatccatcaccattgctgtgtttgtcagacatagtagctcatgtgctgcttctattttccgacaggagtggacagtgtatgccatgtttctgatgagtagtcgtgtgtgcgttggttcagagattttgctcagctgagaatggatcccatggtttattaaagaggctaatctgaaacctgtcacctgtggtgctgtaaggttgattttgtcagatgtggttgtagaggaacagtttatccatgtgtgaattgaatgcacatccagcccactactggttgtacttctcttgtccggtccagcccagaagctcattgtgggccgaaatgaggacgagctcatcgaagtatgaatctccaagctaatcatcaaatggactcgaagggaatttgatttattctgaaagaaaatttacacctggtgaaaaaagttgagcagaaaatcgaagggaaagaaaaggacacggtgtgagttactgtgcagatccaaggaatggtcaaaagcaaaggaatcatcttttgtgtgtgtgtgcaggcatgattgattggcagaatggcagctagtggcagcgtctcgttccgaccgaggccaccacaccactgtcactgcacgcaattacttgcgccacagcttcttcatcttgcagttgctgtactgtaaaaaccaacagtatcccacagtccctgccggattatcgctgtggccaccactgcttcagtttcgcatcggccgacgtgacgtgatggctcgttgctgaatgaacggatggatgattgctcgcaacggagtctgaaaagaagcatccgggagctgttcttgctgggcctcatcagtcatcagatatgctctctactggatacatggtg

SEQ ID NO: 57201 - DNA, 436 bp, Oryza sativa
actgcttagtttacatgtgtagatctaatgatgcgttaatgctagtatacatctgtaatgtcatgatttatttataaaatatattaaatcattatatgcctatattctcaacaacatgttcctctcctcccaccccagcgttgtcaactcgattgaatggatccatagcttcagaatctcttcaaattaagttgaaaattgacggctgcgcgcttttgcgcggtggagtgaatttcagttcaaacatgcatgggatggaagtcgctcattgaagaaaggttggaggcgcaactgccgaggcaacaataaagcacatgcaacggagttgtaataattcatcagcggaaaagctagcggcctctctcctcttcctgcaaatgaaaactaaaaaagcagccttaacgttcgtgccacaaaaggagaagagaaaaaaaaa

SEQ ID NO: 57202 - DNA, 1501 bp, Oryza sativa
ttgttagaatgtctttgctgaaatatattaaacccaattaagctgatgaaggtacgtaggatcagtttgatgcaatggtgattaaaagagccaaaataaataaagaaatttatgggccattgccgcaacaagacaacagtgcaacttttcaactagcatccatcggtcgatcgatctcattgggaaaatatgggcaaacatacatgaaccccaaccactaaaattgaaggcttgctcatggcaactactctcctccattggactgatctatctatctctctttgacatgtgcattgtaaagtgattcctatcgaaagctggaagcttgcctgaacgacttttcctagatctaagaatgatcactactcacaaaggaataggggacatgacatgttcctttttaactgaaatgcttttctttctttcatttcatctctcttttcctttcagatttccatccaaatgtgtacaggaggaacaagacaatgcagggtagcctggtgccatatattggcaattaacacatcatcaatcagcattaataattcagaaaccaacagcgacggcagagaagaactgaaccagattttactgctgtggtgtatccgtaactgaagaattgaaggcgccgcgttttgatgcatggccaggtgtggtgagagcatcatcgtgagtcttggagagaggtagcattagcaatggccgctgtgcactcctcagccacgtgaggtggggctccatcgcacgtgctccacgcatatgtatcgatcgatcgatgaatcatggctactgcttggtattgaagtctgatcgatcaactgcatatgctgcagagctagctagacgaatagacgatcaggaggaggatagggttagagagaagcagacgaacaattttcccttttcatgggatcccctgcctgccttatctgaatttctctgaattccttggctctcctgtcctgcatctatctgcaacaaggactccatagatctctcgtgctacagcactagagcaggcaggcaggagttgtgctgaaattgatgcaggtcaggtcgtcgtaagactgcatgcatgcatgcattgacgcgcgtcgctccaagctgcagtgacagtgagccagaagcgctggtagaaagataataaggcctcctaaacaaaaaacatttcagcctgtcacactttgaaccgtttggacacatttatagaatattgaatatagataaaaaaaactaatcatacggattacgtgtgaattgtgagaagaattttttaaatctaattgcaccatgatttgataatgttgtgctaaagtaaatatttgttaataacggattaattatgcttcataaatttgtctcgcggttatgcttcataaatttgtctcgcggttttattattagactatgttttatactttaaatgggtgtccatatatctaatgtgacacacaaaaacttttcgcccctaaactaaatagggcctaaggcaatacatagg

SEQ ID NO: 57203 - DNA, 1501 bp, Oryza sativa
tatgaaaacattatttgtgtctgtcgaaacaagatttcggcaatactaaaagggggtggctattaagctaaaaaagtggatgtgtttgaagacaagaaattttatataggttcaggccttcttagttaagaagtaataccctactcctgtccggggatgattccgccgagtgtattattgatcgtatgatctaggagaaagtcgtgtccatagagggacccggacccctccttatataggggaaggagtccgtattacaaaatactgtttatatccctaacggaatatgtgattatagataaattacaatcgtaaccgactagaatctcgggtatctccttgacatacaagtttagaaactaacccgagtcctcataaagatattctatctatatctagtaccccgtacctaaccagactatacatgccgtgtagatatgggggtatccataatctccacagtagcccccgagacctttacagtcgacgaaatggccttctctcagaacataaagcaatgatccgagtgcttcaattccttctgctctggtatgccgagtactaaaatcaaaaactgtgaagggcgaaaaaagaaataaaactgggtgcatcgagtagatgcacctaattaggtgtagcccccgactatgtggttagttaaaaaactaaacatgtagtcaagaaccgagtggttttacaaccaaacatcatataacaaagcatacgtggtattcaaaaaaacacctagtcgactgctttttagctttaatgtatcgagaatgaaaatatgaaaggctgagtgataaacactcaaaaaagtccacaaataggcatatttgacaagaattcgagtaagaaactcttaagatgatccgccaaatatgataaaaatcatggtaattaacgagtctaatagtctaggctatgaccctcaccacaaccaaaataagcatataacatgccaagagaatgactcttaataaactagtcatctcgaatcaacccaaacagattttgcagcttaataaagcttataaaaatagtataacacctttctgtcgggcacctttttatttgcatcgtagtaattccaaagaattatctaaccgcgttaaaaaaggattttaacagcatcgggtcacatcattgtgagcacaatttgccaaagaaaaaaagcacctaagtccctagggatcacaacgggccatgctggtaataatattgggctgaagtactgtataggtccaggctcattagcactcccgataccctaacaaaacaccgtagtccaagcgacgcttcgacttccccgctgagactctcgccatttccccattcctcgctagagtacaaaaccgcgccgacgaagctagggttcatcaatccgctccaatccatcctcaaaaaactccacgaaatttctccgcgcgtccaccgcaccaattccccatccctctccagccacatctcggaccaaattagaccatttagctcacattca

SEQ ID NO: 57204 - DNA, 1501 bp, Oryza sativa
catcctagagttcggccacatgtctaatttcatttttaatgcaaggactagtatgtttgggacatacaaacttgcttccgcgttattaattacataataatggagatcattttgatatatgtccatccagctttgtgaaaaataaaatgtcattttgttaatgctccttccttttccttttgttttctcctaatgtcctatagctccaaaataaaatgatgtggaactaggtcgcgtaactatcgatttgtcgaaaacttggcacacatgattcagcttccgatcaacacgatccgaaccctgcaatcgcaacaccacgttttctttggttatcaactgtgctgaaaccctgttgacctttctaagaaggctaatccctacgtgtgaatcaaagaacataagtaagaacaaggtagattgcatctcaatttgccgatgaatgattaatatctcaaagatgaggttccatccctttcaaaaaacaaagttgggattccacaaacagaacaagcggcaaaactgcaatttcaaaaataatctaagtaaatccctactctaaaagatgcctactactgaatacatataatttgggacgtcctataacttgatgagttatacaattttgttgttatacgactttgttatagttcttgatgagttatacaactttgttgtagatgacttttttagctaaaatcatttactgctttaaaatattatttgaagttttgaaattcaaaattttaattgatataacaaattcacaagaaaaaatgtccaaaataatagtaataaaaacacaataacatgatagagcatgattttagaaacatttagaaaaaatcatctaattggaagttcatatgagtgagataaaccagtttcaaattttttaaattttattttcgtatacggctccttaagtagcctgtatggaaaaatcgattttcccataagggcgcttaagtgagccgcatgtaaaaatgagctcatttttgcatgcaattctcttaagagacccgtatgggaaaatcgattttttcataccggccgcatgcaaaaatgaccatcgattcttgcagacgtcactagttatgttccgtttgcaaaaatcaaggggtctcataaaaaaaacatttttttagtagtgatatatgcgagtgggagtaggaaatatttgcctaccatctgcaaaaaagaaaaaaaaatcaacattcaaaaattcattgcgcctttaatagatggaatactactagactttaataatcttttggaataaggcttttacttcctccgttcctaaataatcgtcgtatagcaaaaaaaaaaaaaccaaaaaaaaatccattttgtgtattacgaggggaggcaccgaaaatcttgcatggagcctcgtatcgcacacgcttcgttttgttcccgtcggagcttcctatgccaaaacccagcacgggcgatgtttcttctcacacctactgaaagacatggaggcgatggatca

SEQ ID NO: 57205 - DNA, 589 bp, Oryza sativa
caggactaaagataattggagcctgaccctacccaccaatttctttaaaccggcactaaaaataatctttagtcccgattgtatgagtgggtatcgtagtacttagattaggatcaccggcgactggctcgccatcccactgcccatgagttcggcatgcggatcgagctctgtattaatttagtgatgggtcttcgacgatgcatagtagatattttgcctcacctccggccacaaagggagtagatcttttctagtagtccattgaatagttgtgctatactaataaaaaaaagagagacatttaactatttgtcattcttaagatgtgatgataacagatttaccactcgatgtctaacatatgggccgcatgtgtctatgacatgtggacccagtgacaaatctgttatcactacttataaaagtggtaaatagttaattattccttaaaaaaaaagaaggcaaggaaagagtagcggaacgcggaagagaataaatgggctgaagagaacacaaccagcctgcaggtttcgatgcaaagaaagacgtaggtgattcagcccgctttacgggcctatccaccagg

SEQ ID NO: 57206 - DNA, 1501 bp, Oryza sativa
agcgcttcgcgcgactgctccctgttcgttcgcgacggctcgccttcttcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatcttatgatgcgattatactagttttcatctgtaatgtcatgatttatttatggaatagattaaatcattatatgtatataatctcaacatatgtatgcatatctcctaagcatgttactaatatggtgttaatatgaaatttcatcaatttaaaactagcctcgcatatgattacaaatgcgctatcatagcccatctaggcctgttaagaacatgacagtccattaagtatgtgattagtggcaacagcccgcccattatgacggcccataacacgtactgagtattgtccattggactattgggcctagagacatccggcccatcacgcccaacgccccccaccccccaacccacgctccccttggaggcgcatccaccggcctccgccacggggagagcgcaccgggaggcggaacggcgccgcgcggtgggcataggttgccggcccgacgtggagaccgcgggcgagccgcccgactcgacggaggggacgtgcgcgactgactggtgactggtggtgggtgagaacatcgcttggtcacttcctcagatccattcgggtaaaccaaacccatttttcgcgatattttaatggctacgagcagcggaggggcgtggggatttgattgcggggtaggattctactcataatgatctagtaccactgccgattccgattgaaggaattggtgaattgattgaccatgattgtagcaggtgcgactttcactagtttaacttgtgtaaattgtgtggtcctttgatatgatcgattgttgttgctccatcctccagccatcatggatgttgtggtgatgtttcaccaattgacctaaataggatcctaaatcgccctgtgccttgttcaatcgaaagtcaatttactcaaagttgagtattatcaagggttaatacggcaacacaacttcctccattttctgtatataactaagaataactcctatgcatttagctttagcatttggatttccaaagtaaaatgtatctgtcatgtgtgtagccgacccatccactaaggttgtatggttcccctcttagaaaaggtgcttcaaatcttatgttgcataattgtattggcaaaacaagtcttttttaatataagggattttggctatagaattgcttgcatagccaaaatcccttatattatgggacggaggtagtattttgctaagtcagtatgggaactgcagcattagcacttaatacattgttgtactgcctatataggtcaagccagtatctttgtacaattggctgaagaaactggttttatcttagga

SEQ ID NO: 57207 - DNA, 1501 bp, Oryza sativa
aactactgcaatataatgtccactaccaacaactatataacatacgtatacgtacggtcttatcttctttaccggccgtatgcgtgtgaccatgcatgcatgaatgatatgatttagctgataaaatctgcatttgcaaaactgcaaaagagaaaaattcagagatgcatatggtgctgttagttcacatggagtacagagactttagagctaggatccaaacccccaattcgatcattgatagtgaccacttactcgttcgatcgatcggtcgatctacggcgatctatcattctatccagcgtcgatccatggatgcatctatctatctgtgtccatctcatgacaaggaaattcagctaagctagacgcatagtgtggtccgtgtactgccagttgatggcttcagcagcatacgagtgctagctagcaatcgtggccatgcaaattagcttcagaatcgttcgatcacaaattggaatgggagcaaattagcagagctgtctgaatctatgtggaattacatgctacactccaatttcaggaatgtgtcatctgctagatatgcttgttaggtagattattgctgctgctgctgatgatgatccatcaattaatggtaagtaattcagtgctggtttaagcagagatggatatgacaaaatggtgccagcaacaccctaatcagggtggaaacatgagcaaaacaagtgatatatatgcacatttatgtaggacaaaaaaacaaaagaaatgggctgtttctgctggctaggttggaccaaaaggatggaatggaataccccctccatccatgtttttctggggtgggcccacacccccacaggccaccactggcaactggccaactcgtgaagtcagaatacagatcacaacccaaaatcactcaataaattcaaagaaaaaatgttctttttcaaaaaaaaaaggaatgccaatagtttaaatttaagtatgaaaatcaccaaaaatgtccactaccagaacttttttttcctacaagcaccaaagaagagcatgagttgtcattttattttcttattaaaacaacaatatacttggtatttattatacatgcatatatatatatatatatgtataggaaaaataattacactcctagtattatattaatccctagtgactagtgacttgtagtgagcgagagtgagagtaggctttaacttggggcattaacctccctgctcttcttcttcttcttcttcttcttctttctttctattcctttccttcctcctcacttcttccttcttcttcctccttcactctcctctcccctccatccaacgctgcttcgtctttggagttggagttggagttggacaccacccaccggcacctagctaggcttctctaccatcatctgtgatctttcttgtcgagagagagagcaagcagttgcatgcctgattggtcagcgagtgagctgctggtggcggtggcggccgcgcttagtcag

SEQ ID NO: 57208 - DNA, 1501 bp, Oryza sativa
gtgtcagtcaaatgaccaataattattaatttgtgagtacagttccctccattttaaaatataagtatcttgaagctatatacggatattaaaagctaggtacaaattgatgtttggttgataaaagaaagtaagtgaaaaattaaatgtaaaatggttgtagttagttgagacgagcggtagagaacttgagtggtacaaacatatttattttgatttatttgtttgaaaaagaaggcaaaagaattatcttttatattgatagagttaggagatcctcaaatatgtacatcatttgagagttagagtcggccctaacaaaagagggaaaagagttaatctcctttcacaactcccaggagactaggataatcatcgacttgagtactttctttggcatgttttgcacggaggtggttttcacccaccactgctacattgttgtacagttcgtcaactctattggtttgttatgtagctgcgatcatgtgcttatggcgtcctagatcctcttagagaggcggtaatgagcgagtaatagacttggttttgtcaatttctggttttacagtctactatccagactgttttggatgattattttggaaaatgctatagacatggcaaaattaatttattttgtgacggaaaagagtaaaactgagcagacggctgtgcatgcatttcggagctccagtaagctctccaccctggcttgtccattttttggccccacgtaattaagccaaaactagctagattgtctctgcacctcaagctagctagcaccactttaattaatcaggttaattgtatgtgtttttttttagccataggtcgtgtatataagggcggccatggccaatctgaatccgtgctctgcctctccattattccgactctcgtaagattaaggggggaggaattggagggcagaggccgccattttaatcagtggaaataaaatccacgcattttatatatttaatttaacccccaattttaacttagcagcacactagctagctagctgctaagttaactatttgatcaggttacagttgctggcctgacagttaattaatctcttgctggttgattagttgctatcagctacacgctctcgctagctgccactgtactaatacatactcccatctattcgcctgagaaaatatcgaaaagtagcagcaaagaggagcaggcaagatggtgatgaaccctgacgccgtccgcaatgtcgttggaatcatcggtacgtcgtctcgaattgaacctgcttgtagatgcttcatatatatatatatatatatatatatatatatatatatatatatatatatatatatatatatatatatatatatatatatatatatatattgcccgaccacttagtaattgactaataattgattaattgtactaggtaacttgatatcgttcgggttgttcttgtcgccattctcgacgttcgtgacgatcgtgaaaaagaaggacg

SEQ ID NO: 57209 - DNA, 806 bp, Oryza sativa
cgcgggttatgacccttgtgaagacgtgagacccctttgttttacaccgactggctggtttttttcttctgcatcacgtagaatcggattcatttttttccttttttttcaccctttattttattttgacggacagcgaaaacatctttttaagtagtagagatagagatagagatatacctggagaccacctgaatttcgtttcaaacgtgaaacaactcagccatcccgaaggtttagagtacaactagtataatgaaaaattgtctcttcttcttcctcctcatcccggcgaacgatcagcctgattcgaccgtgagcgcgaggatcgccttgcctaaatagatttgtctcatcgattcttcttctttgattcaggtgttcttctcttgctcatctccgccttgcatgtactacgtagattgattccagattaattacttggattatattgttgtgggcaatatgtaggcactagctagtgtcatctcctgtccgattaatccatacatggctgtcgttgcaacttttttatattcatcaatgatcaattcttagtttgcattaaagaggatatatgcatcagtccatgcacctccatagaacagaacatagcaactttagttttcagatagagaaactattaaactctcgaggatacgttaccctctctgcagatatagatatatccctgtcccatattgtagttagtatatggacatactatcatcctctcaacattgtacttgtggttgctagctttgcacaggctaattaatctatctctgctctaattaagcatggca

SEQ ID NO: 57210 - DNA, 1501 bp, Oryza sativa
cataccttgaataagaaatacatgaaaatcaatagctcaactaaaatattctggcattaacattatgataggtgcatacttgtgatatgatcgattaaatgattcgttttgctcttttgtaggaacagcaacaacaacatatagatgttttaactgcctcttcagcatattcaccctgaaaaggcatatcgaaactgaagtcattatcatagtcgttagggtggattggaataggagtctcgcacctgctaaagacagcaccttcattttgacaatcccagtttgtctcaaagataaatgcaacagatagctccccattgttgaatataaagtcctgggaaacacttgctcaggttacagaaaggcgccacagaaacagttgtgtgacgttgaagcaggaagaggtgcttacaggagatattgacaggaagtttaggcggtatgagtttgcagctaagaatgcagcaataaagttgatgaggcttggctgttgtttatccctccatgaagtgctcattgcgcatactccacgacctgcaggacggtgcccaaaaccccaaatagagtaaccaaaaatgtgctcagtgtaggataagctaaaagcagcctgctgcttctttgcttcaggcttcctgtactggtctaacattggagattccatatgaaagaattctagagtgcaaactgaatttctaagtgctcctgagtcctaacatactgaaattgaacagcagagtactgcagactgattggtttaaatgaaataggacatgaacatgaacatgccattagcaagtaagacgtgtccacaagtagcaacaggctggtgcttccggaaacaagcagccattcctagaactagaagtaagaaatgccgaaattgaacaggtgaacactgcaaagtgacggccttagctccttaagtaggagatgaacatggccacgcgcccatgccatataagcaagtaaaacatatccacaagcagcactagcctgatgcttccagagaggcagccattcctagaactagtaggattgagaaatgtaactcgtaccgtactgaactcatgattttgcgacattgcgggcttgattgatccagtatggggcgatgccctagcgcgtgcgtgagagggggagagagagagagcgagaggcgagggagtggatgacctggagcagcgggttcgggcggcggcggtgggaggcaggtccagccggtggagtgggtggagcgctccatcggatcggaggaggacggcgagacgaggcggcgccgcgacggggatcgagcggaagagccagccaactcgccgccggtttgccgtcgactcggctagtgcggtttcgcggcggcttttgctcgcgctgggcctcaagtgctagactgctacttcttccttgaggcctcgttttgttatgggccaaagcccggcacttcggcaaggatgggccagatgtttgaacccagggatttggtccgtttgaaaggaaatgaaaa

SEQ ID NO: 57211 - DNA, 1501 bp, Oryza sativa
gagacaatctagctagttttggcttaattacgtggggccaaaaaatggacaagccagggtggagagcttactggagctccgaaatgcatgcacagccgtctgctcagttttactcttttccgtcacaaaataaattaattttgccatgtctatagcattttccaaaataatcatccaaaacagtctggatagtagactgtaaaaccagaaattgacaaaaccaagtctattactcgctcattaccgcctctctaagaggatctaggacgccataagcacatgatcgcagctacataacaaaccaatagagttgacgaactgtacaacaatgtagcagtggtgggtgaaaaccacctccgtgcaaaacatgccaaagaaagtactcaagtcgatgattatcctagtctcctgggagttgtgaaaggagattaactcttttccctcttttgttagggccgactctaactctcaaatgatgtacatatttgaggatctcctaactctatcaatataaaagataattcttttgccttctttttcaaacaaataaatcaaaataaatatgtttgtaccactcaagttctctaccgctcgtctcaactaactacaaccattttacatttaatttttcacttactttcttttatcaaccaaacatcaatttgtacctagcttttaatatccgtatatagcttcaagatacttatattttaaaatggagggaactgtactcacaaattaataattattggtcatttgactgacacgtggcacgcaattggcgttagataggcatccgtaccgatccgatccgaattattaaccgtacacttgcgggattgcaggagagcatgcgatttgcatggcaagtgaagtgattgatgatggttcgaggttttgcttgcattggcatgccgatagcatgaataacgttcgatccatcaaacaatacaccaagcattttgaaagcacgggctttcttcttagccgattcagcccaacgcgttggtgcggttagttagtttcagttgggctgatttccaaattctgatgggccgatcgagttggacccgatgaatagtaagtttacctcgtgtccctcaactttacaccaagtttgtttgacatccattatcctcaataccagaaatattcacccctaaactatactccctccgtccctaaatatttggggccattgactttttaaagcatgtttgactgttcgtatacataaatgtttaaaacttttgtgaaatatgtaaaactatacgtatacataaatgtatatttaagaagaaaaggaattaataattacttaaattttttttgaataagatgaatggtcaaacatgtttaaaagagtcaacgggacggagagagtatacaaaaccggataatctgatttcgttgacgtggcaccctaccagccacattagcacggcccaccccctctccctctccccagcaattggactcggatcgccgcctcataaccgca

SEQ ID NO: 57212 - DNA, 337 bp, Oryza sativa
cctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccaga

SEQ ID NO: 57213 - DNA, 292 bp, Oryza sativa
gtaatgcagggtacgtcacgacggatgagcggcgccgacaggtacccgcaactgttaacccccccattctccttctcctgcacctacttctgatttcgatgtgttacaaggctgcgtcgcgcgctaaattattgcatttcgcgttggcttttaggaggttgttttgcctgagttccatcacgtggagaaggcggatggtgacggtactgtcaatggactgaatcaggttcgcatttgcaaatcctgttcgatgatggtgactgctttgtaaatgttgtttgcttctgaaacc

SEQ ID NO: 57214 - DNA, 272 bp, Oryza sativa
ttacacatgagatagcctcacagatccgtcttgccattacaaagcttggatcacatgaaaagttgaagccaatcaaagatgaacttccagaaaatgtaacccttcctccatgcatgattagactactgttgttaatatctaatagatctgttgcatcaacaaacaactgcttcttatgcactgccaagttagatattagttcatccaaagcgttcccaaggcctaatttacctggcaaaatgcaacatgatacttgcaggtaacttatgaga

SEQ ID NO: 57215 - DNA, 1501 bp, Oryza sativa
tgtagcttgcatctttcagtggtaagatttacatgaggcccggttttactatctctctagggggaaccagaaaccaggcatttagattagagtactaagcaagtcatggttctcaatgactctgtgccaatgtcaagaacatgaacatgaaattgacacatggtaaaaaattccaccctcaaaggatggcgcccattaaagtctgaagacaagaaaacatgccctaaaaaattgtgggcagaaagtaatggggaagaaggaaaaagaataggaaaatgatacggtcagcacacaaaagccaaaagcataaccaaagcagggagaaaagatgagggcaagaacaaagctgaacccatcataagttcataaccccacaaagatgagcatatcacatcatgtatttactgtttgctacttgcttagatgaaatactagtaaactagcctagatgagcctagcatcaggcatagaatgcttacactggcaacgcagtagtactggccgaaccgaactaatttatcatgcaacagctttctgcattcttaggagcaaaatggagcaactttctgggcgccaaatgcggcatttgagcaacttgattagagaagccactaggcaaatttgaaacgaaaagaggaagcaataaaggcaaaaccgaagctaatggaagattgaatatgggaaggtggcaacgactgatagatttctagtaggagttatgtgggaaactgctgcacatggcaatgtgggtgcagatttactacattgtttactgactacaagatctggagcagtacatgatttcttcatctgcacttaaagagaacccaatttattaatcacggacgacaaatgaataatgtgcagtgctccaaagtccaaagcccaagctcagaggtcagcatccagttgtttgcaaggatccacacatttctaacttgtactagcatccaaccccaaatgaaaactcagcattcagaccggaattccaggaagccaggcgcccagacttatgtataccgtatagatcaagtaactcaattctgaactcttttttttttttttgcggggaaactcaattctgaactagagcaggaacatcgtaaagagaaattacaacattattattgcctctggttaccttgctagatccgccacgcaagcaagtatgcaacgagaacaagagctggagctcaagaaaagatccagtctctgaacatttcgagctaggaaaaacagcaagattgaaacaaaaaagagtaaatttaatggaataatattgcggataagtctcctctattatttgtccgttccgtagcacagacaaaggaaataggagttctagcttctaggacggaaaagaatgttatccatcaaattcacctgaaacggcggcgtgcagtgtaactgagcagtgagcatcaatcagctagaaataggacgaatgttgcaagaattcctagaaggaaaattaagtaaaattgggtttcgacgaagtaaa

SEQ ID NO: 57216 - DNA, 1501 bp, Oryza sativa
taatcgtctaaaatcgcacaaaaatcacatccaaaaatttgaattcaaaactcgtcggtttcgcggtttcaccacgataatcgcacggtttaccgcgataaccgcgatattcgcattgttatcgcgggctgtgtagctgaaatcatgtaaatgtaaaataaataggataaaaaaaaaatcaaaaatacggttaaatatgtgtagaaaactagaaattgagaataattggaagaatatgtaggatacttaaggcccaatatcctcttattttttcaatttgtaaaccatttttggttttaccctcaaatttgaatttagcttactctatttcaaaaaaattcttcaccattggcaattacaaatcaagaactatatccatgaattttttcagtttttttttatttttttccggaattttgaatttggtcaaaattcatccaaacatatcgccggtttcccctatcgtacccctgtgataagcgcgataaccgtgataatcgcgcgattatcgtgcgataagtgaaaccctggcatgcaggatcagacacaatctcatgtctgcatcgatcgttctcattgttggatcattcatgcggattagtacatgtgtgcttacacaatttacacgcccgatacgatacatgcatcagcgacgagcagcagacaggaagacagcggcaaaaagggagaggtgacttttgctccattcctagtacgttgcacgaagcttcatccccctttgctcgatcgaactagccatctaggcgaaaaatgtcaacttgcaaatcttaacacggcgactacaaagccttctacttcctttaagctcgtattgctgctgctaggatggtccaatgggcacccactccactctagtagccattgctttaatttatcagagcaaattaatggaccctgcatacatcagctgcacacatcctccctcttctatcaagcattttcttatggacaaatatactaatcccatgctcaaatgatgtatttttgggaatgaactagttggttggtgtatgtaactgtaatcgatcttctggttaattaatttcagtttaaagtttctccagggtgaactgaagaggcgtatgtacagcatgcgcagttgctgactggggctgcatgcctcagtcgattgagtccacgtttgtcacgtacgtaatgcgaagtgcaaagcgcaaatggcgcatgcagtggcaaacacacgcatcaggacggcgtgggtgaggtggattcactcagtagctgggacctaatccaaaagaaaacgaggccgatttaatctggacgatatctttgcgctaattcgtcgctgagatcatgcacacgctttgtttaatccagcagcatcgctcgctttctgcacagggaattgtcgaccaaaaggcagcacgggattaaagcgcgcgtacgtacgtgcgcgcgcgtcgcccataaaatccatgcattgcaacctctcgatctctctccatctcgctgtctgcga

SEQ ID NO: 57217 - DNA, 1501 bp, Oryza sativa
gcaagccagccagccaagctctgtcttccatcttgcatacatcaacgtcagaaaaatcatcagatcgagatatcgacatggtggtggtggtggcggcggccatggcggcggcgagcttgtgctgcggcgtggcggcgtacctctactacgtcctgtggctggcgccggagaggctccgcgcccacctgagaagacaagggatcggcggcccaaccccgtccttcccttacggcaacctcgccgacatgaggagccacgccgccgccgccgccggcggcaaggctaccggagaaggacgacaagaaggcgacatcgtgcacgactaccggcaggccgtcttccccttctacgagaattggagaaaacaatacggtacgcacgtgtatatcgatcaacgatcatatatccctgctagctgctgtttgattggttgcatgctactactgctctgcccatgctgtgtgatcttcgtcttcctgcctctacataaaacagaactcaccctgtttagaacaagaaaagaataataacagaattgctaggtttcttgcgacatttttttttttgaaagaaaacttttgattttggaccgttagaactgctataagattcatgtaggaaagttataatgtgattgtacctttgctatatttgattttttttaaaaaaaaattgcgccagatttttaagatagtttttttaggggaaaaggagatatattactcatatatggcgtcaacacgcgctaaatgcatgatgaaattacaactgtttcctagccaaacatttgacaaggattcacatctagctttatttgctaacaaatgactgatcccattttggctgccatggatcttcattagcttaatctccctgctcccagaaaggagatagttaggtcatgtgtgtgtaaggaagaagaatctgcccggtggtaaaggagtaatcaacggctgtaatcaatcgatttaattactaataatcattagtattaatcatttccaactttcggtaatgaatggatttaaatatatatagtgaagatttggttctttctacaaagtaaatagtggagtactactactatatatgaaaagtttcagagtacgtatactatacgtccgttcattaatagagcaacaaaagcatatgcatgctgataggaaagtttatctatccctcgtttttgcatgctgactgtaaatactgcatatatgtaaagtcaaatttattttttaatctatgcaagtagaatttaaacatgcatttaagtataacgatactactatatctatattattaaatattttcttatgacttactaagtgatatgcaccaaacaaggagccgtctcctttagggtagttgtcgatttcgagcattcatatcaattgaaaaagttattacaaaaattaaaaaaaaacaagtcactcataaagtgttattcatgttttatcatctaataacaacaaaaatattaatcataaaaagaattaaataa

SEQ ID NO: 57218 - DNA, 1501 bp, Oryza sativa
gcacagctagtagacagaggtagtacaaactactttaattacagaagaaaaaaatatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacatttgtgaatattattaaaaaatttgagtagtagtagtatatttaacaatgaatcaaatgagaggaaaataattaataattacttattttttaaaataacataaacggtcaaacatatttaaaaaagtcaacggcgtcaagtatttagagacggagggagtactaattaatgtctggagagaaagccgtgcaagggaaggatggctaggtcaagagtctacttcaaagttttactagtaatttaaaaatccaaggaggcaaggtctcacatgattaattttcttcctgcagtatgtactatatccatttttttttaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgtttcagattcagtagcaatggcgctgctggaggaaagggaagcatcaaggatgctcaagtatggagctactgatgatatatataaagggagtcgaatggaagtacaggattgcacctgtggttgctgcatgaagccgtgggttggtaacttggtatggcggagggcagaatcgggaattaacaggacttaattaatcgatgattattaattaatagtgactctagtctagttgatcagatc

SEQ ID NO: 57219 - DNA, 486 bp, Oryza sativa
  unsure (1)..(486): unsure at all n locations
cgcggatganattctgctcggtacccaaataaaataaaatgttaaaaataggcaagacccaaggtaagtctcctggaaaaaaatggggtcctcccctcttatctccctcctactcctctctctcactcagcgagtacagagagagattgccaccgccactccactacaagtgtactcctccgtccaaaaaaaaactaaacctagaaggggatgtgacattttctagtacaacgaatctggacaaagggctatccaaattcattatattaggagatgtcacatccttgcctagattgtgtttttttgggacagagggagtacacaagaaggggagtataggggagggcctccatggatcatctccgagtggtacatggccctccgttttatgctactgctaggagcatgcctcctagggtgtaacctccgccacttggaagccaaccccagctcgccaaccgtcaccagaggcatgccatcgaacca

SEQ ID NO: 57220 - DNA, 1501 bp, Oryza sativa
attggagaaggtagttttggtttggtggcacacagatctccatgtcggcctatgccgcctatcatcatcattccactagtagcaaaacggacggccctggaagctggaacaaacagaagaaaacagcaaacaaattgcccctacgcgacgtaggcaaagccagccaaggcagcccaccaattattggtgggccccactaatcagggacagtaaaccggccttttttacccgccgcaccaacggcaggcgggcgctccaggaggtttcgcttcgcagtgaaaaaaaaaagaaaaaaagaagaaacggaagcgaatatcctacggcacttgggcttggctataaaaaggagccgtctttgacgcctgaacgaattgctgcgccgtgctcgaacagatctcgatctcgatctcgatctccgcacgcaccaaggcgaagccaattccactaccaccgctcttccttcttctcactccttctcgcgactgcggcgagggtgagtctcctgtcgtgagaatttcggtctaccggcggcggcggcggcgttgggtgttcttcgcgtcgtcagacgtcgggatctggtacggttctccttatctctggttgttgataatctatatggatctatggtttgttgattcgtctgtatgtgaaaaacatcatcttgggttagcgaggggtgggtttcagattctcaggtcgagtctccagtacactggttgagtgctcgtttctagatctgtatttgttctgcaacgcgaggtgttgtggttgatgcgattcatgcgaaaacttaatctgtcatacatacttggaagggtaaaaaaagaaaaaaataatctcctttctactggagatgcatagcgtgggaattataattagcctcttgttatctgctagcctggttgttgagcgaagctttcggatccaaccttttaattcagggtagctttatgtagtacagaaaactgtgtaactgtattgtgtttcctgttactttcttttaaaacaagttctggttgaaaagcgtagaaacagtcttaactggcatgtcttgttttcatgcatatgtgctgtgcagtagattaatccttttacctagaacttctcaattgagttttatgttagttgattccaactagtagttgtccatgactgaccttattgcatcttcttcttttggcagaattactagacttccaataagaaggaaacaccttagggaatgcagaaagatgtgcttgcatgctagagagctaccttgtgagggaattggcagggtagcaagccatatttctccttccacaactcttcatgacattggaacacaagagtatatacagcgcttgctccatgtgctctcgcactatggggttcgacgtggcaactcaaccatcttcttagatcaccatcttggtggagacggttgaagtcacctatcatttctaggctcctggttaccacactttgagctttgggattactgctttctttggcgtgatgg

SEQ ID NO: 57221 - DNA, 254 bp, Oryza sativa
ttgctaataagaattcaggttatgcattggactgttgttaagctgaggtaattgttcgttgatgatattgaagactttgaaccgtatgacaaaataccctttctgatcaatcaaccaagtgcatgtatgttacggttgcaacgagccaataattaccgagagacgattctatcagaaatgcagatgtgcataaaatttgcatctgaacaatccactcaaccataaacgaaaactttagattcagttgtagtatc

SEQ ID NO: 57222 - DNA, 253 bp, Oryza sativa
acatccactatccttggcaatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatca

SEQ ID NO: 57223 - DNA, 1501 bp, Oryza sativa
tcagatggtgatttcggtcaaacagaggagcgtacagtagctggctgctttgtttgatcatgtaaggttccagctgttgtaatgagaattgaacaagcttatcaaatgataattgtggtccacaactgatacgttgctggcaacatggacaagtactcatatatacatagttcttctctcaaaaaaacaagtatatggcgtgctaccgtcgccctggcggtttggactgttgcttcatcctccctacacgtactgtgcacgtcttgcaccttctcttccaagtactctaactagtaaaacgtactctatagtctacttcgtatgtactacgaacatttctttgagaaaataattagtagccgccgatcgagaagaaaaacatcatgttcgatctagtatcaactaaactctccagtgtatttcggcggcttggaatttccatgtgttttgtccgagttaaggaactgtaccaagtccatatgtccaggaaataaataaataatggaccaacaatttaactgtcactgtttttgcgcattgtacacgttgtttcttcttcttcttccaagcatgcagccaaaaaggaccaaagtcctcccaatatacagctgctaattaattaccctatctatgaagcatcaacgtcatcgatctttcctggtggtttcctgagatattactgtaccgtttagctctcttttgacctcacaaattaccccagtttttccacgaattcactgatgaatccacgattgatcaaatctagcagatcgaccgccgcccgctggaaaatgacacccaattagagggtggaatcagctgtctgtttcactaaaaaagttgaaaacaattttgtattgtcgtttatgtcaaatcgaaatacgtcatggccccttactctatgttatcaacgtcgcgacgtcgtgatcataccaacaaaggcattcgcaaagcgtacttgctaatattgtttggtgataattgttactcctactacggtgcaatttttttttctaccgtgcaccgcgtcacggccacagtttagcccttggcacgtcgcacgggccggccgtacgtgtctcgccaccatagaaaaaggctaatgattcagttttttttttctgttttggtaacaaaaggctaatgattcagtagctccacctgttttcgtttgtttgtcatgcgagaaaacaagattaagaaggttcgagatccacgaaattaagcctcgccatcgtcacagtcacagatgcagtacaaccgtgaagtcccgttcggtgtggcctatttcttgcagcctgctactatgtgaggctagcagtctagagtaattttacaattcttgggaagatattatgaggaaccaaaatttagtattaaatttagtatctcatagtatctagatactaagagttattaaatttacattaaaaaaaagtacctactcatcagtctatcactactaagtacatgttaatcttgtaccgcatcaatgccttaa

SEQ ID NO: 57224 - DNA, 1501 bp, Oryza sativa
aggccgacggcgagggtggcggcggaccaccgcaataaagcgcaggaaaagcgtcggcgtccggttgcgccggggcatggggccaacgggaccgggccgggcggtggtcaggttcatggctgcatgcagtctcttgcatgcaaatatagtggttagctctttacttgtttgtcttatatattttttttctatgtctaaatctgtgttaggtttatagctcgtttttcatcttttctctcttctttcatctacctcagcattcaatctttttataaatctttttatagcccctattatactgctctcacgcagggccaatccaacgaccaggtcacatggcaactgtaccaacatgtactctggtgatcagcgcctagagcacggccaaacagtaggtgtggcctatcgctacagtccaggtcaccccgtgctagtatcatcatccatggagatatcatatcagatcagatctcgaagctacccgataatgcacacatcgactcgccggccctcttatcatcccccagctcctactatgaacaattttaaacatgatctcaaacctcatagtttgaattccttttgagaagtctaagactactctaatgccttttcttcttcctgtgaagtatccaaacgactaatttgacaaatgtctttattttgagtttatgtcagatttcatatagcatgacatttaattactgtgtttttttttctatttttccatttttttttcttaatttcttatacgttctaaaggagcccaaacgaacggatggctgctgaagcctggagaaagaacaacgttaggtaggggataatgttcccttttgcaagtggcgcctagtacttcctcagtccaagaaaaaaaggtaaatcctagattttcgtgtccaacttcaactgtccgtcttatataaaatttttttataatttgtatttttattgttgttagataataaaacataattaatattttatgcatgacttgtctttttaattttttttcataaattttttaaataagacggacggtcaaacgttagacacgaaaaccacggtttgtctttttttttttttatagatggagggagtagacagtagcctctgaacggtgttccgatgacgcgttcgaggtacgcacgacacgatgatagcgagaaccgccacaaaagcgcagtgccagcctctctctctgcccatccgcgacgggttcgcaccagcagcaacttgtatagctgactctgttttttttttaacgccacttgcatagctgactctggcttccaacaattttcagcgaaccaattggcatcgttccatgagaagctgtgtaaactaagaactggtcgactgttttatcgggcaatcgatcgagggaggaaaagtcgaacggcagctctcgtccacaagagaggcaagattttcgtccatcctgtgtcatctgacgccgacgagtcgacgaacttcagtatcttgtattcttgtccgctcatca

SEQ ID NO: 57225 - DNA, 1120 bp, Oryza sativa
tctagtcatcttacatacaatctgtcatatgtaaaaaaacagtctacatacaactgagagagtttattgatataacgtttaggagtttgagaaatatgctaatggagagcgatagagtagccagcttccctgacttctctttagaactcgtattcgccttagtataccatggagtgaaaactagaagttgtactccctccggttacattctttacattttggataaggttgtggtcaaactttttataacttcactatcaataattttataattattttgtttaactataacaccatatatatatatatatatttatctttcaacgtactataataaatgtaaacatgcatttatttactgtatatattaaaatagaaaattaaggttaaatatatgggcttgttcactttgctaccattttcaaccttaccaaattttggcattaccaaattttggtaatattgtcaaaattttggcaaggttgtcaaattttggcaagatttcatatgcacttactaaaatttgttaacaaactaaacgtaaccaaaattttagcaacttaaaaaaaaaggtatagttgaaaataatatcaaagtgaacagaccctatattttgaagaccattgtctaaaatatcgagaattataaaaccggagggagtatcaatttgaattcgtattcgtcactcttgacagttgatctcgttttcccatgctaattttctactgctgcaaatttgtttgccaacttttcaaaatacgtactgttacctatctcttattttgaaaatatgcagcattacctatcttgcttctgggaacaaagatggggactcacgaaccaccatacgactttgagacctgacagcctgcataccgcattgtcggaacacaaaagcgtttaaaggttaggctaattggctgttgtcacgtcgtacccggtcagaatagtatgtgccaccatttactagccaaaaaaccaaaagaattagagcttgaattccacaagcaaaatgggttaatttatggactaaaaggccttgtctacatattgccaatagcgacgtcaacagtctagcatttctttcgctatgattatgccggcttagcgcattttcagg

SEQ ID NO: 57226 - DNA, 305 bp, Oryza sativa
ggcatgtagctagctagggtttcaacaatgaaggccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacagg

SEQ ID NO: 57227 - DNA, 162 bp, Oryza sativa
ttcctgcagccctactgtgtagttacatgtgtagatctaatgatgcgttcgtgctagttttcatctgtaatgtcatgatttatttatggaatagattaaatcattatatgtctataatctcaacaatccaaaaaccttatcataggcactgtgattttacta

SEQ ID NO: 57228 - DNA, 233 bp, Oryza sativa
tttctaaggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaattttggcttgggaaaga

SEQ ID NO: 57229 - DNA, 214 bp, Oryza sativa
ttttcataccacgactagcagtactaattttaattattattcatcacctgttaatactattagtcatgctactccacatatccctaatgcttacaatgatcctaatagaggatattctcatgacaccgggtatggccaatatattatattgcgccgcaacaaccacctcttaggccaccaaatacaccaccaaatctatataggcctaaaaata

SEQ ID NO: 57230 - DNA, 284 bp, Oryza sativa
aaaaatatttgtaactgtaatcagcccgcttttactttcttatgaattatatcatttttaactggaataatgtgttaattttctgaacgttcaacgctgctcgcaagcatttccccaaagccccccttgccgatcaattacattttatatttgttgaaacttccacacaaatttcgtgagctataacatcgtaaaaagtttgaaaaggaagtctaatcaacctctttgttaagaggacattaccatgtaactctgcagcggaaaaaaaaaactagatatatcca

SEQ ID NO: 57231 - DNA, 162 bp, Oryza sativa
gcagttcaagctcaagctcggtaacgtttctcaacacactgtaattaaccgtaactaaaatttttttaaaattggttttcccctttaaaaacgtgtaaatttccctttccttgtgtcatcaatgtattatatatgacgtgcagtcgtctgaggacgacggga

SEQ ID NO: 57232 - DNA, 219 bp, Oryza sativa
aaaccaaatgagagatatgtaaattttgtgaacaatgttactgtcactttatcggatgaagaaatgaccaaaataaaagttatagatcttgatgatttatacaactttgttattgatgactttttcagttgaaatcatttagtatttgaaaatattgtttgaagttgtcatattttcaaattcaaattcaaactgttcaaacaaagtcatataggaaaa

SEQ ID NO: 57233 - DNA, 268 bp, Oryza sativa
taattttgtcatattctttaaatatagacctttaattactcaagaatacatttttgcatgcattgttaagaagtttttactgtcagggttatggatacccaatagtaatcgactaagctcggcaaggcccaccacatgccatgtcttatacggaaaaaaaacctcgtatatagaaggagttccggataaggaaggagaagaagagttctacatagaaacgacaaggactactcactactcagatcgtatccatatttatctccctagt

SEQ ID NO: 57234 - DNA, 1501 bp, Oryza sativa
  unsure (1)..(1501): unsure at all n locations
tttttttatgaatttacaaaacttttaggtatgattttcatgagtttccaacacttaactcgtttccacatatatgtccccctagcttgttttcacatatatgtccccctaaatgtaacataatggtgaacgatatctgttccagacgtttattattattatttaaataatataatgtaggcactcatatacgcgtgcatacacacatttcttataaacgcgcgcttgcaccactacactatggctgcctaagcgcctgtctgaagccctgaacagtgaacacttagttctgcttactatacattctgctgctgtctgcaactacaaggcactcaggaaattgtgccattcaatttctttacaattttaccgaattcttctgaacagatgagaagagcgaaccctttaaacagatgagaaagcggtggcgcgacaccggagatggtttcgcttctcttctgtgtttctcaattgtaccctctcacgatagatggtcagatttgattttgtacctcccagtactagtacctcccggtagacgggagaaaataacgccaaaattaggtccttgatgaacaggcgctccatcccttgttaagcggaagagcatgcgtcacctttggatccctccttccatatatataaaaaaaaccacgcttgatagctacaaggcgacgttgacatttttcgttaaacatcaatcacaatacgcccgttttggatgcatgtatctttggtacggcctagttaacatcacttaactaagaacaaaaccgtcgttcttatggtccattactcaacaagtatatattgctacatctaggctagatacacactgtaaactactagtattaatctattcccgccattgctgattatttttcagcaatgacagatgctgaacttgagcaatataaaacagtagtaataatttaatgttgcagatcgtgtaacagggaaccatttcaagtcaactcttgctacacacggtcggcacagctggggctgtgccacactgtggagcccagatgcttgctatgcatgtgcatatataaatatatgtgccatcttcttcttctatgtccattgtatctccaataagcttgnangtatttnnnncacacnannnnnnnanantccccccccccccccccccccctctattttgctcatcaacttcttcttcttgatgtccagaagttcaaaggcacctctgtttcttccctaggtgagattaattcttctgtgtttgtcgattcagggctcctttggaacgcaggaatttttatgggattttcatccgatttagtctaattcctctgttccaaaggaggtcttgttgtttggctgtgtttcttgtgtttttaatgtttcacttaactttttcatgtcacttcacttttttttgttagcagcctctttatcctgttctttgaggtgactgttatcactttatgcaggaaagccgtttcttaacaacaagataaaggtgtggtttgta

SEQ ID NO: 57235 - DNA, 291 bp, Oryza sativa
atgccaaaagggggagaatagcgtgttttatgttttgtgggttgggtctagtagtagtgaggttagtcacctcatatttaataggttaaggaggattgggctatatttggtatgggtatgggctattactctatattgtgtcattttgaagcactttttgccattttggatctaaacactagtagcaaaacttggcaatttggcatttggcatttgctagtacatagtagcaaattatgccaaaaagtgctttgggaccactccctctctctttctctctctcactttagt

SEQ ID NO: 57236 - DNA, 304 bp, Oryza sativa
tcctgcagccctcttttctcagttgtcttaagaaatagcttagtcgctaatattaaaactacctcaaaacaatacttgctggtaatcaaggatttttaaaagatagaagcagaaataagtcagttagttggtcagagtattctggtataagccaagatcatcttcatcttttgtcatgatttgcttttcaacatcctggagttgtttgcagtcaaattttgtcttctgttcatgtcatatcaatcttcattttattcatatatcacttcttggtttggcatctgacagtattccctcttgcagt

SEQ ID NO: 57237 - DNA, 383 bp, Oryza sativa
tctcttgtgtatcaagccttcaggctaggggtgtaagtggctaacccgcgaaacccacttataggcgaaaataagccgcgaacccgtttattttgacctataagtgggttcgcggctgacccacttacagccctacttcaggcacatgaggatcaatcatttcatagtgtgactatttgtagttatctgtatggccgtaaataatggcctctatattgttctgtattggagtatctctctactatttttttctctgaagaagagcattcttttacctatttttggttttcataatttaatgtgatgcataatttgattctgttcttttttagataaaggaggctaatttgattctgttcttgcaattgtggatgcactgcagg

SEQ ID NO: 57238 - DNA, 924 bp, Oryza sativa
acataatctctggcaatatcgctgtctaacctacaatcggctaacatctatcgaggaaggtagccgattaggttagattctgacgttgattcagattatataagatatttaccactctatgaaacttccagcggcttgattgtctagatattgttcttctcttcatacttaatgctgcatcagttgagtttgatttattaagtcgtgcttagaagatcaatctctaacctgtcttctggttgccgattagggtagcatcggagtttcagccgatcttatctgatttaactatatttgctttatatgcttaattgacatattaaatctgtcctttacgtcaagatattgctatatttaaatatattaggcctttgtttgatatattatacctattttaatatcctgatatagagtagtatcggagtattatccgatacatgctaggtctatctgatcagctatgctataacatatatagacctgttattaatatatatttcgacctaagtgatttatactgtctcggcatggtgaccgatctatctcaatcacttgatttaaatatatatcgatataagaactgtatattggaaatatctacagccgattgaatagatttagttctttattatctatttacaattgccgatcgattcatatatgacatcggctcagggataaatgatatgtcatcggcatctagccgatcggctatcatttatagatttaaccgcagtttctttgcttctatttcttgttgattacaggatcaaatcaactgtcacgctagtacacccaaaggcgagctttggacctgcactggagttaagcagatctctcaggcctcgtgttttctgttaacacgcttttggcacgcccggtgggaccagtaagaagtcagccgacagttcttcctcatagccg

SEQ ID NO: 57239 - DNA, 1501 bp, Oryza sativa
tctgccgggaattaaaaaaataggacagcaaattaagtgccggcaatgaacaaatataaataggtcaattgatctgccatagataatttaagagaacacattatctgccgggaattctgttaccgggaaaccaattttacagtgaactgtttgaggaaattttggcgggctaaaaatattggcaggccgagcaaagctccaaggcgtggaaattttcgtgggcccaacatcccgtcgcacatgattcctcatcgcatcgcactcccactctcgtcgcaccgcacccgattcctcatccacgatgtctccacacgcaccgccacacgctgcacgccgccgtcgactccaccggccggccaccactgttgttgcctcctccccacctccgacttgacccacacgccactgtcgactccgcccgccggcttccgctgtcggcatatcgctgcccaacgcctccctattgccgccgcagccgcactctctccctgacgagctccattcctctatgcggccactgattcctcctcctatgcccgacgcctccgcaccaaaccctcgactccacacatttagacaggggcgtagccaagaggtagtcccggtgggctcggaactacccagaattcggcccagagacctcacctcccaaaaaaattaggcccaaaagcctgtttagcccaaaagcctgtttagcccaaacagcccagaaatattagggttggaaggattccagtccaccaccaccaggcgcgcctccaccctccacttctccacgccgccactgtccagggccgcgcgtcgagcctccccgtcgtccgcgccggcgctgcgccatcccagccgtccactctgtccccgctttcctcgccggcgccgctccgtcccagcggtccgcgccgtcgtccgcgctggagccatcgacgcccatgggcggtgggtccgtcttccgcgtcggcgccgctccaagccgccaagcgggggccggcgacgaagcgacgctgcgacggcaactcctcctgtcctccatactccagtcctcctcgcctcctcgggtcaccgcttcgccggactctggccgccggttgcgggttgccggcttggtggcttggcgcggcttgccgcagcgccgccgctcgcctcctgcttaattggctgctccacgtctccactgatccggcgctccaccatttagctcaggtaacgaacagatcaacaaaacactagaacagctgcctaaatcaatttgtaattagagatcagtgaatatgtgaataagaataactgaatatgcaatttataaattcttactaatgtgtgctattatttgtaggattggtaaaacatgaagaggaacggagatcaaggaatcggctcggatatccacttgttcaggtaaaaaatctcccggttataccagatccatgatttgtttcttctgaaatgagtgaatgtatgcatgtatgtatggattgtttcatgtgttaaattataagtgaat

SEQ ID NO: 57240 - DNA, 790 bp, Oryza sativa
tgataactcgacgaatcatataaacaagattagagtatcatgaggatggaagcactaatctcaagaacgcaagccgtcataacaagttttacctcttgttgaagatcgaaaccgatgcagctcaacccgaaagcaagaactcgtcgaaacaaaactaaatcaaaagggtggtgatgtgccgaaattgtattgaacgtgtgttaaaagttacataggactcgggtctatttatacccgagaattacaagatacgtccataacggacacgactactatctctaacaaactctaagataccataagtctttgcggcagacttttgcccaaacgtatctctaaggaaattatataaaacatcctaattaatagatacaattgcctcctcagaactctatccatgtacggcaaccaccttgaagcacctcaatcgaacccgacatcacacattaagttgtattgtcgggatcggctacgtctgcttacctagcccgactcagactcagccgatcttatcgtagccgatctggactccagccgattcctgccttgttttcgaactcaatctccgcctccgactttgcttcgatctaatcttctttcccaatgccgatgttaccaaatttggttgttaacaagctcacaccgaaaccttccatatatagaggaaggctatataaaaaggagagggtgctcatattgtacacttgtgcttgacttgtgcttgaggatgatagaatgatgaatgagaagagagtctcacccctatatcttgtgtctccacttttataga

SEQ ID NO: 57241 - DNA, 696 bp, Oryza sativa
ctgcttgtggtaagcacggtaagtctccaagggtttcccgtgaaccggtccttaattgccatgagtgcgaccagcaaaaccatgcacccacaacccaccattcggtgtattttaattaactaacaccattgcggtggcacgaatccagaactatgctcatagtcagagtctatgtaataatgtgatccccttttgtgtactagttgaactaagcatggctaagcatttcctaaaccaacatctaatcattttgataccccagttatcaatggcatatggaaaacgatatatggctgagtaataggacccatcccacatgacattgtaaaagagtgcaacatttaatagaaatgcagagtgtttgtaaattgggtacaatatgattaaatgtaaagcatgacttgccttgctctcacactgatgagacctcagcaacgtcttcgagaaaccgcggatcgacgaaacggccgaaatctacgcgacaaacaaagcacacaagcaaaacatgctataagactactgcaacaggaaacaaaactatttttaatggattctttacatttttatgaatttattgagacttgaatggacttaaacgaagctcggatgaattacttatgaattttagaagataaatagtgtttttactaataaagaaaaagtccttaatcaatttattgcgcaataaatcccagg

SEQ ID NO: 57242 - DNA, 253 bp, Oryza sativa
atgcctatcaaaaatagatttttcagatttgaaaatatgactatcaaaagtagatggagggagtattttggaatggagggagtattagtaaatagaatatgatcttgttggattgagtaatatgcaatcataactccccaatgtacttttgaagaacagtgagagattgattaaaaaaaagaacattgagagaagatttgcctcattttccacgcgcatgcttcccgaactactaaacggttttataaaacaa

SEQ ID NO: 57243 - DNA, 1501 bp, Oryza sativa
ctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcagacgcgacgtgggaacatggctgtctgctgacatgaccattgtcagaccgatcacaaatcggtcattcttgtccaccacgtgtcagtttaacaatctgcatgttcacccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtca

SEQ ID NO: 57244 - DNA, 1501 bp, Oryza sativa
atgaggtgcaaggtgttcgacgaaatggcaggctacttgaattgaaggtgtttttttgctgtaggcctgtagcgatgaaaagataacaaattaagaatgcagtttgcgaatttgtcgtcaatttccattgttactcaaaaatgtgattaacaatgtgatacaattcactgaatcatactggaatggtgaaactttttcttttttttttttgcgggggaatggtgaaacttttgggtggttttatctttgtgatatctctttcatgaacatatacttagtaagagcattcccttgcatgttgccgttactcataacgaatcgcttcgaatgtcactttgacctttgaaaggattggttcattatgttgagtaaatcttgtgaatgctaggagtaaagccgaccgtttctgccatttttttttcatttaccaggacgcattatttgactgcattcatcactgatagccataatgtaaaactcgaatattaaaaaaagaatgacgaaaattgcccccttttttcattcaaaagaacattgtctttgttgctaaaagttacttccctgttatagaataactttatttgttatccatttcataatactaatattgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcagacgcgacgtgggaacatggctgtctgctgacatgaccattgtcagaccgatcacaaatcggtcattcttgtccaccacgtgtcagtttaacaatctgcatgttcacccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaagg

SEQ ID NO: 57245 - DNA, 377 bp, Oryza sativa
gaccttgcccacttagaaaaagggggaaaaaagaggagaacgatcctagaacgagaggggggctggctcggactttgtagcttcttcatacacagatccaccaaaacacaggagtagggtattacgcttctcagcggcccgaacctgtatacatcgcccgtgtcttgtgtgtttccattctcgcgaactttccacagaccaagagcttagaacctcacacagggcccccggccgaactggcaaaggggggcctgcgcggtctcccggtgaggagccccacgctccgtcatctggcgcgccaagtagggggttctgcgtgtgttcttctaagctctcgcactctttcgtgtgcgccaagcttttcctgttcagcccaa

SEQ ID NO: 57246 - DNA, 1501 bp, Oryza sativa
ctaccggcgcccgccagttggaggcctgcgctggaggctggctcggaagtcggaggcgcgcttcgtcggcgaggggggtatagaaccagtcgctcttccagtcatcccacttcttgcggaggacgcagggaatgtagtggttcagcaccggcccccgcggctggaagtagcaaccaccaaccaccgacggcggcgacaccggctgtacagtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagctcggcctgtctctcgctcacgatgcgggaaggcggcagcacgctaccatcaagcggagcggagccccgtgccatgacgccggaagaagagatgtttgagagcgagcgcgtgtggcgaaggtagggcacaggaaacaaggagttagggcgcaagcggcgaagacaaggggaataatagtgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtctagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccaggagtatcatgacttagagacttgaggcagacacgatcgcccacgtggcctaaccccctcgggggggtcgggcccgagggtgatacggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattacggtttggacgagcgcgtcacgccgcatgtaacgcagtgcagcgcgctcgtttattcggtctgtgaccggtcacagaccggtcagatcgtgggttaggtggcgacaggcggtctgacgcacgccttgccccatcccgtcaggacgagagcctccaagcactcgtccctagccggaaccggcgtgttagctcctggagatggcacgtt

SEQ ID NO: 57247 - DNA, 373 bp, Oryza sativa
ttcctgcaccccgttctgcagttagtaatcattccataatttaattttctctccatctcttgcggtgatcaaggtgcaggcattaaaaagttttgtctattttatcacagggaatattcataaactcatggtttttcgggatctttccattggaaccaattaatcaagaagtggcctccactgacattttgtgggtcatcacttctccaaagaaaggatcctctaatccagcctattctcttgctgtgacatcccggcccagggattaataggattaatagaatactcatatcaacaagttgcaacttcttttccggaagccgatctcgaaagaactctaaggttaagcatgcttagcttggagcagatttgg

SEQ ID NO: 57248 - DNA, 682 bp, Oryza sativa
ctgcaccccgcagattctgaacagtgctcgtctctataccatcatgtattacatacttggttgtggaggacacctcggctaatggattgttgaggatatctcggctaatggggaaaatatgcgatggaaacaacatatgcagtggaaacctgaaaactaccgtcggatcgaaaaatggacgtctgagattcttccacgttatcccgactaaaaattttactcgcagatatactcatgtagtaattttttttatcatgcgtctattttttatctaacaatcgttttcaggtttccactgtatattttcccaagctaatgagtaatgaaagttagggtttgattaaaaaaataaacaaataaatctcattaaccgaaaattgcaacatactccctccgtcttaaaatataaacatttttggttataaatctggagaactatgtgtctatatttatatatagataaaaattgatatattttgggacaaatgtagtatgtaaataccgcgatgggtctatgtgcgtgctacgtgtgcaacttgtctctctagaactgaaaactgctaaatcgaaacaagctggggctactgggctttacacctcaggaatgaatcgaactgtcgtggccccataggcccatagcacccatgggccggggccttcacttcattttctctaccatagt

SEQ ID NO: 57249 - DNA, 328 bp, Oryza sativa
cgatggtatatttatgctaatcgaacaacatccagtatatttctgaaagaaagatcaatgaacagtatattttcaaattttattcccatacatttaacgaacattcaaaacgcaagaggtaggcataatccatctctctcccggtctcaactggactcgatcgacgacgcaggttttgactcggcatccctgtgttgtgaggggccatgttggcaactaggcattcatgggccacaatgtcttcggtcggttttgcaagttaacgatgcctttaaatgggtcaacgagaggggggccatgtctcggtcgcgaaactgattccgcgaga

SEQ ID NO: 57250 - DNA, 513 bp, Oryza sativa
gcttcaattgtgtttgttgaatgcatcttctgatgcttcggtctctgtgattatctaaggctacggattatgtgtaaaattctagtgtatgcttgttcaaatgtcagtttgcacttttaagcgcaagataaaatgcgtgcagttaaatttattactacatttgcagttgaagtggctagtagttgcataagcaaagcaaagcctatgcaatcatattcttatcactatcatgacctatgatcctttgaaatagttttaatgggaaggaattaatcctagtcccttcagattgacaggaacttcagattgacaggaataactaccctacaatcagaggaatttggcattttttcttatgcaaactaagcctgaacaataattgagcgagtagatgagtcaacataaaagcttgagttgaggacacgcctagatctgtgattatccattgtttcactcctagaatttaacttatgaataaatccgcgtgcatttgaactttaccaatggtttcct

SEQ ID NO: 57251 - DNA, 489 bp, Oryza sativa
tagtctatatttaatactctaaattaggatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagca

SEQ ID NO: 57252 - DNA, 224 bp, Oryza sativa
ttttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttaga

SEQ ID NO: 57253 - DNA, 170 bp, Oryza sativa
cccccgactccttccccgccgccgacgtcgccactgcctccagagtcataaccgccgtcgccgctgccaccgacgccaaccgccgcctctgcaaatcgctgctccgccgtcgccctccaccaccgaacagctagcagcccgacgccatgtcttccgccgccgttgccaga

SEQ ID NO: 57254 - DNA, 482 bp, Oryza sativa
tgggctcgcggcggccatctcccgagctcctggcgcgggtggacgcaaaggcggtggccgaccggagcggcgccggcgtcgaggcgcatggcggcggatccggcgtcgccaccaccggatctggcgcgctcgcagctggatccggtcacggaggcgcgggcacggcgtcggcgaggcgtgggcgctggcggccgcgacaggcggtggcatacgcgacggtggcgcaggcacgggcggccgggcggcggcgtcaggcgtgacggcggagcaagcacgggcagcagcggcaggctcggaggcgcagctgctgtggccggtggctcgatgcctggcggcgacggcagcggtgcccccagatccgtgcctctcggctggatctggaggatgggagcagtcggcgacggcgacgacggtgtggcgacggcagcggcggtagttggccgatggcagttggcgacggcggtggcggctgtggtggctgc

SEQ ID NO: 57255 - DNA, 358 bp, Oryza sativa
gacctaagaggctgtgggatccatatatcaatgagcagtactgcagacgatctgcatcccacagactgatgcagtaactagggcactaggtgtacaagctaatatatatgcacaaatctttcggtgacacagaaacaccggagctccaatgaggccatgaccgaaaagtagtaaagcagtagtgtagaaatcttgctcaaataattccctgaaaagcgatcctgtctgtaagtggatgagcatagatgtgactagatcgatcaccagaaatgcaccgttgaacagtagtcgaaaacaaaccgcatcgtacgtcctccttgtcacgacgacatgcctacggcctctactgttcgatagg

SEQ ID NO: 57256 - DNA, 362 bp, Oryza sativa
atggctaactcacctccaccaaaacaagcggtatggtactaaaaatattctgctcccccggcggctctggtgtctcttctctgctttgcaccaatctcctgcatgggcctatagaagcagcactgttgggcctttcctgacgctagccacagcccacaacataagtcccattccggcccaactataacaatccacaatatactacaagtctgtatcctaaagtccaaatagtcgtcgcatacccgtacaatgtgaaccatccaaaatggaccaaccacatgtgaagcattcttccggaaggaataagtacatctgagatcccttaacttgtcaacgaatccgattttcgtccctcaaccaga

SEQ ID NO: 57257 - DNA, 1501 bp, Oryza sativa
atagtagggtttcatttgcataaacagcatttaataaacatttcagaatttaataaaatagttaagtagtaatttaaacaatattaatccaacgctatacaacataccctgttgcataggcccaatcattctgtaaaaccaatcctggctgcacagttctatctccaaaccaggaatataccattccaaactaggagctaatcaaattattaccagttatagcatcttttattatggtgagaagtgtgagactaatcacgaaagacattgttagacccgcccataactgcgggcacggctattcgaatagttttactctagccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacgattaatgtttcacaaccgaaactcgtgaaccggtccttaattgtcatgagcacgactctcaaaaccatgtactcacaacccaccattatcaagttttagttggcaagtaattaattaaccaatcacgattgaccatcgcgaactatcattaagccatcattaaataatagtgagtcataagttatcccaatagtgtgctaatgtttctaagcatggctaagcaatcatatctaatatctagctgaaccaatatataaaactcaactagtcaagttataataacccaagttatcaaggaataaagtaatcaagaacaaaaggactataccaaacaataggttaattccacccaatgacattcgaaaataaatgcaatagttgaatagaaacaatagctttaaacgggatcaacatgttcaaagggttgtttgggatctgtgtgacttgccttgctgcccttggaactcttcaaattcttctcctgcgaaaacaaactctccggaaatgtcggaatctaaacagaaaagagcaaaaacaccaaaacagcacataaacaagcatgaacagtacatgtggatatttttaacatgtagatctcaattttagaaaaaattagagacttgaaccaactaaatccgagctaagatgaattagttatgaatttttagagattaaatcggattaaaacacttatatgggttttaattgaattatgacgcaataatgaattatttttgaaaaggaaaaaggggtttattgcgtcagcggctagggtttgcggtggaccgggtgcacggcggcggctcacggaaacgaacggccgagatcgatcctaaccaaaacgaacggccgagatcgaccggtccacggccggaccacgacggacggcaacga

SEQ ID NO: 57258 - DNA, 230 bp, Oryza sativa
agaatagaataggaaagaccaagaactttatttatctgagaaatatcgatctaatgcaaagttccaaactaagcaaaaggtaaactgcttgccaacagtatagtcgaccaacgtcctcctaggacatgctctaaactagccatacaacttccgttgtcaaagcaacttattagacagacactacaaaccattggtcatcaaccaaaggtcgccatttagcactggatcca

SEQ ID NO: 57259 - DNA, 568 bp, Oryza sativa
ccgggactaaagtcccacccctatatatatgtcttcttcctcctccagctgcccgagcaagctttaaaatttcttcaaaaaagaggggaggtcatgccaaaatttctattgaatttattttggtgattacatacaaatcggaggtgcctaaaaggtttgcaacttcatcctccaatgttttgttttttcatactacatttgcacctatattttgcacacttttttttgtctccaaaatttagttgtaagttgatgagagcgaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttatgtacggttttttttgactcatgtaga

SEQ ID NO: 57260 - DNA, 1501 bp, Oryza sativa
ggtaaacatgttactggatgatgctatattactattattagcatgttcatagatatctccgttattcacaacacatgttgagtatcttgtttatctggattaaaatatcccaaaccagatatctccgttattcacaacacatgttcagtatcttgtttatctggattaaaatatcccaaatacgactatatttctagaggaggtccaaagtaatttgtaactattcaacattacgaaccattggtgtgcctagtacacacactactattatagctaaaaactggtattgatatggaaccctcctaacttgtgcgggttcttggagtacaaaaattaataatgatgaccttcgtctgtaccggttcttcaaatcaaccagcacgatgtattagtatcggttcctttacatgaaccagcatagaatagtaactattagtattggcatagaataaacaattgtcatatcacttcactgaattagcaaatattgcatttatggatccaaattaaggtacgggcaccaggttcgaattgaaacaagataagccaacaatggagtcaggatcaaattgatcttcaagatgaatatccacaataaattcaaaacagaaaaacacgccataaaaagacagcaataacaagcaaaactactggagaagaccaaagaaatcgattgatgctgcaggatgtctgcaatttcattttggacatttttactggggcaccaaaatttcaggaatttcggaaattttggaattaaaatatttaaaatccaaacaaatgttgaccaaatctaaaatgaatgaagaatactattgtgcccggcggggttgttctgaaattccggcgggcatgaggaaagtcagcgatgggtatggggacgccgagcgggccgagcccgatatttcttggaaaattactatggcctggtgaagtcacaattactttacgatggataggccatagggtcaaaaatggatggaaatttagagttacggcctacgggccattcaagcacgaagtaagcccaacatgaaaaaatgatacgggcagataatttacacttgtgttgtgctgagtacaggagttccaaacaggagctagggacctaccccctaaaccacaggttctctgctagagttcgagtttcaccataaatggggatgatgaagggatgccttttttcatgaaaactggcgtagaagttgaaggtgacaaattcagtcacaagtaatccccttctgattaacgcgagaatttgatagtttttatttctcctaaagttgtgatgaaagcttcgaggaaagtttccaaccatatagaaatatataatcgtgcatgctccattggatatgtcacctacctcatacacgtgatgtcttagtatattatttttgtagttttacaatagaaacaacataattgagcagctatatataatatatggaactcgcgaacattatataaacacgctattgaacttgttagtgtgtagtaatcc

SEQ ID NO: 57261 - DNA, 712 bp, Oryza sativa
  unsure (1)..(712): unsure at all n locations
cagaatacccctgcaaagacancggcaagtggacgcggncggcggcgggtagcagcatggacaaggtcttccggagcaaggcccgttaacgtactcaccgctggctgggcttctcccctgagagtgctcatgttagtttcacctgtctgaaatgtgctatagtgtagtttcagtcaacagtttatggtttcggtcaagattggtgtgataattgtcggttggtacagttgctactatgctggagctacctagtaaattctccttttgtagcagaaatgcagtgtggtctgatgaattacatctatgcagcaatgatattgcagtcaatagtaatggaatgtgtaattttcagtgcttatttttcctgatagaagcatgttttgcatcaaatggattttacagtgaagctgaatttgcttctgcaccctgctttcagttgcttgctagcagtccaagatggagttagctgaattttcaatggctcccacacatttcataactttattatctattcacttttccataagttagctgaatttttaatgggcttctcaaattgctgctgggaaacatgcagattgtttctcttctctttcttcatactagttgtttcatagcaacttttttctttgagccagttctgaacttcagatatgacagttgttgattgtccggttacttcagtctgtgatgtttcgtccatgtgtgcagt

SEQ ID NO: 57262 - DNA, 1501 bp, Oryza sativa
ccaggtaacgaacagcgaagcctccgccgtaatctcgcccaccacgcgagaagcggcgaacctccttggccggtatctgcagattgccgtcgtcgtcttcgtggaagcccggtaccgaaaaaacatggaggttttcttctttcgtgaagaaatggaaggctttcttgtggtgtatgacatcctccagaactgacgtggtgacggactcaacagcagtcgccttctactcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtcccaggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaagtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 57263 - DNA, 283 bp, Oryza sativa
attttgtataccacgaatacgtcggagcgctcgtaagggtgggcgggctagctagacgcacaaagaagcgctatttcgagatgggtccccaaaacaagaggaaaacaaacgagcacaagcatatcctcccaagaagcctcctaactaagatacatccgctgtcgtccatagccttccttcttgtttaatcctctcgacgatgatcagaactgacgataggacagcgtcgaagacacgcattacacttctaccatagttgccaggatgtcaacgaaacaataga

SEQ ID NO: 57264 - DNA, 1501 bp, Oryza sativa
aaatactagacaatgaacccgcaaagatgaaaatctatcttacttaaacaaagtaattaaataacataagaaaggaacatgaatgcttactttatagaagatgttctccgaacccggagcagagtatacaaacagctccggtactcctccagaattcctcctaggaagctacactcgtcgagatagaagtcggatgagggccaaacttccgggcactcctccagagcttcccctcactctctacctaattctaatgtacaaaagatacaatagagcctcttataattcagctcaaagttgtgttttggaaatgagagtgaaatcctccttatataggctccaaatgacggttaggggcttgggaaatgaccaaaagaccctgcaaccgccttaggggagaaatccgagccgtccacgtgaagccagatggcgggaggcgccatgattggttcggccgaattggcggttcgaccgaaccaaaaaactgtcctcctgacctctcctttggccggtaggttgcttaatgggcccccaacatcttgcacattgttttggcccaattctaagtggttttggtttatatatgggccctccaattcatgtaaacgcatcctgaattcgcggaggtgcattttatcgcatgacggatgtgttttctcctcaaattacctacatacacatatttcaccaacactagtagaaatgattagtaataaaccctaccactatgttggattccatattttatttcattatatgcaagtattgatggtcaaatattatgatttaaggaccgtcaacaggaggacgactaaggattctcttgggtcgtgctccactaggttgggactgttgacagctattaagtatcaaattctcgccgtcaatacctgcacaaaactgaatgtgtaaaacgtcttacataagtggttgggtatatttctaacaatttccacaagtgttgctgtatatttggatgcaggtgacaaactaccaaagttgtgaagaaatatacataaagaaggaggagaatcaaacctatattcaaacctatagtgttttggacccaaaaacctaatgaaacacctccaaatgagcccaaccactatgccaatggactgagggcccaccagagaatgtccaggagaatgggatgggcagtggcgtagttgtgggggtgccggagggggccaacaccctcctatccgaacaccaccaccacatccccctgtttttactctatattgaggttaactaagataggtatttatctagtttatttgtgcagcttagaattattattagtttagttagttagcaagcctaaaaaacattagaatgaaacatgatctacaaaattagtctgtgatttctcatttttttcaaagtaaaatagaagatacttatttgtgagattatttattagtttacattaaaaggatatagcaataaagactagttccaaactttcaatgatattattaaagagctaaaattcagt

SEQ ID NO: 57265 - DNA, 533 bp, Oryza sativa
  unsure (1)..(533): unsure at all n locations
gcttagctgcgtgcgccatccatggagccggccacgggccgcgctttgtgcactgctcnccgtattctctcgtggatttttgtcccctcccaaccagataaccctagtggcactcgggcccagacacacatacatacgtacctccactcacacacaaaccatggtgtacctagctactagtactaccagttatcgttcaaccggaatctgttgtaacgcacggatacttagctgataggatgtacttccgctggtttcattttaattgacgttttggacaatgacacggtctataaaatatatttttgaccttatttttctattataatatatataataaataaatgtatgttacttttattatagtgctttgaaagacaaatctatatatgttgttctaatttctttaaactaaatatttttaaagttattgatggtcaaagttataaaagtttgacctcaaccttgtctaaaacgtcagctaatatggaactggagggagggagtatatcctctctccgtgtaaggattaa

SEQ ID NO: 57266 - DNA, 1501 bp, Oryza sativa
aaggaagacccatgggtgcttgccgatcgggtcgctcaagttttctatgtgacagacccatctaatttgaagaaagacatagttatttcgggaaaacaaagtattttgggagttgatgatgtcgaagatatcgaggcatacaatcaatatgagaacatgatactatttacagattttcgaaacaagatactacgcgtcgaagaatcaattggcgaatcgccgaagccatacatgagaaatgaaggtgtagggagatatgtgaaaggctaattcatgtgaactgatggatgatgaatatttatgtatgaagtgtgacatgcatgatgatggataatgatgaatattatttaagtattaatatgtgacatgatgaatatttaagtattaatatgtgacatgatgaatatttaagtattaattttatattttttattcaaacaatttaataaattattaattcttttcctatcattatgattcaaacaatttattaaatatttttatggatgttgaattatttatgttgtgtaaattttatttacatatatctgcattaaaaaaagaaaagaattaaaatcattaaacaattttcgctggcaggccaataagaacacttctagcagaaatcattttcgctggcggtgagattaggtggccggccagtgaaaaaccatcgcctataagtacgcaaacgaccccaaaattttctaagtacggcgaaggcgcgaaaaccctagcgccgctaggctgcccaaattttgtgcgccagcgaaaaaccctagcgcctcctccgccaaccgccgctgcctcctccaccgcctactccgccgaccgcctcctccgccaacctcgtcctccaccgaccgccgccacctcctccagcgcctactccgccgaccgcctcctccgtcgaccgcgtcctccgccgaccgccgccgcctcctccgccgcctactccgctgaccgccgcctactctgccgaccgccgccgcctcctccgccgaccaccgcctactccgctgaccgccgcctcctccacaccgcctactccgccgaccgcctcctccgccgaccgtgtcctccgccaaccgccgccgcctcctccgtcgcctactcagccgaccgcctactccgctgaccgccgcgtcctccgacgactgccgcagcctcctcatccgtcgacctctgccgcatcgtcgctggtgagcatatgatgaatgcctgggatatttgatatgcatggtttgatgaatggttgatgaaatgcctgggatgatatttgatgaatgtttgatgaaatgcctgggatatttgggttaattctgaatttttcagtacaaacagtacatatccccatttagcaaattctgaatttgtgataaacagtacatatcccttttttcctcttcaataacagacaaacactttgatcgttaatttgcagggcagctcaaaacacactaacacatattcttcttttttcagtgaacactgctcttct

SEQ ID NO: 57267 - DNA, 1501 bp, Oryza sativa
ggcctagtgggaagaattcgtggccttgaagacatcagcggaagaaaaagagaagagccagaaaatgttagaactggcaagaaaaaacatctatcctcatcatttgggatcggccggttaccgtcctaaagccaagaaatggagaaaagaagaagaagaattaaaaaaggcaggcaaaccaattcctatggaatatcataacgaacgagccaggaactgggtgcatgcaagaaccccatcttttaactcgaagggcgatgtagtcttcaaagatccaaagctccagcaggtagccaacaagatgaaggagatcgtcacacaacagaaggatgggatattcgtgccagacagagaagtggaccaactgtcagttgctttgggaacctcggagcacggaggccgcgttcgaggagtctcctcaaaggctagttggaaggatggcttcaaagaagatgctgctagctacaagaaacgtgatcgatataaggaggagttagtggctagctgtagggcagcaacattgcaagaatgcataagattttttaaccgaaacccggaacttcagcaacgcgttgataggatgcaagatgcgtttcctatgcccgatgtccctagctatccagtcgatgatataaaggaagatactccttgcagactgcttattccggttagaaggacaggaaagacaattcaggttgcaactggaagggcaatgccagggcgcagatttcattgccaagatataccagatgactatgccaaggtagaggtgcggacggtaaatgaggatcacaggatgtacgagatagactttccaacacccgaggatatcgtgtaccttggagatgcagttgaccagataatactatggcacaaaaaggatattcaattaggatcaacggattctccgccaaggatactgcggtcactatgtcatgccttgcgtaacatggacgaagaaccgggggatcctccagaagatgcatcacctcggcatcaacctgaaaagcaagccgatcagcctgaaaaacaagcagatgaaccagagcttgcaaagcaatccaatcagcctgaaaagcacgcagattaaccagagcttgcacatccaatgcctgagcaactagagcctgagcagccaatgcttgataaagcagagcttgaaagggaagaagaggttgtacaagaaagggaaaaggaggttgtacaagagagggaagaagaggctgtagaagagcacaaagaaaaaagtgcgcccaagaaaaagtttgtggtaaaggcattcccaggaaggaagagagatatcaaggggaaagcaaaggatgtttatgataaaaggaaagcaaaaggcctgaaaataagcttggataaaactttgagttttattcctactgttgatgtgccagaactatttgagaatggcaaagcattcctccccacatgggaattagaagaaggaccttggcaattaaaaaggtggcatgaatggtacatgaaagcaagt

SEQ ID NO: 57268 - DNA, 377 bp, Oryza sativa
  unsure (1)..(377): unsure at all n locations
gcaattcgacactcatgctcagcatnnnnnnnnnnnnnnnngcnttagntagtcnnatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgaga

SEQ ID NO: 57269 - DNA, 1501 bp, Oryza sativa
cgggcggtgagggtggtgagtagctgttcaacttggctcttgccccagctggtcgcccgtgtaggatggttgacactccacgggttcttttgtttatttgaatttaagagacttctgctgctattcttttgtgttgtatgacaggtttatgaacccgattatgttggtggtggcggcagtggccaagggaggcaactggtgggctccccagaggtgacggggcgctgatccggtctccctcttcctctccctctccatcggcctcccactagtggcatgtagatctagggagggggggcattgctctgggtggtggggttcgcgagatggctcgacgatgagtggcgagtcgacggacaacgactaagcgatttgttatgtgatttgttcgtgttgttattttgttgttacatgttcttggataagtgttctgcactgttcttgcaagatgctatgcatggttggatatgatctctgtgttcagtgttctttcatgactagagctagcatttggaaattgctgactgaaatattctgggacgtgcaagattcattgttactgttcattgtttatggttggatatgattcattatgacgtagataattctgtgatggttcgattgagccgagcaatatatctttttttctttttgaaatcatgcacaccatagttgccggctgttggaccggcaccaatgaggaagactcataggtgccaccaatttcatgtccgctccaaatccggcaccaaaggggcttttggagccgacaccaaaggatgtctttgtattgtagtgtatggggtatcatctaattttactggaggtgtactttgaatatatttaggtggcatttgaatcttcataagattaaaagcgggcacgtaaaataagaaagctattaaagtgtgattaattgagttttaattattaaaaacttgaaaaatggatatatttgatatttgaaagcaactttcatatagaaaattttcacacaaaacacgccgttttgtagtttgaaaagcgtgctaacgtaaaccgatgtaaatctttatcgagaaaagtaccgggcctagcttattctggtattcgtattattggcaatgatgatttttccctaccataagaaaataatgaattttccatggcttcatccctctgtactatttatgtatgtcgtataaatcttttattatacagcaacaagtgggttaaaatgaactatcacgttcatatcgccctgaaattcccattgttgtattacgagcaaaaagaaagaacgtacaagtataatgctttatcatggaaaatctaaatttagactacaatggtatttggttatgtaaacataagagggagttatacacaaggggttaaaattcaacaatcacgtgaaattctactaggtggtgttttgctatacgtacagctatttctctagagaaaggtagtaattaagtagagctattcggacacgacatcataatccccacatccaggg

SEQ ID NO: 57270 - DNA, 751 bp, Oryza sativa
  unsure (1)..(751): unsure at all n locations
tgtgttnncattttngtcangttangaaacnnccccganttngtgaaacnnaccaccgagaattcgtaccccatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccgataccttattgagtttttttttttaaactaacgataccttattgagttgcatataactaccaattcaacccaaatattaaaatgatgaaaaaaaactaacaattcacttatactccaagtgatactgatcttcttgttcttgtatgcagg

SEQ ID NO: 57271 - DNA, 486 bp, Oryza sativa
cgcggcggaggggagagggaggggggggcgggggggggggggaggggggggagggggggggggggggaggggggggaggggggggggagagggggggggggggggggggggggggggaagggggggggtgggaaggggggggggggggggggggggggggggggggggggggggggggggggaaagggggggggagaggggggggggcggcggcgggggggggggggggggggggggggggggggggggggggggggggggggggggaggggggaggggggggggggggggggaggggggggggggcggggagggggggggggggggggggggggggggggggggggaatctcagctttggatgttattttggagggctgagatctacgctatatcacctttaacatgcttatcctatgtcaccatctgaatccgctttttcaattcatacctcctgacttgtcagtgttttgcttgaaacacaga

SEQ ID NO: 57272 - DNA, 1501 bp, Oryza sativa
ggtttacttcttaaaacctacttaacaactaaaatgtggaatggttggcctggattggcttgggacgagctgggacccaggtcgggttgccagttcggtctgaatcatcgtagaccttgggttaaggcaggttcgtgcgggttcacggccttgattaataatactgtgtagctctaggatcgtgtttacaaaatagctttgggcaactaagtgactttcaaatgctgttttctgcaaagcttaacccctatactatttccccttgtacccccttgcattattcatgcatctttcggtgtgacttgctgagtactgtggttgtactcattcatgctctatctctcccccttcagtaagagaagctttggagaagaagtcctaggtggagtcctgacttataccccagttgagcgcctgtgaagatggagccgtaggctcgctagtccgctgctgtttatttttgattgtcaggcctgaagcgcctgtgtaataatgtaagttttatcgatataataaagatgtgccttttgtatcatgtttgtgtggtgtaccccggcttttcctaggacggagattaatacactagcgttcgggaaaatgcaaattttctcggtcgcgacaagctggtatcagagccatctcgactgtaggataagccaagtggattaaacctaaggacatattttataaacaaaactattggcgaaaagttccttttttcctcctttccctaatgctatttgcaaaaggtttactcccttcttcctccttcgaatttcaactagtactagatggtctgctttgcgaagaagaagatgtcgtcagttgtctgccgaagctccggaagactgttggatccgctagcgaagcgaaggaagcagtgaagccagctgtgaagccggagtgaagatcttggagaacccatcgcaaaacctaagccatcctctagggtagagtcgttagtcgtgtgtttccttacttgtgtgtgtagcgcgtggtttggatctgtagggtgtgatgtaaccatgctaggttgtttgcttaatcaacttgcagaataagcctaacatacatcacaacagaaaaagattagatctgttaaggtcctatccttagttctgatctctttctttcctccaattttccctctctccctcttcaaaccttgtatcagatggctaacaatgaaaaaggcaataaggtcagaagtcaggacaagggtacctcaagctcccgattgaatgaagcaccagacaccagttgtgtggcagtggtccaacacctgattaaccagaatcgattgcttaaagagctactacagcagcatcagacaccaattctgaacccgagtcagatgcaacctcaagtgcagttggaggcagtccaagcactcacacctcaagtcagtgcaccaccagcatcccaaccggcccatcgcgccatgcaacatctggactcaaaagaagctagaatcatttgttttatatgtgatgaacaagcg

SEQ ID NO: 57273 - DNA, 1501 bp, Oryza sativa
agccgcgccatccccggccaccttccatggccgccggccgccattcccgcctccgttccgccctctcccgtggccagctccctccccgcgcctataaaatggaaccccctccttccgttctctcgttttagcctcctcccgcgtctccccgtggccacaccacccctccccgccgtcgtccgctctctctcgtgccgccggccgcctccagccgcctctccctcctctgtcgtgcgtcggtaggccgtgccgtcgccatcctcggcgtcgcagccacctcctctcctccggcctgccctccgtttcgcgcggtgaccatcggaggcgcgttcccgccgtcgtccagtggcgttgccgccactgtactgctccagccgcctgtgcagcctcgccggtgctatggctgtcgtcgtcgcctccttcctcggcaccgcggggccatcactccggcctccaaggcccgtaggactcttattcggatccctatccgaattaagctcatattggatctccatccaatccccttattctggcccattaagcgtgcgaccctgtaggttcatgtatactcggctgttacccgaaaactccttttcggtccacgcatcaacagtggcccctagcagaacgtattgacccacagggcatacataaagataatatcggctgaacctctggtgtatacttgtatgaacccttttgcctcacgatatcgattaagctcaaggctagatatgtgccatcctctaatatctcaatcattcatccgaacctgttgatagattatataacttgtgattgactcctcaatcacctttggcatggccatgcactttcataatctacaacatcgaggggcccagagatatctctccataggaggggcaaatcccatcttaattattcatatctcactacatgtttcatagtatacccgaaaactacttttataactacccaattacggagtagcgtttatagcagtccgtaagtaagctactacacatgttgggaaccatgataatctcagatctaaggatttaacaccaacactaaataagatcactgatgacacaacacatatggctcttgcagtgtcttatgttggatctatccaacaacatgttcactaacatgtgtccatattattaatttgatatctctatatcatgatctatgagacatgatcatcaattagtatatgtgctgatcatctaatcatatttgttccacatatgatatttaatcagggatcctatagaaatattaacaaacaagataaagagtctcatgaaagaatcacatattcattaactaataatgagttatctatttcaagaaacaatgtcggataaatatgtaaacatagtatgtgatacaatcatatctatgattgcctctagggcatatcactaacaatatatatactacacataacacacggatataatcatataaagctctgcaagcagctagggcggttaggcaaaaatggcgatca

SEQ ID NO: 57274 - DNA, 676 bp, Oryza sativa
  unsure (1)..(676): unsure at all n locations
gggggggggggggggggggggggggnggggggggggggggggggggggggngggggggggggggggggggggggggggggggggggggggggggggggggngnggggggggggggggggggggggggggggggggggggggggggnggacgaatctcagccgttggatttgttttggagggctgagatctgagctatgtcaccttgtgacatgcctaccatatgtcatccaatctgaatcctgaaaaggccaagatttctcattgtttgttagtaattttttcctagtcaaacttaacaagtttgataaagtttatagaaaaatttagaaatatttaaagtatcaaattgatttcattaaatctaacattaaatatattttaataatatatttattttgtgttaaaaatactactatattttttttataaacttgatcaaacttaaagggtcttatgatatgaaacaaagggaatatttagctctgatccatgtaacttaaccatagccactaccactatctgtacataacctgtagctagggaggaggataaggaggaagtcacgaagaagttaccagctgcccaggacgccggcaaggagccttacctgagcaaggaagcagcaatcgaggcagggttcgtggacaaagatggcaagatcctgtggtctagcta

SEQ ID NO: 57275 - DNA, 1034 bp, Oryza sativa
ctctcggccgccgctccgccgtgcctatggccgccgccggcgaccataggggcgcgggcgcgccgcctcccgtcggctgtgccggcgaggccgccttcgggcgcgcgccgcggctgccatgtggggcccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcattatcactgttttatttagccatgcctatttacctttgttacgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggt

SEQ ID NO: 57276 - DNA, 241 bp, Oryza sativa
  unsure (1)..(241): unsure at all n locations
cgtgtctttgannnnnnnnnnnnnnnnnnnnnnnnnnnnnnnnnnnnnnnnnnnnnnnnnnnnnnnnnnnnnnnnnnnnnnnnntgtttgtgtctcgacgagatgtataaatttggttggtacaatattacaaatatatatatatatatatatatatatatatatatatatatatatatatatatatatatatatatatatatatatatatatatatatatgtgagcgatgaaatcatatg

SEQ ID NO: 57277 - DNA, 1501 bp, Oryza sativa
acttttccccctaggttttccaatccctagattggggtcaggtgacatgtactcctctgtgagcttgtttattctagagctcctcctacgatcagtgtccacaattaccacagttttaccttttttctttttgcttttcttcaaggaaggccgacaagaggacaaattctgctgaaaagggtccaggggcatatctgagacatgttgcacaggggggacacagctaatgggctcaattatttcagcattttcaaattgttgggcctccaaatcttcctatcccaacatggtctgttgagtctcactgtcttcaatcccaaccaccagcagaactgctgctagaagagcaaactgaacaatatgaataacaggcaaagagaagggcacaatctgaaggtcttgaggggggcccaaatccagagaccactgaggtgagagctgcagcaatctgaagggactctgattctgaactgacaaagtgccttcccaagtagagagagttgtgttaaaagcagacagaatcctccaaaagaacagattaataagaaaccgaggctggacaagatgttcaaaagagataattccctggttctacagcaccatgttatgagaaccagccaccactgacagagcactattctgagaaatatgctgattagcatgggcatcctcttgcatattgtccccaaagacttccacatggtgtgccagctgcgggacaggatcagggataggaatatgattcacaggaggaagatcttcatccccaggcatgatatcaggcatctccccatgacacagaaagaccgaaacagtccaagatcttccaacacccccaaaagcagcagcccttttaatcacaattcttttagggacctcaagggcagaagagtacaaagctttaaccaacaaacttcctcttatattatcatctaactggactttgactacttttccaaaaagagagactgctttgtcaataacggtcggggttttgaaatccaacgggaagtccaaaaacataacccacccttccacagtaaaaggagagtttcggcaactagaagtgagatcatggggaacaaaacatagcataaactgattatccacctcatagggaccccccgcgattagcgtatctcttagcagagcagacgcaacccgaacataaagaaactccataggatgatggttgacctctaacacatgataccccaacacattctgaacatagtttaccgccaactgttgaaaaccctcaaactggtcaggggttgggggaggctcaatgcaagccacagccataccttcattgcgccttggaggatcctcttgaagacagagatcaacgcactcaagctgatgatcccagggttcatgcagttgtatggttggagggaggaaaagagcagggtcagggttgacaaccgccatggaagcactatgtcacgaccggaaataacccaacgggcgttccttacgtgcgtgcattaatccttgt

SEQ ID NO: 57278 - DNA, 1501 bp, Oryza sativa
aggagaagagcgggagcactctccggaggttaggaacccttgtaacactcaaccataatctcacgcacaggagtagggtattacgctccatagcggcccgaacctgtataatcttggcgctcgcacacgatttagtagcattcagggcagactcgcgatctccccaagcgagccttttcccccggccgaactcataaaagggggatctcacgatctcccactagagaggatcactcctcgacatatggggtctcaaacaaaaaccgaataatatggtaactgttgacggtcgttacagacaaattttgaccgtcaatataactaaaataatgaagaattagcaatgcttacaatgcatatttgttttcaaacaatgtagattcacttgtacttggagaataacatgttgtaggaatttatcaaataaaataaagagaaagtggagaaaacctcactcctaagcaagctagaggataaggaggggccatatgtcaggtgtaaccgtccagaaaccgccttaactgtcacaaccgacaagaggacccacctgtcagtgccctacccgatgctggaggtctgttggccgacccaggttcagccgaaccctggtggcgtcagctccggctggccctccacgtggacggtccagatcactcctcaatgacggttgtgagagtaaaatggacaattcacatgactacaaccgtcatacctgccctataagacgaggagctcattcactctctcaacacactcaagcaagctaaaattcctcttcatactttagtattagtatcttactgctaagtggagtagagtagaatagtattaggagtcctcaaagtcttcggaagagtttcggtatagctctagcagctcttgtattctcttctgtaatactttcgatattaatgaaatattcttctttatatatctttcgtacattgtttagtctgagtactgttcttactttatatctgtgtcgtactgattgtgtgggtagcttaccagagaggtgcaatggtgcgggtttaatgtatgatttatcagttgctctatgtcattaatttggtgtagagtagtatttagtaatgtaagcgcggtgcttagattattaaatatcattaattgggcatatatgctgcgggacagtacaggtgggccgctgatggtgacagttcagtacaggtattcctccacgttagtatatattcctaagacaaattcctggggagggtactgctccgtatttagccccagttggacggccatgataggttgtcgtaagtaactgttaggggatattggccacacgattatatactaacagatgtaaactaggatttgagtgtatactagaagtatatgaattgagtgctttctaattcttcttccacttagaattacttcattatgaggatttgatcagctttgcttcgtgtcactttacccctaaattaaaattaacccctgcttaggctttaacaattacaagtaacat

SEQ ID NO: 57279 - DNA, 174 bp, Oryza sativa
  unsure (1)..(174): unsure at all n locations
tgaaacgtggctgatatgcnnnnnnnnnnnnnnnnnnnnnnnnnnnnnnnnnnnnnnnnnnnnntagttttccattttgaaaattgacggaagtagtcgcctaccgccctctgggagggcgatttttaaaaatcaccatcccagagggcggcgaaaatgacgtggcagacggcc

SEQ ID NO: 57280 - DNA, 1501 bp, Oryza sativa
aagtagtccacaagcgcatggatataccattgtagcatttcacccggaagtatttcaaggtatcgtatttttaaacccaagggaagataataagagtgaacttttccaatacactttatacatatgttacttgtaattgttaaagcctaagcaggggttaattttaatttaggggtaaagtgacacgaagcaaagctgatcaaatcctcataatgaagtaattctaagtggaagaagaattagaaagcactcaattcatatacttctagtatacactcaaatcctagtttacatctgttagtatataatcgtgtggccaatatcccctaacagttacttacgacaacctatcatggccgtccaactggggctaaatacggagcagtaccctccccaggaatttgtcttaggaatatatactaacgtggaggaatacctgtactgaactgtcaccatcagcggcccacctgtactgtcccgcagcatatatgcccaattaatgatatttaataatctaagcaccgcgcttacattactaaatactactctacaccaaattaatgacatagagcaactgataaatcatacattaaacccgcaccattgcacctctctggtaagctacccacacaatcagtacgacacagatataaagtaagaacagtactcagactaaacaatgtacgaaagatatataaagaagaatatttcattaatatcgaaagtattacagaagagaatacaagagctgctagagctataccgaaactcttccgaagactttgaggactcctaatactattctactctactccacttagcagtaagatactaatactaaagtatgaagaggaattttagcttgcttgagtgtgttgagagagtgaatgagctcctcgtcttatagggcaggtatgacggttgtagtcatgtgaattgtccattttactctcacaaccgtcattgaggagtgatctggaccgtccacgtggagggccagccggagctgacgccaccagggttcggctgaacctgggtcggccaacagacctccagcatcgggtagggcactgacaggtgggtcctcttgtcggttgtgacagttaaggcggtttctggacggttacacctgacatatggcccctccttatcctctagcttgcttaggagtgaggttttctccactttctctttattttatttgataaattcctacaacatgttattctccaagtacaagtgaatctacattgtttgaaaacaaatatgcattgtaagcattgctaattcttcattattttagttatattgacggtcaaaatttgtctgtaacgaccgtcaacagttaccatattattcggtttttgtttgagaccccatatgtcgaggagtgatcctctctagtgggagatcgtgagatcccccttttatgagttcggccgggggaaaaggctcgcttggggagatcgcgagtctgccctgaatgctactaaatcgtgtg

SEQ ID NO: 57281 - DNA, 1501 bp, Oryza sativa
cataagtttctgtaatattccagaacatgtactctggtttgtacttaaatgtttgtttcttatatcaactacattttatgaactactttgcattttatctaccacatgagtttatgtacagttgtagtcctgcaaaagttgccaactatcatatttgaacaaacaaaatttattccagaatcaatttccctacaaataaaaagagagataaaaatataaggactaaataaaaaaaattgtgaaaaaaataatgattctaaaaaaaatttacctgagcaaagtcaatcactagtttctttgttcctgtaccgagaacagaattgtctggatggaagaaaagacggttgacatattgaatcctaatgttttgaatgtctttttgatagaaatggtttgtcagctgaactcttggaccccatagttccatgtattttagagtaaaaactcggcaatcaaaactaggaaaaagaaaaaggacataagtaaccacagttacttatcataaaaaataaaacaaacaaaaaaaattaaaaaaagctaatgcagttatggtcatactatttactctgtaaatttactaatgaaatctattgcagttctagtccatgttgtactaagaaacaggctcttatcccatctagtaattctgaatgaaacaattgacaaacaggaactaaattttttgaatgataatcataacaaacaaactaaaattgtgcattaacaacaaaacaaacaggttatgcaacaattagaaaaacagaacagtcaagaatttctgaatgaccaacaaaacatacaagattcctgtcaacaagagaacaattgggcatctgtacaactctaacaaaaaaaaacaaataaaaaatattattggactaaaagttacagtaaagaaaaacaacttacagattattttggcgaggtactggtggatatacaattttgaaagcatcaaaattgatttgatattcttccatgatggaattccaagcaagtgcaaaattggatgtctacaaaatataaaaagaaaactctgtaattataaattccaaatcacaaattgaacagtaatacatatatttaaaaatttgaaaataaactgaccaatctattcttaacttcatcttgatattcagaaccttcttcatgtaatgagtcaagaaagacaaacatttcatcttccagatgaacaatgaaaacaaaccagtggcgcttgtagagaattggaaagaagagcttgaaaaattaaataaaacaaattataaatgtaaaaggaaatatgaaattaaatgtcacaccccaatctggtaccgtcgtacaacgacacctgacaggagcgtgtcgtaggggaaaacggcgcgaaccgcttcctacgaaaccgcggtctcggtaccagtcccaggacatggtgctggtacccacggtaacaaatatgaatcatagcaatccttaaaataaatagaggacttatttaccttaaccttggttgcagctcaga

SEQ ID NO: 57282 - DNA, 1501 bp, Oryza sativa; identical to SEQ ID NO: 20762

SEQ ID NO: 57283 - DNA, 698 bp, Oryza sativa
ctttgaacaaatttccagatagattgaaagctttctttacaatatgaaagaagcaatttccgtgctttgcattttgaaatacttgagcaattgctgatctcattgctccatcctgatcagtaatgattatttttggttctttttgtgacatagctttcaaaaaagttctgaacatccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattccaaagttttcatcatatcattgctgcttgtctccttgttaattgtggttctcacattgcttatatctttcttcgtataaggcaaagaagtcaatcctcctcttagaacagataaaattacaatcatgtgccttgttggtattgtcggagacatgggaccgggggtatcttgactagaggtttggggcagctgcagtcacccatgtggcctgaccccctcgggggggggggggggtcgggcccgagggtga

SEQ ID NO: 57284 - DNA, 1501 bp, Oryza sativa
aaatcttgaagcatccgatgcctatccaaacaaaagaacaaaactggatttatgatggaaagattgtagttcagacttcagacagtagagtccttaggagaagaaaccaagcttttgcttctcctcatctaactcagctgtatcattatcagcattcccttgcttagctacagcctcacgcggcagtggagaattccattttgttgtaactgattgctgatagagtaccccgccagccagagtgaagagcaagcaaaccaaaccaattgaactcgcatgtttatcccagatcataacattgattgcaaccgtgagaaacttgttgacaacacgcctgttactgtgaaagccgtggcagagattgttttccttgctgcgaaaccaaagaagctaatgagcagcccaaacacaggacaaggaaactgtcacaaaggcatcaagttcaaaccaactctggccccttgattcaatggctgatctgaagactgataagtgctctccagtcaaaaaccaaaatacaggagcgattaccagctagagaagattgttgtagagtacgaagccccatgtgttcagcccagtttatgagaacttaagattctgagaagtagctggtgagaagctagctggtaagaatctgtagaagctgagaaacccagcttctagcttctaatttatttttggatttcataactatagattcttataatctgagtgaaaatctggactatttggtggagcttctagcagtaatagcttctaaaaaaatcttcagctcctagaagctcctccaagcaggcccatagttactagataagcaactgcccatgggtaggctgtgaggctgaaccccgaatatgtcatcacgtaaccaacagcacctcctaaaatagtcacaaaggacaaaattgtaagcttggaaggacatggctgcttcctgaatcctgaaggcagtatcatcagcgatggcaaccaaaagcggggtcaacgatctgaacactataaaggtatccacattagcacgcttcaggagatgtgtaggtgttggtgaagatggcaaggtagaacacaagcgccgccggcgcaaacttctttgcggtctggaagttgaagggatcatggtagagtagtccaagctttgcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgcc

SEQ ID NO: 57285 - DNA, 797 bp, Oryza sativa
  unsure (1)..(797): unsure at all n locations
cgcgctggaatgaatgcgcctcannnnnnnnnnnnnnnnnnnnnnnnnnnnnnnnnnnnnntttttcaggacgacaatgttatattttctcttctacaattggatgttaattacctagaaacatttctaaaaatatcgagaactaaaatgaaaatatgtaagcagttatttcttcgcaccaagatctattgcatttttttggtcgatccaagacaaataaaaaatggggctgtctatataggaatcgaatgatttctgaagctccaatcatgcagattttatctaccataggatgcacatccaacaactcagaaaaagtgatacaaatagatattacacttaaaaacagatatattatttgattatttgaacgccatttttttaaagcccaaatctagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacacaaggaaataaagcccaaattataatccaacagcctatccaaaaaagtagtaggggccaaacttggaagccaagtagatgaaaaacatgtcacatgaatcaaccatgtatgggaccacacttttcaatcccctacttttcaacagcactattagttcacaaacagatctagcacgaatcaaaca

SEQ ID NO: 57286 - DNA, 1501 bp, Oryza sativa
tatttaacctagttaaacattgtagacagctattgaagtatttctgacagtaatgactttctcaatctcagatggttcaaattgctagagcctacctttccaattatatagctctctctctctctctctctctctctccaacatgtaggttcatttgggaatcaactaactacctcatgttaattccgtattagttttgcagtacacagagcagcacaagctcagatgatgcaccgtagcatcggtattgaaagacagtcgagcaggacgtatgtgaccaacttctacaatttcatacaaaattacaagatttttaccatattgactcttagcttatacgacagtttagtttctgtctaaactttcagatatgaaaagatcgcaaattgtattgctccatctaattgattagttataagactggttggacatgccatccaaaatagatagactggttgaatggacttgaaaattacttcaaccatgttgaatggagttgagaattacttcaaccatcttcctgtcatgagatgctcgtgcaatgctctcgatgttcattgaagaaaaatgaaaatgaacaaaacaaaagaaaatatgctccatattatgtcgcatgtcatagtatataatgcatgtcaaaacgtgagcatgcactggtcatatatccacaataaatataaaactaagatataagcagtctgtgaacatttatcaattatcagaagattattagcaactgaagaccatgcaaatatgtgggatgcgacccaatggacaaatctgaggtaaataaaaaaaaatgagtagagcatgttcaaatccaattaatgggcaatgcaagcccaagtccagactttgtaaagttaaattcaatttaagaataatttgtatcaatacaaaagttgtagaatttatagtatatttggcgatggataatctagaaaggactaacatatttggaaagagtttccaaaaaaattggcatacaattttgcaggagagaaaagggaaaattcctaattgcaaatgcacagtgaatagttacatgcataattgcataccaatataccattcaactttacaaactttacttttgtctctgaaaatgaaagattaatgtgtaaattacaagtaaattattaaggacaattctataaaagaaaacttggtggaaaagaagtaaacccaaacctttcatggatcaaagaaaaccactgcaattggtatcatgccttataatgctcagcttcgttacaggaagaacacctatatctttgtcgatacctatttgagagctcaataggaaacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaa

SEQ ID NO: 57287 - DNA, 1294 bp, Oryza sativa
ctgtgtgtataccactatacttctctcactaacatgaacttgttcagcctcagcctctgcattgtcaccttccatgcctacttgctgcacttctgcattatcaccttccatgccaacttgctccatttctgcattatcactttccatgtcaacttgttctaccccattcccatctgattcatctcccatgtcctcttccatctccaactcatagtcacttccttcatcctcatatgatagatcaactaggattggtgcatctgcatacacctcagccacccctccatccacaatacaatcattcatgtattggcacatactgtcgtcatccaatagtgcccttaactcagaattaagatctttccctgggaacaacaaatgtagcattgttccttcaccaactttgtagtggtcatgcaaatggcctactattttaggcagagataccttatcttgatctaggtaagacattgcctcacttccaccaacatagtgcttctccctaccagacaccacaaaatctctattgaagtgaaacgtaacttgaagggtgtttaagacgtccatggaacctacatgcaagttggaaaaaaatcacttccccatcgttttaaaatacctaggttttagatcccaaataaaaagagaggcaatggatgatatagtatgaccaaatcgaggttaccaactgttgttctacataaacaatgctgactacaccaaatccgagggcacagtgcgcatctaccacaacatataatttggtggagaaccctaaatcaaaatggggagaccacgataaagaaagggtggactcaccagctcgtgctgctccagttgcggtcgccccaaaccaccaccgcgctgcattccaccgctgtcgacgcgccccctagcgccacccgagccgtcgccctcttcgtcgccaagctcacagtaaacatgtctagggtttcggtcaatgaaaaaatgagcgggatggctacacgcgtgggcatttaccagtccggatctcactcagctaacgataacctagtgtcagctacctatttcccaccatcctcagctaagtcagcaatgttgaccacagtcaagttgccatgtcatcaaatactgcccataatactgccataggagtcggtctgtaccggttttaatattgagggttagggtcgttctatccgggttttcttaacattacgaattagatttttttaccattaaggaagtcaaggacttcttagccgatcgagacaaaggttatggaaagcccaaatcgacaacgacatcccag

SEQ ID NO: 57288 - DNA, 1501 bp, Oryza sativa
atttggcttcaatccaaacatacacaattattgttgagattgccaaaaaattggcaagcctaatttagatctcaaaccaaactggccccatattactgagtctgcaccaccataacgggggcataaccccaattgttgaatagctttcctctttaaactcaagcactctatatgagggatgaaaaaggataaattcgatttatgagaatatttttagatttttggtattaactataccaagtacttacggagcccctcttagcatcctagttgggttgacggtaagtggtgaatctatgatgatgttgtacctgcaatcattgaggatattagatttcactaatttgtctaattggtgttgctatttctagaaaattcattacaccctattaacgctattgtgttcatgcatatttgaaagtttttaggtccactttacttttatataagaaaagtggagcttcaagagaacttgactttaatagaactgttttgactttaatgaagttatagcttattttatgtggcatagtaagaaatgaatatattaattttttggttattctgtacagttcaatagaacaactgctagacaaatattaaccgagctgatgactaattgcaagcattgaattaggcacagttagaatgtgagttctcaatcctacagttagtagcagagcaactcagctggttgctaccattactgggatccatggattttgttattccatatatatatcatttagggattaataatgctttgtatttcaaattctaataaattttatggagtccatgtccatcccatgtgagttaagacattgttgttttatttctgtgtaatgtttaagaaatttgtaaatgacagtaaaccagacaaaattagtgtacttcatatcatgaaaaagaacgaatatgatggttttctactaacttccagttggctctaatctagttcataagacaccattcttctgttcttcacaataaaattgctattttttacttaacaattccctgttggaaacaaataaaaattaagaatcctcaagaagcgaccaggattgattgttttcttgtgcatcagtctatgggaaatggtgctgtttagtatattccatttcttgaaattaaataaatatactatttgaaataagagcaaaattttacatgcatctaaatatctaatgaaatcagaagagcagccataaaaacaaatatagctagctgtaggcaagaaacttacgtccccgtgaccccaatttcatgacaatatgtgcatctgtctagcttgagaccaaccttttgtttaagtttttctctatcctctgtgatgtttatggagttaagcatatgaccccatttttattcaggagatgtagcagaagacaatgaaattatgaaagtagatgacctgagattatgccaactgttaggaaaggctgtaccacattgatcccgaaaatgaccatctcttttgacccagggattacctgtt

SEQ ID NO: 57289 - DNA, 829 bp, Oryza sativa
gccgacgacgacgaggaggcgggggcaggtggcggcgagcttgggcgacggctagggtttctttttttgaattctttttggaattttatttttttccgtgatttagtgggtagccggcatcgacggtgtggccagtggccggcgtcgtccgcgtcggcggcgtcgtctgtggtggtggcggcggcgaaaatggtgggggcgaggacggagcgagagagccgactagccgaggacggcggccaggcggccagcggtggcgctctcgacccctggatgcgccgctccgccgccgcctctctcgatctctgatgcgccgcctctctcgatctctctctctctctctcctctctagggttagccagttagggacttgggttgggctgggaacttggggaggaattatggactatttggatgggcctttttaacttcggaaattccgacaaactttccggaatttttccgaccgattccgagttccgacggaaactggtattatcatattcgattccgtttccgaaaaaatatttccgttttcgattccgtttccgcgaaattccgaaaaaattccgaccggctgattccgtttccgaaaacaggtccggaatccggaaaaattccgaaccgttttcacccctagccactggcaatgcagcttaacgagatatgggaattaatctgggaatttcactgtaatttacgcatctctgcatgtggatttactgttatgaaagatgcttgtgattttctatactgattcgtttagttgtttctcatatacaatggatagagtgattggggagctaaagctgtgtcaccttctctccag

SEQ ID NO: 57290 - DNA, 278 bp, Oryza sativa
tattttatccagaaatatatacccaataattactttttacaaggttggcaagcttgaaatgaaaatctaaaataataataataaaaagagctgcacctaaataacagaaaaaaatcaacgcaacttgactacccgttcttggtcagctaacgatataaatctcggactgtgattgggtgtacgagtcgattgatgggatcatttccttggcttccactgataataataataataatctcccctaataaaaaccatgtttagccatcgtaatctccagc

SEQ ID NO: 57291 - DNA, 253 bp, Oryza sativa
  unsure (1)..(253): unsure at all n locations
aagtcgttagatactgggttgcaaccnnccccnnnnnnnnnnnnnnnnnnnnnnntgagtgaaatttctgatggacgaccctgacctccttctcattgttggtgggtcatcatgtaatgcaccaagaggtatgggaggctcgtcaccttcaacttggggtctgcgagattgctcatctgtttgcttcattgtcaactcatccaacttgtcccacaactcattaaatttcttctcttggctctgtgcacatagc

SEQ ID NO: 57292 - DNA, 186 bp, Oryza sativa
cattccaccatcgatcaaacatccttcctaatcacaaacatctatgctccccatgccaactccgagagacaagaagtgtttgatctgctcactgccttgaggaccacacgccttgagccctggatgcgcatcggcgatttcaacatatacagattcccacatgagaagacaatgacagcataaata

SEQ ID NO: 57293 - DNA, 842 bp, Oryza sativa
ccttataaagagaaagtatctttataatcagtctataacccaagttaataggaaacaaggggattcacaattttggtcagggctcatgaaggtcaaaaataccttcttaaatatgggttcttggattgtaaataatggaagacaaataaggttctgggaagataaatggctgggtaacttggcttttaaagacaaatatccatctttatattctattgttcgaaggaaaagttctactattgctagtgttatgagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcagg

SEQ ID NO: 57294 - DNA, 1108 bp, Oryza sativa
gagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggaca

SEQ ID NO: 57295 - DNA, 721 bp, Oryza sativa
atttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggaca

SEQ ID NO: 57296 - DNA, 1501 bp, Oryza sativa
ggatttatacccgttcacaacgatacatttaggatgtaataaatatcatcctataccgcatacatgtatttgcctcaaactataccatcataacataaatttctgttaaattttacaaacttattctaataatataaaactaatggtacgttggaaatttaaaagttaaacaaaatctaatcctaagcgtcgtcaaatatatgacctgaaggaggaggtgcagttcagtgaaattatatttgcaagctaggcttgttgttttgtgcaataggacaagaagtccatagcatacagagtgggagtttaatttttttacctttggcagccgagtagataggaagagaatggaacgcgaggacagaagcgacggacgagatattaacgatactgcctcttccggagtccttgaggagagggtagaacagctggctcaggtggaagcacgactcgaagttggtcgtcatcaacctcgacgtctcctccggcgtcaggtccgccgccggcttcaggtacgccgtcccagcgttgttcacctgcatatatatatatatccatccggccgtttcatcggttcgtgtccatatagagatattatactggattagaagataatatcacatatcatggtgcgtgctcgtgttcttctaccaggatgctgagcttgccgtcgaacatggcggacaccctgccggcgagcgcctccctgtcggcgcgcaccgccacgtcgcagacggagacggtgacggcgaggcccttggccgtccactcctcctggcatctgctcagctccgcctggttccgagcgcaggtgtgcaccgtcgcgccgaagctcgccagctcttccacgatggcgcggttacatggttaataattcatatgatatgcttcgataaatttgcaccactggaatgatgaagcgtatgagccaaacaattagtcagtttgatttggtaagttgattatacgtacccgatgcctttgctgccaccggtgacaagcgccgtggcaccggcgaggctaaacctcttgtttatagagctggcagtggccatgtatgaagtgcaggagtcctgttattgatggtagtttctgtgaatcttgtttgattattgtgtgcatcaccgtgcccattatataggcatatatggacgcccaaacctacacatgtaacacgttcaaatgactaccatctatatattttattacaagaaactaggtctcgatcttccggtaggtattgataactcttgatttgatggaaattgacaaacatgattcggctttcgatcaacatgatccgaaccctacaatcacagcactacgtctcctcttgttatcaactgtgcactgtccggttgacctcgtcgagaagtctgatccctaccgaccctccccatatctctcttgattatatttctatgagtcggctgaatagattatggaggtttcgtgcttatatgaactcctcaccgaatagacccgcactagcatgttccaatgg

SEQ ID NO: 57297 - DNA, 1425 bp, Oryza sativa
tgtaaacttgaattaaagaaataatcaatgtttattgtagcatatggtttattcaataaaggctctatatatatgctttattgacttgttattcctcaaatagctttaattgcttattgtgaaaaggagaataaaattaagaaaaaatgaataccgaatccttgaaaacagtcatgacgacaaggacatattcgatgtgagcaagaaaaaatggggtgccgaatccctggaaacagccttgacgacagggacgtacccggaataatagagaaaaatatgagaaaaaaaaggttcaaaaaattctcttggttattttgtgctaaaggttgtttgagaaagagtgataaatacaataggtatatgtgtttagtgtttattcttcaacctatgtgcttgttaagatgttgcattataaatcgtatgaaatcatgaatttttattattgtttcaaacttaattgtaaaatctttggttcatggttatactttaatgcatgcttgttatgttatagatggattcatcttctttttattgcaacatatgacttgatatgctatatgtatgctgagctcttgaacattaatgaacataattcctatgcttgatgaaatcattgtcaaatgggggagaagtaatgtgaaaattttggattttatgaaatcattgtcaaaagggggagaagtaatgtgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttggtgatgattgggtttacaggtgaatcgcaggattgttatttcatgtgaccggtcagactgggctctggtagccggtcagaccggcgtgtaatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactaaggctagagttga

SEQ ID NO: 57298 - DNA, 210 bp, Oryza sativa
actaaatgatttcaactgaaaaaatcatcaacaacaaagtggtataactcatcaggatctataacttgtattttggtcgtttcttcatccgataaagtggtttgtaacattgttcacaaaatgtacatatctcttatttagttttataacatataagagagatatgtaaattttgtgaaaatattactatcactttgtcggatgaagaaa

SEQ ID NO: 57299 - DNA, 256 bp, Oryza sativa
tcactaaataattagtaacgaacaatagttcactaaataattatttatttcactaaataattcaccaaattaactaaaatcactataaaaattactattttcatatatttcactaaataatttactaatttcatataacagaaaggcttgtttaatgctacaatagaaattcataggaatataagtacttcattcgtacaaaaagtttttttaataatacaaaatatttcatccatcacatgaaattcctaaaaga

SEQ ID NO: 57300 - DNA, 304 bp, Oryza sativa
cccggttagggcatatgtattgtgagcatgatgtgatgtgaccctgtagttctggttggagctgcctttaagttcggctgcttagtggaagctctatgatttagactccctttagttgctcttgccgtgtggacgtgtaaaattcgggcaggatgggtgttgtatgggtattttgaatttattttgggtgtgtatttatgtatctaacattctaactacgcatttatcgctgtttcacgtcatgtatgtaaccgtgcagttattagtttattgtcttcattcgtgcttagcataacgacattaa

SEQ ID NO: 57301 - DNA, 478 bp, Oryza sativa
gccaaaatctcttatatttagggacggagggagtactaaatttcacaaaatttgactaaaaatttgcgtaaaccttctactcccttcgattccactgtttccacattataagcacatatgtggatctttataatgtgttaaacagaggaagtactactgataatttgatggaggaatcacagtgccagtactaacaaaaatgtacattctgttccttaggtttatgcataaataaacacgtccctggctaaaaactatgtgaacatttgaaaatcattgcctaaaagaaatctgactattaatcgagtccactagccgagcaaacaaaggtcggtaatggaaacaccgacccctgtattcggctatttaacaccagcaatccgctatgaaaacaaaaatgagacgcatgagctcgcgaatcaacaaaaattcgatgcagcagctatggattcagatgcaaacacatcgcaatggttta

SEQ ID NO: 57302 - DNA, 1501 bp, Oryza sativa
gcggcggctggatggctgcgagtggccgccgttgtggtggccgccgcctctgccgcctcgtcggcggccggcgagggggtcggccggcagacggtcccggcgatgtacgtgttcggcgactcgctggtggacgtcggcaacaacgacttcctgccgccgccggcgccgaggccgccggagccaccctgcggcatcgacctcccgcccgaggccgccgccgccgacggcggcggcggtggccgcttcaccaacggcttcaacctcgccgacgtcatcggtaaacatcagctgaggaagcttttttttttttgcttatattctatattcgagaaagaaaaagaaaatcatttatttgagccccaaaaaatataaatcaaagatctatatatatttttaaaaagaggaataatttttttatgtgtatggatctcttattatttgattattaccgacgaaagaaagaaagaaaaatcaaattattacgcatgtgcatatatattgatttgcagcgcagcatgtggggttcaagaagagcccgccggcgtacctctccctgacgacgccgggaagagacggcgaactccggcgaggcctcgtcggcgccaactacgcctccagcggatccggcatcctcgacttcattgtaagtaatagcgttcacagaataagaacggctggaatttctgttttgcttttagcagaacaaattaattcagctagatttatgcaatttttgaagattttgaatcatataaaggatgttggccataccatactgaaatttgaaacccaatccaaaatttgatgcttagtgatgcatgacctactcccttctctctctctctcttatcttgggatgtaaacatgaagttgtattttatctgaaggattacaatcatgaacaatatatttttaaaaagtttccataattattttaatgtcatataagaaacgaggggacatcccctcgaggggaaagaaacacccctgagcgatggcctttcttcgaattccatacctgaacaattccatgatactctgtttcaaccacaatcctttggcatccccattcgattgccaatttcgctccatcacggcaggcccaaacttcagaaaaagtgcacctgcaacgaacagacaccacatcctgttcttgctgcaacgaatgaaccggagtcatctctcagcaccatccatgtgccttgaaatgcattgagttatgcacacgctgatgagttgggtaccatgcttgcatccgattgcccatttggaagcagagattgtattgcacagaacaaatcaatggataaatcacagattgttacaaagtacagcaacgaaatctaaagtcagctagtcagtctagcacaaattgaacactctgttctacctgcattacataatgaagaacagagatatggactagtggctatggactaatattgattaatttcttttactttagtaatgaaacagaggaaggcatcgaaaagctcctttt

SEQ ID NO: 57303 - DNA, 1501 bp, Oryza sativa
tatataaataagatgcccgcgcatctgcgcgggcttcctttctagatgtttattaaataagaaaagagttgggtggtccaatctaaagtgaaaacacgagttgaatggtgatcaaataaatcatgggcaataaaatgtagccaaaaacgattatttttgtttaaaaaaaagaaaaaaaaaggaaatagtcgtgcggcggtgtttccccttcctctcggcggcgacgccgactccccgtgagttcgtccgccgcctccgccgccgccgccgccgatccccatccatcccgcgagcgagtaggggcgccgtcggttgtcctgctgcttccgccgtatcctggtgagcatccatccatggctatgcacgtccactttctcagctctctctctctttctctctacccgcgtacctttttcttctcgaatttgcgttaaccctagcttctgttctagaaatttgccttaagtttgttctcaaaatgttcggggtagttcaactgaacctccatttcccatgttagatccgccactgtttcgtagtgatcaaaatgactgaaaccgatgtgcatcctcgcttcttcttttgtttcatttacatgtgagttttgatcgattttgctcagacttcaggtccaaatatttagtactgatcaatcccaattgattttgtctgcaatgtgctagatgatctcggagaagaggattgattttgtctgatcaggtgtttaattcggcaccagagtgggatctaggaactggtgggaaatggagaagccgttatagcttcgtccagggtcagtgaagatagattttgcctcttccttgtatgctgccaaggcagatatcgctgccaccgcggcagcgctctcgcatgcgcttgggccgccctgctatcagctcccactggcaaaagtaaattcatcactgccactatggcctccagtgacatgcccttcaacatttgcccagaagcgtcgtatgtcattgcctagcccacctccggccaagaagctgcaagtgcagcagtcttcatccatactgccacaagattttccaaagttagaggtattgccagttgaaaagcccacaaagttgcaggagcggcggtcaccgcaacatgtatccccagagctgaagcaaggttcaccgaagatggagaggccattgttgccaaggcctgcaacctttattgacgtgtgagttctccatttcttggaatagtgagatggaatgcttcgttgaagaaattgaaattgatagcttcatatttgcgatagtatgatgcatacctttaaagttgtataattcactgtttgcaaattgtttgcgctaatgcatatatgagtttcttggattaattgagaaaattaggagagcagataatgaatatgtttcacatggtacgtaactgagtttactttactaaaggaggtaaattgtcttcttttctgtctcttcaggatgctgagttctcaaaagccatctagcgatatgtggtctga

SEQ ID NO: 57304 - DNA, 1501 bp, Oryza sativa
  unsure (1)..(1501): unsure at all n locations
gaatcgccaggccatgtgtggtttagacggacgcaccagtgcttgtgggatcgggcggacggccggtgaacatgtcacgcgatagggcaatacagagagagcgcacgaattagattttgtccttccattgctggcggcgtggtgcgctactgagccgcatgatacagaaggcaagatgcaggattggaatgcccccggattgcttcaacggcagagatgaagtgaactacatacacgtctacaacgtttaagccaatgtcagaggaatacatttccatagtcacattttcacagattgcgtggttaggtctgtggagtgattctacataaaggtcgggcaatcccatattattttcagaataatacttagaaaataccatatctaattaaacttctttctggtagtgttactcgcaagaatgcaattcaaccgaacaggttttatgcaggtctttttgctagttagatggcatatttggaagcatatgaaagatttaattttccaggggatgtgccacaaaaaaatggttccagagatttaaaaagaaggccgttctcttacatactgatggaatgaaccaatgaagaacaatttacaaaacactgtggacaattagttacatctttccttgaaccttgcgtcctgtgcaatgtaaatatccctgttcgttagtccaacaaaagttggatggagataaagattttcatggcacgtatttcaaaccgctaaacggtgtgtttcatgcgaaacctttttatatgaaagttgttctaaaatatcagattaatacattttccaagtttataataattaaaactcaattaatcacacgttattaccacctcgttttgcgtaaaaaacttcatcttcatcttcaggagattcaaacaccacatgtaactttagttttatataataaaataaaagaattatgcccagcccaacaatattttatctttaaaatagaccaaccatataaatcagtttttgtcctacgacctttatgttctatgagtgagatatcgttttgaaaaggatggtgctctacataccacatgagagagcacggtaacaacacaacataatcgctcttgcgtcacaaggatgaggcatagccgcatagggagcaaggagtgcggccgcatagccacatagtcggtcattgtcggtgaggcctcgagggcgtcagtcatggagaagtggcctaggtggttnnnnnnnnnnnnnnnnnnnnnnnnggccgatgtcaaggcggtggtggcatccctccaccggacaaagattcactctatgtttttaatttttgacgacaagttttgaacatataatattcatcttacaccgagatgttaaattttcccaatgaagaaaaaattattaatgaattgtaaactcgaaactaaacaatatttttttaatctaccatgtttttcttgtattattcgattcacatgtagaaattagtcttctcggcgagataaatgataaccaaaggggaca

SEQ ID NO: 57305 - DNA, 1501 bp, Oryza sativa
aagaaattccaaaccaaatataagccagaaaacaacatgaccaaagatcgttgtcgatatagtcgctgtacacttcccaatcatttaataaaatctctgctcaactttcaacgaagtcaatattttcccaaattatcggcgtcactaaggtagtgtttgaatcttctgaaaaagattaagtgtttcacgcaaaacgaggtggtaataacgtgtgattaattaagttttaattattataaacttaaaaaatgaattaatctgatattttagaacaactttcatatagaatgttttcgcaagaaacgtaccgtttagcagtttgaaaaacgtgctacgagtatccaaaagtttatccaacttttgttggagaaaaaaacaacgcaggtggtgtttgaatcttctaaagatgaagatgaagataaagattaagtgtttcacacaaaaccaaggtggtaataatgtgtaattaattgagttttaattattacaaacttgaaaaataatctgatattttaaaacaacttttatatagaaagttttcacacgaaacgcaccgtttagtagtttaaaatatcacgaatatccaaaaatttatccactctttgtagtggaaacgaacgggacccacacactccatcggtctaccccacatcctcctgcaccacaacaagaaaaacaacgcaaatcgcaaatcaattcttgattttgatttgctctcggctctctcgttcgtgtgcacatcaaaatctatactcctttaaaaatatggtggtggcactaccacctcaacattcttttacacttttttataaattagcccttaaaattttattactacctccgtcacattttaaatgcagttgagggtttatgtgttcaatatttgaccatccgtcttatttgaaaaatttataaaaaaactaaaaaattagtcacacataaaatactattaatattttatcatttaataacaacaaaaatactaatcataagaaaatttcaaataagacggacggttaaacgttggatatgaaaatatgtaaaactgcagtctttttttgaacggatgtagtaatattatagaatattttaatatttcttttaaacaagtgaataccatatactccgtattcaaataacatatttgaaaaatagaagtgaagaagaaaaaaagaatcttcgaaggccactgacgaagtgacaagaagaggcggggacaggaaggaaacgccatgtgggccccacatgcaggtaggtacaaaccgccatgtgggccccacctcgccgcctccgctccactctcctcgccgtcgccggtcctcgtctcctcctctatctatataaaaaaaaaaaaccttctagaagaagcttcccgcctcaaccctcaagccgcgcggatcgatcgcttctagaagcttccgcctccgccgccgcgggccatggacgcgcgaggaggccaccaccgcgacgacgaaggcgatgaggaggcggccggccggcg

SEQ ID NO: 57306 - DNA, 212 bp, Oryza sativa
  unsure (1)..(212): unsure at all n locations
aaagacggggccaagtttacangcaggtatnnnnnnnnnnnnnnnnnnnnnnnnnnnnnnnnnnnnnnnnnnnnnnnnnnnactggtgtccatctctcattttcttgtgtccagaaaaatgtttcatgtagtagtggtggggagcgtctcgccggcagcatcgtgcacgcaggcggccacgtcgtcgaagtagacggtctccttgctgtcca

SEQ ID NO: 57307 - DNA, 569 bp, Oryza sativa
  unsure (1)..(569): unsure at all n locations
acgcgttgacccgtcctcacnnnnnnnnnnnnnnnnnnnnnnnnnnnnnnnnnnnnnatatagaaattaaattaaatcagcataaattacgtcattaactaaaaatgattataaaataaacaactcacaacattataaatgtataagaaaacctatgcttcaaataaaatgttctcttaacttacttatccgatctttgatccgattataccattgtgttcataacaattaaatctttataacgtgatctcacatgtttattttaataaaaaaatataaattagttttagatttcattaagttgaatcttagacatataaaaataaattcaataaaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccataacaagttactttacttttactttttgttttaagttacttctataatatgggtaaattactt

SEQ ID NO: 57308 - DNA, 1501 bp, Oryza sativa
attcattatatttttccgtcatcgataggaagaatgctactgtgcagatgaaaagctgaagaaaactaaaatgagactaccttgacatcctcgaacagcagcccaagtaatgcgcttaactgtgtatgtaagacaccatcaccaacaccccataaagcacctataaacagtggaactgccgcaccaagcaatccacccattggactgtaggcagtagaaagatgagctcattgtgataccaatggcaagcataactgcagaagaatggtacaacagcacaatgatgattcatgaagccaaacctgtaaaaaagaagtaaccagaacaggactacagcatgaagaatagctccaaccgaaacgatagatgtagctgaatgaagcccagaggtcaaacgtccagcaaccaatgcacactgcagtgtcagacaaccatcaaaagtcagctaaaacataaattatggcattttcaatagtttagcatgatatagattagttatagatagctgggaaacaagatatgccatactttcacaaagcaatagcaacagtaggaccctagggaaacgataatctagagttcagactgaaatgccaccaggatagtgctaacaactttagtgatttaaacttacaacagcatcggctgcaccatatattgccatggctccgccaactccagagacgccaagaacaggtgttacaatatttttagtgaatacagccctaaaaattacacagcattatctcacagaaaaaatattaataaatcaaacagcaaaaaaatgtccaaaagcaatttgtgctactaagtgcttaccatacaaatgccgcttgtaatcctgaatatactataagagggatgataagaatcatccttcggtccttgagaggggcaacaatatacttcatcatggccccaaatgaggaatgtgttggagcagtatttcctttctcatcccttttggaaagtaaacacattaatacaatgccgacaatcatgcagccaagaaacacaacaaacagcagatttttccccgtgacacttcatcctggagtaacaaggaatcacatggacaagcatgattgttattaagaacataaaaggtttcaaaatttatcaaaagtcatacagaccttaactagtatattgatcaacagcttgaacaaatacttttgagggtttagacttctgagtattgctaacctcaggagtcaggacattttataatagttaagtccatgggaaattagagtaggactgctaatattttagatatttattttaaaatgtacatctaaatgataaacattaagatttattttcggtagtgctcattgtgattcttctatagttgtcttgtagtgtgctgcaatatttttgtttgcgatcattattttgttacaactaatatactgatgcattttgagacaattttggcataatgtaaacctagcagaattttgaattgggtatagaggtataacagaagtttccagga

SEQ ID NO: 57309 - DNA, 205 bp, Oryza sativa
cacatattgcgactaatttgtgagacaactcttttaagcctgattgttccatgatttgacaatgtgttgctacagtaaacatgtgctaatgacgaattaattaggcttaataaattcgtctcgcggtttactgaagcaaacaccctatgaacaactttacaccttgcatctaaataccctctaaattcaattctatttttttaaa

SEQ ID NO: 57310 - DNA, 1501 bp, Oryza sativa
gatggtttagtttttttgttggagaggcagatggtttaattagtagttccatgatttgatcagatgcgtcacctgacaaagaagatcccccaaattgtatgatactgcttgagctgcaaatggatgcgattaactatttagctccaacggcagcattggattaggatatgaaccaacggccaagccactgtcactgccatccttgaaaaaaaatccaagagcataacaacactggggttgcaggcagcttagcatgtgtttgatttggggatgaggtaagatgggttggactcatccttgtttttaggataggatcattttagagtctcaagatcattctcgttattctaaaaagttctctctctaattggattgaaaatgtgttctagcaaattgctagttttaaagtatttttcagctgtagcacgtttttacgatatcccctagcaaattacacaaactttgagtgccatgtagtaaaatttgtctaaatttttagtctttgaatcttagtctacactatacctaagccaataatccaaaatcatgcatactcataatattgtttgaatctcctgaaaataaagatgaatataaagattaagtgtttcacataaaacgagatggtaataacgtgtgattaattaagttttaattatttcaaacttgaaaaaggattaatctgatattttagaacaactttcatatagaaagttttcgcacgaaacacaccgtttagcagtttgaaaagcgtgcaaccttaatctaaaatttaatccacccttttcatgactaacgaacgggactgcttcattttacttgtttgggagagttccctaactcccattaccaaacacagcataagagaatacaatcggcaagataggaaaaacgatttactctcatttaaattacttgtctttctaactttaccttgaatcaaacatctctactttctaccatcgttttttaaaaatttgtgtaaacgaagccgaacttcatccaccaattatgccaagcgattgggatcctcttcagtcactgcccactacaccgtgcctttgtcattgatatgtggacctgatgtgtcgtcgggctcatttattagtgacaaaggcatggtgcagtcgactgatctctatcctgataccaagtggtccttgttagttgaaaaattggaagtaactagaaaaaaaaatcttccaaggccagtaggccactgacaaaatgacaagaggcggggacaggaaggaaacgccaaagcagttacctgcaggtggggacaaaccccgcggcttcgagccactgccatgtgggccccacctccgcctccgcgcctcgtcgcctccgctcccctcccatcccctcgctacctcactctacccgctctataaaaggccttctagaaggagcttcccgcctcaagccgcgcggatcgatcgcttctagaagcttccgcctccgccgcgggccatggacgcgcgaggaggccaccaccgcg

SEQ ID NO: 57311 - DNA, 606 bp, Oryza sativa
  unsure (1)..(606): unsure at all n locations
cgcgcgcttgtagatcatacaacnnnnnnnnnnnnnnnnnnnnnnnnnnnnnnnnnnnnnnnnnnnnnnnnnnnnnnnnnnnnnnttcatgcctcttatattccagcacagcacattccaagatttaaaaacattacgcatctcgcgtgacgaacagcatccgcccacccagcgacgaacaactccttccaagcgtatgatgcccgtggttgttgatgggattccacggcgactactccttcgcgccaccaccgccccagcgcacgcgacgccggcgctccctcctcttcagcggcggccgccccttcccggggtgcccccacatgcgcgccttctcgacggcggaggcgcgagaggagatcgaggccgccatggacagcaaggagaccgtctacttcgacgacgtggccgcctgcgtgcacgatgctgccggcgagacgctcccgaccactactacatgaaacatttttctggacacaagaaaatgagagatggacaccagtccgtcccccgcacaaggaaatatattttcgtgtgcaggaaaataatccaccccacacgctaccatccttatcctcctccccatcctcccatcatgggcgcgcg

SEQ ID NO: 57312 - DNA, 1501 bp, Oryza sativa; identical to SEQ ID NO: 49000

SEQ ID NO: 57313 - DNA, 1501 bp, Oryza sativa
tagccgctggtgccgacgacgagcgcgcgcttggagccgagccacgtgaccacgggcgacgcggccaccgagaagagcgtgaaggaggtgtacagaatccccatggacaccgtgcccaggtcgccctcctgcggccagcatcatccacggatcaggaaaggcggcgatcgagatcagctcgaccgatcgacgacgaggaggacgaggacgaggaccgaggagggacgagatggcacactcacggtgttgaccgagctctcgaggttctgcgcggcgcagtaggcggagaagacgaagaggaacgcggcggagaggacgtgcaggtcgccggcgtggctacggcggtggcccgagtaacccaacggcgcggcgccggcgaggagcggcgccgcggccgcctcctcctcctcgtcgcggtggtggcctcctcgcgcgtccatggcccgcggcggaggcggaagcttctagaagcgatcgatccgcgcggcttgaggcgggaagctccttctagaaggccttttatagagcgggtagagtgaggtagcgaggggatgggaggggagcggaggcgacgaggcgcggaggcggaggtggggcccacatggcagtggctcgaagccgcggggtttgtccccacctgcaggtaactgctttggcgtttccttcctgtccccgcctcttgtcattttgtcagtggcctactggccttggaagatttttttttctagttacttccaatttttcaactaacaaggaccacttggtatcaggatagagatcagtcgactgcaccatgcctttgtcactaataaatgagcccgacgacacatcaggtccacatatcaatgacaaaggcacggtgtagtgggcagtgactgaagaggatcccaatcgcttggcataattggtggatgaagttcggcttcgtttacacaaatttttaaaaaacgatggtagaaagtagagatgtttgattcaaggtaaagttagaaagacaagtaatttaaatgagagtaaatcgtttttcctatcttgccgattgtattctcttatgctgtgtttggtaatgggagttagggaactctcccaaacaagtaaaatgaagcagtcccgttcgttagtcatgaaaagggtggattaaattttagattaaggttgcacgcttttcaaactgctaaacggtgtgtttcgtgcgaaaactttctatatgaaagttgttctaaaatatcagattaatcctttttcaagtttgaaataattaaaacttaattaatcacacgttattaccatctcgttttatgtgaaacacttaatctttatattcatctttattttcaggagattcaaacaatattatgagtatgcatgattttggattattggcttaggtatagtgtagactaagattcaaagactaaaaatttagacaaattttactacatggcactcaaagtttgtgtaatttgctaggggatatcgtaaaaacgtgctacagctgaaa

SEQ ID NO: 57314 - DNA, 158 bp, Oryza sativa
  unsure (1)..(158): unsure at all n locations
cgatgtgnctnattgattgacttgcagcctcnnnnnnnnnnnnnnnnnnnnnnnnnnnnnnnnnnnnnnnnnnnnggtaacttgcgcgtgctgtgtgttgatcttaccgtccctcaatgtccgcctcgtcgtcatgaggatgtctgcatcgccatagt

SEQ ID NO: 57315 - DNA, 1501 bp, Oryza sativa
cacggtcaccggtcttcaacgcggagctctttggcatgatgatggagagcgacaccaccaccaacgatgccatccaaatcggtgacatggcggcgccggtgttcaaggcgttgctccacttcgtgtacaccgactcgttgccggagacgatggaggagagggaggacaccatgtgcgagcatctgctcgtcgcggcggatcggtacaacctggagaggctgaagctgatctgcgaggaaagattgtgcaagtacattggcataggcacggtgatggacatcctcgcgctggctgatcaacaccactgcaaggggctgaagaaggcgtgcttcgattttctcaggtcgccggcgaacctgagtgccgtcaccggcagcgaaagcttcgagcatctgagcaggagcttcccctctcttatgaaggagcttgttgacattctaggaacttcacataattatgcttggtgagttgtggcaatatatcctagcttatttaggaagaaactccaaatcgggtgcctgattgtttcttaaaaaatcggatggtcaaatattttagttgaccactagtgaaacattgagttatacatggctagacaaataatttagtcgaaacattttctccctccgtttcataatgtaagtctttctagcattgctcacattcatatagatgttaatgaatctagacatgaagtaatatttttttgtgaaacacagtggagacacgttgaaacatatcgttatcgtgtatgaaacattgagtgttaaagaattgaaagatatttgtttcataaaaaatataatcttgtgatatcttattgtagagatttaattacaacgaatacaacagtgtgatcgaatagataagtagtttaaaagaaaaatcgttttgaaggttgctaaatgcatacatgcatggatagatggagaggagacagggtaggtgtagttagttgcgtgaattttacgaaacataatgaagacacttagacacatgctgaaacatgtctttatcacgtatgaaacatatgatattttgttgtaaagatttaattacaacgaatacaacggtgcgaccaaataattagtttaggaaaaaaatattaaaatagaggagggaaggataataaactagctagctatagcttcatgagcctgatttttgttggctgaatcggtctaccaatcctatgcatgtattctcccttaggttatgaacttctgtcgctagttttacgtgacagtggcaatggggccaatgaaagaattgactgtcaatagtcttttcagggaaaaaaacagaatccaacatattgacattttctactcagcaaattatttttgttcaagatttttttttagataatggtattttcttacctggcctctacatcaaaccgaatatatgcggccatttaaattgggaacttagccccacaaacaatccaatctgaaattcgcttctatggagatttcaactcaaaaccttggggtactac

SEQ ID NO: 57316 - DNA, 909 bp, Oryza sativa
  unsure (1)..(909): unsure at all n locations
aggtaatacgagtttgggattcctagctcagacagaaagttagctattagtttggnaagtggaatgttatttcaggactttatgacggcctgccctaggtttaaacaagggtgtcacacttctgtctcacacggagaaaatgatggactaccatacgctcttgtttccatactggtgagtcgagatatcggtcgacggaatttatcttctatctacggagtatataccatacgataaaaatttattaaaatttattaagctttctaggaacacttattagctatggtgtggtgctctaagagcatgtacaatagcatgctataaaccagctataaacatatattttaaaaagataaaaaaagagagagaagagcagtgggttacagatatatagccagctgcagcgcggactccaagacgtaatatatgtataacaggtgggaccatatattaatagtatagtgtaatgccccgattttcgtcgggattaaaaatcatttaataatgcattttctagaaattaaataaaagttaaatcaatttaatcaagtgaaattatagaggaaattaaaattttcctttaaaaatcatggccgagaatattttgtaatattctttgtgccctaatgaactttctgaaatttcccgcgaattttcgaagctcaatatctaattttactattacaaatatcatttaaccaattaaataaaaagaaaatcaaataatctcccctttctccttgggccattttcggccctagatcttttccccctccttagcctgctcgcccctctctccttccctcctccctctcgggccgaccccacccttctcggcgcgatcgacttcccctcgcacaaagtctgaataaccccctcggtctcctccttctctccctccccgacagg

SEQ ID NO: 57317 - DNA, 1501 bp, Oryza sativa
ggaagaagccttggctttagttctgttgatttcttcatcgatgcctcatctgttgctgttccttctcttttaaaggcatgcaccctgtttgcctggaccaaagcccagtgcctgaagcccggcccataggacgtgacagtaacttagttcagtgacaaacatatcatgtttctaagattctttatgcagtagtcatcaaaatttctctctgttttgttaattcattgtatatatctgcgagactacaactctgccatttgatcagcaataactttactgtagccattagccaacagatagttatgtcagttgaacctccacatagactgcacgttgcttggtttttaccttctttgaactgatttatcttctccgaaaataaaattgagaaaaacatttctattcatagataagaacgaaaagaaaatggtattttagtgaacacctaaactggcattccagtgaatcagtttgaagcgatgggattccagcgaaaccactcttttgcgatggtataatcccaaatttctcgctttacatgtggctgacagtaagtttattcgtctcctgactttcgtgctgtgccaggccaacccaccgtgccaaggcagcggcccaagcatggtccaactatcaggcccggctggcacgggccagaccatgccgtgcctgggccgtgccaaagcgccatgccatgggctgggccgtcggcccgcagtccatatggcctcttcatcggtctcaattaaaacatggacttaaaaggggagtttttgccctccaacctctctattagtctccaactctccattaaacctacaataagataaaccgggatcgattttgctatatctcactcgaaagattttttctttatctctcactcgattttctcactcaaatttacagtgcattttcttgtaagttacagtgtaatttatgaaacttacacggtaacttttgtaagttacactgtaatttttgaatcttcgcatgtaaattttaaattttgtattggatttggtctttttattaaggatatggtaatttagtgtccattatgatgtttcttaattgctttttgctttttattatatctatcagattttaatccaaagattaaaaatctgtgtgatacgatcataaaaatctttcgaaagatgtataggtattgggatagaaaacttgtaaatacaaaagcttaactcgtatttctctcatattccatcgcaaacatatcagggcacagtaaaaataacatgagaccatgattcagagcccgacaaggcgacaacgcaaattccgagattttaaaaacacagcagcggataaagacgttattatataccgcgtacctgcattggcatcaagaaccatggatgtcgtcgtcgtcgcgtttccttctccttccggcttcctcggttcctcctcctccgcagctaatcttccccaccccacgctaaactttgcaaatcagcagcagcagcagcaacaagcgacg

SEQ ID NO: 57318 - DNA, 333 bp, Oryza sativa
gcactttgcaccccctttaaccgtaggcattttaatttttactatactccctttttcatataattttcttatatatgttacccattgtaggatcgagatgtcgactagagggggggggggggggtgaataggcgatttaaaactaaataacacctaatcaaatctaacctaagttgctaggcttggtgagggtgaactctaactaagcaactaagttatgttttgcaaacctagggtaatagtggctcaaatatatctctaggaaagtaaatcacgctcctatgtcgatgttttgcaatcctagggtgatatgatctcaagtgtgtctctaga

SEQ ID NO: 57319 - DNA, 1501 bp, Oryza sativa
aatatcccatcccccacaagttaagaatttggagtctagccaagtgcaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttttagcagtgagaggagttctggcgctcccgggaaagagaagtctcacaaacatattaaattatggttcaagttaagttctctctctcacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcaaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattaggatcagcatgttcgaggaatagtgatgacttgccttgctcagtctagtccttattcttgatataattcttgatcaaccttcacctcctggaagttgctgacgttgcctcacgactaaccgatacataaattctataatacgcaagaaaaaccaatattcaaataacaaccaaatatgcacaacaaaatatactattcatgtctgctaatggattccaatctcgctaggggctaaggtttcttaatctttctattgtcaacgtggcctattcaggagctagccaatgtagtataaatgagatacgtatctggctaatatgtggtgtagtctagctaatggctatggaaggattatggctacacatgcatctatctaaataaaatggtcgtatactagaggttctgttgtcggatggatttaggatcaatcaaataatgaatcatttgtattattatttaattgatggaggctttactttaattatgaacatatttcacttgtcgcaataaattataaaaggttaataattatcca

SEQ ID NO: 57320 - DNA, 1501 bp, Oryza sativa
cagctcctgctcagatgctcgaagccatcggcagcgatgactgcactgagatttgcctgtgaaccgagaaaatgaaagcatgccttcttcagaccggcacagtggtgctgatcggccagtgccaggatgttccccaccgtgcctacagcaatgtatctgcacaacctttcctcgcagatcagcttgagcctctgcagattgtaccgatctgccgcgacgagtagatgctggcacatgacatttattaagaagaaataatatgccactgaaaagaaaaaacggatttatatcgattttggacggcttagactactcttgacataaagtgaccaagattgaatggcttagattgatcttaatcgaagagcacgagaacagcggttgctggcgaaccacagcatgatgatgcaaatggagagcaccatgaggtagagaaggcgacggctattcttaccaacacttacgcgacgacggaccgcgaaggagatggccagcgatgagctccgaagggcgacgtggtactggtcaacgatggcgacggtgttccggcgatctttggcgaagaagaggtggtggacggtgttctcctcgcagctgcgaatccagtggagacgacggacgacgacgaacggcgcggctggaggcacggcggcgacggcggtgctccacttcacgtcgacgggcaacctccggtgggatttggcgcaaaacaaccagaggccggggtagagctcgactttgtgtagccgagggaggtgtcggcgctgaccggcgacggccgaggcgacggcgcacggcggctggagcggcggccggaggtggagagagagggagctcgcgggcaggggcggctagggctcggcgaaggacgggacttgaggggataggcagaggacgactagcgggtcctttatataggcacgcgagctcgggtccgggcccaaatcgacgggaaaaactccgggaaagtttaggatcctcgcccgggaaaaggaaagattgatccgcgaaattagaaaggatttccatagaaacttttggggatttattggggaaaaggaagaggagattgagaggattccattcccgcaactaatttggaaagaggagcaacgaggagaccggattttggaaggagatcggcggctgcacagcacacgcacgggagagagaggcggcgggaggttgaagaaggtactgtagcgacagggaggcaaaacagacttttgtctggctgaaaagcaaagaagtggaggaataagaaatagacttcccggaaagggactacctatacatttgacgacaaatttttccccaaaaatttgacaaatgtaattatagtacaatcatagtgtaattacactataacttatatgtaattacactgtaacttgtatgtaactacagtgtaacttatatgtaagtttcacataattttgaatcgttgatctattacacgatttgttttggtgaggaagaaaacaaatcatagcacacacat

SEQ ID NO: 57321 - DNA, 1501 bp, Oryza sativa
cacggtctggaggtagaagacgataggaaaagaacgagagagagaaagagagcagccgagccactgacaagccgggccactccccatttttctctaacaaaaataattcggtagaaaagataataagacccctgaccccacccgtcagtgactctgagctgtagataggtttcggattaaaataaatcggatgtgaacagtactgtttcgcaattattcgaatttgaatccttacactagcataacttattcattttaactccgatttgaatgaaacttgatcctaaattcatctaaattcataagctttccaatggtatataattcattatttaagaaaatatattattaattactaaataattaatatcaagatgatgcatagtagtcaacttaaaaatgtgctaataaatatatttgataatgtacaatagagtagatgtaataatataggcctttaacatgctttgtcactgtagcaaccacacaaactaattttaaataatgtctcaaactaatgtattggaagatactagcactatttaatggttgtattattaaacccatgacttatagattatttaaataataaagttagccttataattaggtaaatcaaacatgaatacacatagatgagtctttaatttatttatgaggaataggaacagagttggtatgatagaaccacccaaataaggttgagtcggttaacatccaataattacccaaacagtaaaatcacttgtcaacccacttagatcacatatactgtacaatccatttaaaatcatacataggaacaataacccatcttttgacaaacatgtatattagataaatactagttatatattttgacctcatataattatagttcaactgtaaattaggattgttcattaagggataatatgtaaccacaatatgattaacctaaacaactctaacatagaaagcatggataattattaaccttttataatttattgcgacaagtgaaatatgttcataattaaagtaaagcctccatcaattaaataataatacaaatgattcattatttgattgatcctaaatccatccgacaacagaacctctagtatacgaccattttatttagatagatgcatgtgtagccataatccttccatagccattagctagactacaccacatattagccagatacgtatctcatttatactacattggctagctcctgaataggccacgttgacaatagaaagattaagaaaccttagcccctagcgagattggaatccattagcagacatgaatagtatattttgttgtgcatatttggttgttatttgaatattggtttttcttgcgtattatagaatttatgtatcggttagtcgtgaggcaacgtcagcaacttccaggaggtgaaggttgatcaagaattatatcaagaataaggactagactgagcaaggcaagtcatcactattcctcgaacatgctgatcctaatt

SEQ ID NO: 57322 - DNA, 1501 bp, Oryza sativa
ccaccaaaggtactgacctgcccgaggtcagcgatggaggaaggctgcagttcatcatcgtcatcattatcaccggcaaactcgtcgaataaacggaacccgtgctgcgcgtacacgttcttgtcggtgacaatctcgtcgagatgaagaaacagggagatgtactcgccgcactcctccgtgttgccgttggggtagtaatggatgcgccattggtggccgccaatggtgaacgcgcgggacttgagggcactgccggtggggaagatgtccctggtacgcgagtagtcgttgatcttgaagaggtggtacccgctggccgtgtcggcgacaatggcggaggcggaggacgtcggcggcggcgcgatcggcggcttaccgccggcggcgccggcggtggtagagcgcgtgtgagacatggcgcattgacccatggacggcaaggtgggctcgtcgtctattgcttgctttgctgcttgacgctatagctgctggattcgcgtatatggttaagcgctggagataagaaaggaactaatgttgcaaattaaggtggaaggagacgcaacgagagagacgagacgacggattcacgacagcaaaagtttttcgatatccactgtccagtgtgtccacgcatcgtatcacaactctcaggtttcccccttttgtttatttaaaaaactcctctcagctttccgggttttttctttttttttgttaaacaactcctctcacgttgatcggtaactctagttccttttcatactacaaaagagctttctatgatttgtgaatgcggttttaccactatacgtaaacaatgtgggaatgttgattttcaaaggcagttcagctgtaaaagtccaatttttacatgccgtccacctaaggaaccgttagggaaaaatcaatttttatgtgcggtccggcctaaagccgtccgtctgcacaaattacttttgagggatgggtggcttattctggaaatgattttagcaagaaaatagttccatcgcaattaccaattgctaaaaaatataattcaacaactttaattcaattcaaacacacaacagtttggatcccgttacacaaattcaattcaataatttggatctagttcaacaatttttggttcatacgtatataaaatcagatcgcaaactcacatatacaatcgtggtggaaaaaagggaagatctatgcacccaagcccaccgtcgtcacggcatcaactgctactggagctctcgaggcctgctgccaccggatccatcgctcgcagtgcccgtggccaccagatctgacctcctaggcctcgctacatcccaaccttgcctttcttgatgtctcttcttcactgctattcaacccgtcaacaaagttggatctgcctgacggttgaacaggtggaagaaccccgccatgcgaccctggtccattcgccgctgttcgtcctcatccgcacccatcaccatcgtctctctccccacctgct

SEQ ID NO: 57323 - DNA, 1501 bp, Oryza sativa
aaccatcacgaagagtgaaacgagagctttaattcctgtagctcgctcaaaagaccaaccttgccatcagccaccagtccacaagctgagcaccactctctgccggaagctgaaacggggcagtgatccaccccttgagcattctccacagtcacacgctcgattggtggcaattttcctggatcccctggcacaaggagcaactagaatggtgaggccaaccacgcttctgcaaattatccgccgtgatacatcttccctttgtcgccgaccacatgaaaaacttcactagagaaggcgccctcgtctgccagatcagctcgccacacaaagaatgcgtgcgcgccaggaagaacaggttgtaggctgaggatagtgagaaacttccactattcatgatctaagtcacatgttcgctgaacaatgcacactgatattgtccattgtttatatgttgccagatttagcttccaggggcaacaacagcagttaggagtactaactttgcgtaaatttcaagttttgatgcatatggagtatatgcaacaagaatttcaggacttgttgaaatgcaatgagctatcaaaaatttatctgacgactagcaaaaatatttcttgaattaacatgaacaatagtaaagaacttttgtaaggaaacaggggagggataacccttagcatcgtgtattcatagccaacataagataggtgacggttacataattaataagcatccaaaagtttctgaaccctcatacagcagggagaaaaaaaataatgctcagcttaagctccctcagaactagttagcatgaatgcatgacaagttgataacaataaccagtttatcatgtttcagaaaagaagctagccaggatcctgacaaaattggcacacttaaaggtagccaactgaacttaaaagcatagctagtagtccaacaaacataaactgcagcagctaacagggcacctgaagaatatgatacatcatattcagacacaagtgacgggccctgccagcctgttttcttcaaattaactccagtcaagtcactattcttgatcaaaagcagtaaaacattgaagttttggttttcatagtatacctgataacaaaagcatatatacacagggagtacagcaccatgcctgcgtgctaaaagaagataacatatctacctgatgagaaaggttcagaacttcagattgagaaaccaacaactatcattgctagagcacaagaatattaaccatgattcggtggaagtgccatcacaacaaatagttctttcataagagaggggtagctcctgctcagatgctccaagccatcgccggtgacaacagcactcaggttctccagtgagccaagaaaactaaaacacgccttcttcagcccgtcgcagtgatgctgatcagcaagcaccaggatgttcaacaccgtgctgacgccaatgtagttgcacaacctgtcctcgcagatcagcttgagcctct

SEQ ID NO: 57324 - DNA, 947 bp, Oryza sativa
  unsure (1)..(947): unsure at all n locations
gggattcgtgagnnnnnnnnnnnnnnnnnnnnnnnnnnnnnnnnnnnnnnnatcgtttaaaactttatatatacattatttgtatgagaatacacttatataatactacctccgtttcaagttataagactttctagcattgcccacattcatatagttgttaatgaatttaagcacacatatatatctagattcattaacatatatatgaatatgggcaatgctagaaagtcttataatatgaacagaggacgtatctttttaataaagatttacttgaaatgaatatggtggtgtaatcaaattattgattggataaacagttcatccgaaaaattatttaaattttgtaaatggaggacatgcacgcatccacatgtataaatagagcttgagctaaaagatgtaaatgtgagagggatagatgatgcatacatagagcttcagctaaaagaaaatgtgagaggtatatattcgtaagtaacaaagagagagcaaatgaaaagcccaaatgcagtggatgatccacagtttgtctgatgatatgcctcgtgtcagatgtccgggacatagtagtacccctcacttcccatggtcttttcatgttttccttcaggatcaggattaccccaaacaaaacagccttgccagttgccagtcgtcaaccgaacacctgagaccacattgcacaccatatataactgtaagtttcttatagtctttaacctcgaaaacccggccaactagctagtacaacgaagaaaacacttctgctatcgaaaagcaaaaattatcttaactactatgcggtgaacataataaagaaagcctctaaatcaagtatcctaatggctctgaagatagctaaagaaaatcacaaaatcaaatatcataactaggacgatctatgcaggcgctgaaccctctcctccactgccgtctccagg

SEQ ID NO: 57325 - DNA, 169 bp, Oryza sativa
attcctctggtgggcaatcatcaagtgactagactccatcggctgtgggaagtcatcacatcggctgtgactagttgctcctgctatcccagtaagtcttcctttgtcttaccaattagatcggctatattcacccagctcttactctttccgaaaccgtctctacagg

SEQ ID NO: 57326 - DNA, 1501 bp, Oryza sativa
aagccaacttaaacaatgtaaatgctatatatattgattaaatttgcatataatagaccaaagctagacctatttttttacttgatgcttggcattttacagtccattgcagggtatttatcgtcaatactttttactccatccgcatcacagccggcggtactctattcatatcaatagagatagtgacaactgacaaacatgctcctctagctgaacaagtagtaattttgcacaactaacattagttagaactgttccattaaaaaaacaatagttaagggcagtctcaactctctatctaggatggtgtctatggcattaactacattgtcatgtaggacttttagcttatgtgacactatattaattaagagagagagtgaatagatgaagaaattgggtctcatgcaagacacagcttcaacacgagaacctatgcactagacactatcaagttttgcattgggagagaatagtggctttataatagatgaagaataaatataattggtagagaaaagagatgatgtatttattaatggcccactttaagaaatcatgggttgtagagtgtagtttctattgtgatatcttattgacatgacactatagacactgtttatggacactatggattgggactgccctaaaagttatgtcaaaaaagctcactagccaacagtggtggcgatctacctaaatttgtacagtactagtagaaagaagaattatgtgttgataccgtgactcagttttccttaaaaaattacaagaatctttaatgaacgcgaagtaatcattgaacatttacgggagccgaggaaaacaagcctgttatagcttaattatttaagaagaaagagataaacttttttaaaaataaaataaggagacccgaatacatgttaaaataaattagaggcaattacaaatttaccactactttgaatcattattgcaaaactaccacgaaaattacaaaaatactactgaaattatcattcgagtggcatccttgcaatattgaaaaaaccggtggtaaatttgcaaatgcggcctaaaatgttacgctccaatctaaaccaatttatcttaacataaatttattttagtaataataatgtagttgaaatctgctagcctgtcatctttctaagcggatgatggtcgtttttaaggaggatcagacaccggtgcctgcacaaatatttgtgtccgataggaggttgggtatgtgttgtaggttggaactaaaatttctcacctttgcgtttaatacaagcagataatacttttcctgtcaagatagtctccatcacgatagttcaaatctacgtgatcatttccgatcccactcaatcctatatttggcagaatgagtttatattaccacagagactggtgggcaaattgccaggatcatgaaccatatgtctattaagagaataaaaccaagcatctcaattctgacctccccagataacacaaacacgatatg

SEQ ID NO: 57327 - DNA, 1501 bp, Oryza sativa
gtactccaaggcaccatcaagactacgatagacggtcagatcaatcacaggattaccatcagtggaggatagcttagcattggtatcaactgtcatggaatagggcttgcaactgtaggatcgaattacaagaactaagccaaccagagggggagcgtgaggcttccctgtatcgctttagagagcaattgagttgagttttgagttagggtttcgagtttagtcaaaatttttgtaaggagtgctgttggtgcactttgtaagcacagagagaattaataaagtcgtcatctactttaagagttcttcgatttgtgtttaccgggtttcggcggtctaaccggcaactcaccggtggtcagaccgacggcaagcggcggtcaaaccggcgggaacacggcggtcagaccagcggcggcgacagcaagcagcaggcgatctcggcggttacaccggtagatcaacaccggtcagaccggcggctcgctacggtcagaccggctaatctactttggtcagaccgatctcatcgaaattaagggtaacttttatttccgctaaaagttttcggtttttgggtataccaaccattcacccccctctggttggcttagttcttgtaattcgatcctacaagtggtatcagagccttgttttcttctttggatttttatcgatctagagtttttgccatggctactcccgctaggttttcaactaagccttatgttttcgatggaacggatttttctcattgatgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagtggtatttctcgttcggattatgatcgtgttgctcatcttcaaactgctcatgagatttgggttgctttgagtaattttcatcaaggaacaaataacattaaagagcttcgttgagatctttttaaaaaggagtatattaaatttgagatgaaacctggagaagctttggatgactatctttctaggtttaataaaattttgagtgatattagatctgttgattcttcttatgaagctaattatccacaatctgagatttctcgtcactttttgaatggtctcgacatgtctatttgggagatgaaagttacatctattcaggagtctgttaacatgtctactttgactttggattcactttatacaaaactgaaaacacatgagatgaatgttctttctcgaaaagttgattctaagtcgaatgctttggtttcttctttttcctctttggatgttgttgacagaaaacacgaggcctaggagatttgcttaactccagtgcaggtccaaagctcgccttcgggtgcgctagcgtgccagttgatttgatcctgtaatccacaagaaatagaagccaagaaacccgggttaaa

SEQ ID NO: 57328 - DNA, 577 bp, Oryza sativa
gggggggagggggggtaagggttggagttctgaggtgttttggactcggaggtgtgctccgattaggcgaaattctgctcaaagagggctcaatttcgtgttgtcaactggtgattgtagctgtggctgtagctgccggctgatgtggaagtatatgtgatttgttagaatggttagtacctggcaacgaaatctgtttgggtgattgggcaaaatacatttgaattggataaaatgagaatggggaattgtttacagcaatcgtacacttccactgctgctaagcttttcgcatatttgatgcaacctgcgatcatcggagcatcctttgtgctatgggatctcattagtggtatgatggtatgatgcttttgtttgtgggttggatgggtcatgtgatgcacaaggtgtgtcttagatctgttgcgatgatggtgtaaactctgtctgaggtattgctttattgtccttaccaaggttttggtttcggtgtctggttttcctaatgaaattccactgctggtaggtgaactggttggtagcttttgacttggagtgctctgcttttgatatttgg

SEQ ID NO: 57329 - DNA, 1501 bp, Oryza sativa
atttagtcctttattgtttatttgcaactgccgatcgattcacatatgacattggctcaaagataaatgatatgtcatcggcaccctagccgatcggctatcatttatagatttaacccgggtttcttggcttctatttcttgtggattacaggatcaaatcaactggcacgctagcgcacccgaaggcgagctttggacctgcactggagttaagcaaatctcctaggcctcgtgttttctgtcaacaacatccaaagaggaaaaagaagaaaccaaagcattcgacttagaatcaacttttcgagaaagaacattcatctcatgtgttttcagttttgtataaagtgaatccaaagtcaaagtagacatgttaacagactcctgaatagatgtaactttcatctcccaaatagacatgtcgagaccattcaaaaagtgacgagaaatctcagattgtggataattagcttcataagaagaatcaacagatctaatatcactcaaaattttattaaacctagaaagatagtcatccaaagcttctccaggtttcatctcaaatttaatatactcctttttaaaaagatctcaacgaagctctttaatgttatttgttccttgatgaaaattactcaaagcaacccaaatctcatgagcagtttgaagatgagcaacacgatcataatccgaacgagaaataccactcaaaagaatgttgcgagctttgcaattttgttcaaaagcagttttttcagcagcagtattaatagcttcaggaatcacataagcatgagaaacttttctccaaatatcataatcttcagccataatgtaagattgcatcctactacatcaatgagaaaaatccgttccatcgaaaacataaggcttagttgaaaacctagcgggagtagccatggcaaaaactctagatcgataaaaatccaaagaagaaaacaaggctctgataccacttgtaggatcgaattacaagaactaagccaaccagaggggggtgaatggttggtatacccaaaaaccgaaaacttttagcggaaataaaagttacccttaatttcgatgagatcggtctgaccaaagtagattagccggtctgaccgtagcgagccgccggtctgaccggtgttgatctaccggtgtaaccgccgagatcgcctgctgcttgctgtcgccgccgctggtctgaccgccgtgttcccgccggtttgaccgccgcttgccgtcggtctgaccaccggtgagttgccggttagaccgccgaaacccggtaaacacaaatcgaagaactcttaaagtagatgacgactttattaattctctctgtgcttacaaagtgcaccaacagcactccttacaaaaattttgactaaactcgaaaccctaactcaaaactcaactcaattgctctctaaagcgatacagggaagcctcacgctccccctctggttggcttagttcttgtaattcgatcctacagt

SEQ ID NO: 57330 - DNA, 177 bp, Oryza sativa
ttatcatattctatggcacaaaaaggatataatcttgggcacgggcaccgatgctccacggaaaccaacaagacctcctatgaagaaacggtttaatgataaggtggaagaacattagccacctagggccactgaaggcccagaaaaataaaaggaggtgcaaattgcaccgaaaaa

SEQ ID NO: 57331 - DNA, 1042 bp, Oryza sativa
agaaagatcgtattgttagaataaactacatctgtaagtttgtaacgtaattacgcaataatgttaatgtttgtttctagttctgaattctctgtgccttggttggtggccttatccaccaaactcaaagagggttcttgattttgtcatgtatgagagacagtgaaatggagggcttagtgacaggaactgcgttgttgtggcttgattattgatgtagtcatatggtcatatattcatatacttcattctttttgccggacttttaatccaacttttggtcactgttagtgtttcaaatcacacctttgcctaaaggtcagatgtggtaaactggtaagagcaagtataataaaaggatgtgcataatatgtataaataagatataatatcatgattattaaaaccaaaacaaattaagattgcatggtattatgagaaaaaaaaaagaagagaaaatttaaaccatatatccatcattaaaatgctaaaaataattagggtgatgtggcttaatagataagaaagaaataagagtaactacacttagtaaggatgaactatatatatatatatatatatatatatatatatatatatatatatatatatatatatgggcatatataatgtagcaataggagggggtcttaagcctctaaagtagtccttatacactataaaaatagtccatacggtagtatttaggataagctctcaatatgcataatgcctacccataagaataaaaaataacaatactttctcttctccctcacatgtcatacaattaagtgggacaagtagaacccaggctaatgccttctcttaccatatacattgtagcaaacaccataactaatacgggtctcaccttattaccaagtactcgtggacataatacatcgagcatatgccctaactatataggattcccaatattttccgagtcgaagatccccaaacgttccggaccgttagatgacacaagcaacggtggatccgaagggataccgcagtagcccttcttcttcacggcaga

SEQ ID NO: 57332 - DNA, 204 bp, Oryza sativa
cctctcttccgccagtccgccagaagggaggcacggtggtgccgcacgcgttgaagcggaaaggaagccaccaacgacgtattgcagcaggaggggaggcaccagcgacgtattgcagcaggaggggagccggcaggcgggtgacgcccatggagcggcggtggggggcgcctcccctcagccatatccaatgactgccctcca

SEQ ID NO: 57333 - DNA, 1501 bp, Oryza sativa
agaggcccacataacataaatccagaacaattgtaaagtccactcacactgtccaaagtccaacagcactgaaagacaaaagacatagttctgaacaaattaacactattcattcttaatcatccatgtctgcccggggaagcgtctttcttttctctcccgctaaactcgattcagccacgtcctcaggatgtaggccacataggtccacccccaacttttacaataaagacaaagaacaatcagaaggggatgaatctaaatttatatcatcatccagagcagagaaatcagattcattaatcttgctgccaggaataagaattttcgatatacctaccaactcgttcaactttttagcagatatcccccttggtttgccaattcccattcgatgatcaatcttaagctcttggctggcattaagaatcctggaattgtgccttctggtagggttgtataaagtagtcttctcatcccttttcttcacatgagccttaggaatcagaatcactgcaggggtgacttctggacttgatgactgggcttgcaaagtcatggcatctaaaatctcttgatgagtaagtccatcatcaggagaggaaggcaatagggcccagctggaatgtgctcttttaactacaggaggggcatgatcaagttcatgaaagggcttccatagggcagagctgaagggccagaattcaaagttgtatgcatgatttctagctttgcacaaatgatcaatcttttccaatagaccttccataggataaaaggatggatgctttggcccttccctgtcagctatctcctttgagcctagccaggaaaagctgcacctgttgatccttatccatcagattatgttcttctaacacttgattaggcaacacaatcagttgcctagggttttcctcaatctggcccattgggtgatccttaccccaagcatcctctatttttgcttctgcagcctactgttgctgcacaaagttatcccaatcaccacccccctgattaccagggtgtcctaactgccaaatatttccatcatctgggtcattagcatcatcatcattaggccctggctgcggcccagcagtaggtaaatcctcttcaggtggaatatcaacaaaatctccatccaggacaaaaaccgaaatagtccaagattcacctccaccgccattacccaaaggatcctgcaacactatctttcggggcacagagtcaagatccctaaattttgctcgcacaaacactctctatctagccagaaagtgagctaaccaaaagaggcaaccgctagatttatatggtgatgatcaacgaaatccagcagcaaatccaaaagaaggaaccagccttcccggttaaaatggcaagtacgccagtttggcccttggtcatgtttaacaaactcaacagtcgtcgtaagcagcaggggtgaattcaccaaggcatctctatgcatgaccgaatgaagctggaacatacc

SEQ ID NO: 57334 - DNA, 1501 bp, Oryza sativa
cataactaacataatgttacattgttgaactgcaataaatattaatttcgtatttaacaataggatgcttagagagttcagatcattctactttcaagttcaatccaattcatcctgcaatgcttgctttgctaagtagttccaacaatatgtaaattactcattcagaaaataacccaagatatctatattgaattgtaatgcataattgcgacaacgtgtgataacaagatatttggatcttgcatttgtccaaggatatattgacaacagatcggcatacctcgcaaccgtgctctgaagggtattagtgtgatggctagaagagctcctggttattagcatagttgtgctaggacttcttagctgatgctatagtttgtgcttttgagtggttgttgcttagactaagagtcgatgactttgtggtttgtcatgtcatgtacatattatgttgctttgattattgaattttcaatgactatgattctggactttaatgtattgcttcaatgtttgtaggaattggcttagattttctggaactttgatgtttaacacgtaatgttactgatcaagctttttcaaattcactgggaccttgtagatgactaatcattgcaccattctccatttatagcattcaagtagctaataatgtggttctgtcatttgtagttttgtacaatgaagattgaagcttgtggagcagctgaaatttaatttatcaaacaatgcttctgtccaagcttgtgacgaccaaggtgctattatagttatctgcacagtgaggactgaatcggattttattaaccattcttgtgcttgcattgcttcaccataactcaccttcttttgcatgatcataatgttactcatgtctctgtatgccgtgagttaattttgtgtttaactaagtcaaatattggtattagcattagagcggtattattttattttttactatgatgttctattcaattattttgtttgttcttgttatttaataaggagcactataaagatgtgatgtaattattgtgtattaaggttttcgatacaacaaacaaacactcgatgcctatttaaaatcattttccttagtgtttttgaattcataaatatatttttttctctcgttgtaggacacccaattagtagaggaagaaaaaaagggtaatctagtccaaaaaataatttcagcgtattaaagtggtaagtagtgacacgtttcaaatacctatcaaattataatggcatgatgattttaaatacctatcaaattataatggcatgatgatttcaaatgggtgaattataaaaaccatcaaattaaatttataatgggatgatccaattaatcctttcccttattaaatttgctcgaattttggacatctgtaagttagtacctcctcctttgacggacgcgtcgaccatttctcctcgtcgagatctctctatctctctctctgctctgctccaccgggcgtcgcggcaa

SEQ ID NO: 57335 - DNA, 1501 bp, Oryza sativa
tgtgagagctgctaccgatcttctaatgccactgcccactagtttcatttctgttcgtaagtattgttgagggtgttgaaaaagctaccgtatgctttgtgtagttttgatgattcattctgttctacacttgtactattttgccccattattacctatggtcccttctgcatccattgccttgccttcattcactcatcagcctgtagagatctccattgaacttggacactgaagcgaccaagccgacgccttcctttcgtagttgtcgagcaccttgatgatatcgccggacagctaccatcgcctgtgccgtcggccctgccttgctcctgtcgacgagcgagggaaatgaggcgaggatcctcttcccagtggtatagccggcggtcaggtccggcaaggcggcaacagcgagctcttcttcatccagtcccattttggcctattagaaaggcaagtaacaagtcatcttagtttcattttgtgctagcatagaagagtaacctgctggcaatccaaaatgtccatctggtgcaaggccaatgtcgtcaggagtcaggacagccggggaggttgtcaaccaaaatctccgacttctcgtcctcgtctgccttcagccgcagcttcatgcatcgaaaaccattgattccgcagaagtaatcacagatctgccacacgacaaatctcacaagagcgatatgggcgaacctagaacaaaacttgctagggatcctattatatacttcctccgttacaattcccaaattgtatagcttatattttttttagagcaaattgcattggtggtacacaaacttgttaggtgggtgcaatttagtacataaacttgaaatatgctcgtttcagtacacgaatttgtctggttcatgcgaatgaggaccaaaataacttgacaatgttaattatgttgattaggatgtgacgtgcatatgtgtgatgagtatgcataggacattcaatatttataaatttgctctctactttatttttcaccatggaaatgatgaatttcatatatttctaaccttcataccattgctcgttttctaatctttttctactatcactgtatcctattctattttttattgaagagatgtatgtctaatagcaaccttctcagatatatgccctaaatcaataagattagcaatgtagtgtcctttttgccttcctccgcacacaccagataagtttatgcatcaaaacgagcattttacaagttcgtgcattagattgcactcacctgataagtttgtgtaccggcgatgcaatttactcctttttttacacgatctgacatactttgatcattaatgtaattcatgttatgttcccaacgaatataaaattagcatcacgtgaaaatactttaaaatatgaatatagtgatataacatgtataatatttaacatagatatagttaatatgattattagctaaaaatatttttcttaaaaaatagacatcctactg

SEQ ID NO: 57336 - DNA, 1501 bp, Oryza sativa
gggtggatgtcaggcttggatgctggacgagcaagctacgtcgatggtggtctcctagggcagcagaagcagagccgcgccgtttcctccgagggcagcagcagccgccgctgccaacgccactccctcgagtgcagtcgccgctgctaccttcgcgctgccgttaccacgcgcgctccctccctcagtgcccatcccgtcgccgctccctccctccgcaagtttctgctgcgtcgtcgcgccgccgtgtgaccgtgcgaggctcggcggcggcgccggcgggcgaagccggctgttcggtgcattccggtggctgcgggtgcggtggttggcggcgctgtaccgcaggaggagaggcggcgggcgagcgcagcgagcggagcggcgacggcgggtgagcgccacaacgttgggcgaagtggcgcctgcggcggttgagagcagagaggaagagaaagaatgagagagggagagaaggataaggaagaaaaaagaaaaagaaaaaaaaaatcaaagggtagaaccgtatttacacaactatttctctctccaattcttccggatataataaaataattccacgggtatccagcagctaattaccaattttttgcggtgtcctacagcagaaacacgtttttgcagtgtctcctagataattacacattttttggttgtcctgtagcaaattttaccttgtttttaagatctatttgcatcattgtaccccactgaaaatatatgacaaaacgagatccatattaaatatattcaaacattttattaatttaaaagtaatctattactccatcaatgttaggaagttatcgggaagtaacttttacatcttatacatgattaattctcattagttactccatcaatgttatttacaatccatcaaagattttatcttcttttctcatactacatgaaaaacaaaaacaaaagtgaaaggaaaaaaaaactatcaatgcttaaaacagatttatagaaagttacttctgaaccatgcaaaagttacttccaattaacattgaagttacttttaaaaattgttaaacttacatgtgttgattaaatttaatttctagatagagtcatatttttatccctacaacgaatttacttctaatgtcgtgacaaagttactttctttttattttaagttacttttataatatatgtaaattacttttagactttattgaatttacttttatatgtctaagaagtaatttaatgaaatctaaaagtaatttaaatatatttaaaagtaatttatagtttttcatcaaaatataatataatcatgtgagatcttgttataaagatttaattgttacgatcacaacgatgtaaccggatcgtagatcggatgagtagtttaattgaattttatttgaagcatatgtggttcctatttgcttgatggactagtattatattttcagtagagtaatggcttcagtggtgtctaactgtaagactaaaccaagag

SEQ ID NO: 57337 - DNA, 1501 bp, Oryza sativa
aggtctctatcaacttgtgtcctgtccttcacactactatacaactgtgactgcaaaatgaatggttctgtcacaacctgcaagtgaatataaaacaggatgtaatgtttacacacaaatggcaatcaatgactcttaagaaaaaaatgttagtccagagagagataaaagctcaatataaagcccaattggacactgattatcctagcaatacaaagctagagagagatattaataataaaaattgaaagaaaatgcaaaaatctgtaatctctgactgtcttagttatttgtagtaacaaagagtataacaacccaactttcattttggttccattaaatcttgtatatagctcataacaacttttgtttcttttgcgcctgatatctcttgggaaggtgcttttttacacctgacctacagcatattggcacaactgagggatctagagtctcaactctcaagtgactcacttgagccaacttaacttggttgtttctcaaatctatcattcatatatgtgcattgagaggtataaataaactgtgtttagttgcttaccagtacctcaattagatatcaagttcagaacatatgaaacaagagatgatattcacttggtgaaaaatgacaaatcatacagcagttatgtggatactggatgcaattcgggtgaattacagaaaacaactatctaggcaatcaaaacatattgaaccaaatagtttaaactggacagattaatcaagttttgacaagaactgaatatgaaatttaaccttcaaagtgcgtgcaaaccttctctagctttgggaattgtgtgcgcatcagttgaagagcaatcatggtatcactgaacgtaagggtgtcctctgcatcatcaaacagataataaatctttatggtaactgaaatataaagcaataatcatcaccgaacataaaacaattcaattgttcgattaaatttggacgaggagagtaacgaaccaaggctgcttgtgtatatttgggttgtgtgcactggacgctcatcgctgtgaccaggagagcgtggtcgcttctttttcccaccagaggaagatggatatgatgatgatgatgatgatgatggttcgtccatctcgctttattgattattcatgggcggatccaacttgggaacttttcggggaacaaacaaactgttactaaggttaaggctctctctgaaattaagagaagagcttcttccagatctggaagagaagctagggttaacgaacgaacgaacgcaagcaaaattaaagtagtcccggtgggggagagagagatgaatcagaaagaggatgtggatgctcaccaggatcacctcctctcccctcgccagatgagatggagatcagcgcccctcccctccccttccctcccctgttcagcagcgagatgagcggagcagacgagacggcagattttctttcttttacgctaccaacgtattaacacacgagggttagcaaat

SEQ ID NO: 57338 - DNA, 1501 bp, Oryza sativa
agttcatcatgctgatctccatgtccaaggcagaagttggtacaagagccaaaggaataaactgttccatcatccgttacagcaaatgtatagctggcaccagcagcaacctgcactaccggagcaaggccttcaaataattcaacgatctttggagtagccctgtctattgtgtcaccatgaccaagctggccatgtgtgttacttccacatgtatatacttgcccatccgttgtaagaatgacagtaaaacttaaaccagtggcaacctgcaaaaaggggaatagatagaattaagaaaaagaggaagagttttgcagacttgactagaccagacatatgaaacaactacctataaggctataacagccttattgtctattaacaaatttagttacaaaaagtagggtcttccctccattttatatcaacaaataaataaatttgaccacaaaactaaaacatcgttcctgttgcatcaaataactagagcattgttctgtttttacaaaatgaaatataataattgaaagaggcatttattccattgtaggagatatggaacataaaaggataataaagatgattgggtccacctgtttgcaagaaattccttttagggcctttatttcggttggtcgaaatatagttcgccccacctcaccgtgaccacagcataatgatgaattatctccacaagtgaagacctatttgaacaaaattcacagcgttcaaagtattagaaatattacaattgacaatatacagtgtttaagatgagcatcaattacctcccctaactctgtgacaaaagctgcatggttgtgagaggcagagatgttgacaacacgagaaagtgatgggaagggaaccctgctgaatgccgcacactgggttgtatctgggccatgacctagcaccccacacaaactggatccacaagaatagacagaagagtcatggaccaaaagtgtgtgatatcttcctgtcgctacttgcatctggaaacatacagcatgttcacatatataagaaaccaggttggaaatgtcttctaacattaaaaagaaaatctaactttccagtttcatactaaagatagaattgttcatgagggaaactattcccaagtgcaacaatgcaacttttgttgatcatttggtcttcatattggcaagcatagcagaatggcaataagtaacatgtccaacatagagcatactctcaaactggtagagcagatgagctaggatgttaataaaagaaaaaaaatctagaataaaagtaaattaggcaccctccagaacaatctgatgcagtaggcacgccaaataattatgcgccatatatttttaaaatgtctgacttgaaattcaatcagtgtaagaaaaacaactaagatatgatggattcaaagcaactgaggcatcagcaacatattcccattcagccaagtgtgtcgtatctaaaagaaaatgaaaaaacacaaggtaccatatgt

SEQ ID NO: 57339 - DNA, 225 bp, Oryza sativa
caaatgagattgtttctgaagtgtcaatttgatttgtttcagaatcgcctgtctgttcatgattgttgtcaatttgtcagtgatctctgattctctgaattctgaaggaaaaggaaattccattaaagcacggcattgccataggcttagcatgcaattaccctatatggaaatgaaaacagcattggtagactgtatcactataatggcaattaatcatgtaga

SEQ ID NO: 57340 - DNA, 198 bp, Oryza sativa
  unsure (1)..(198): unsure at all n locations
gcgcccttganttaagaacccctcgacgnnnccnnnnnnnnnnnnnnnnnnnnnnnnnnnnnnnnnnnnnnnnnnnnncttctcaacatgatccctcaaaaagtgaaagcgaatatgagtgtgctttgtacgtgagtgtctcccaattcagtagaatatattatgatacatgatatatctttattttgtatatgtaga

SEQ ID NO: 57341 - DNA, 723 bp, Oryza sativa
  unsure (1)..(723): unsure at all n locations
gttcggaaagcataatttggggacaaacanaccgggtggcatgtggtatttagcgtattgaacaaaattatatctttaaaaaatactattgggttcatctgttgtttgtcaagctaactgtttttttttctaatggatatatcacttacatgtcacaatttttgttaaggtgaaataaacagtgttctaactattttcaataagaaattaatatactttagtgcaaatcttagtaatacataaacacaccaaattataagctaggaagatgcaacatctggattaataaaataaaatcgaaaagttacactaaattatacaagagttgtgatctttcggattaagggtttaataagctatttaatgtgctacgttttagtcgatggcaattaagaagaaaatatcagatgactgtaaagctaaacaccatttgaccatccaagtacattaagaattgaaaagttttcctacatttaatgtgagaattccaacctaattttgctatatgtcagatgagactaaagtggaaattgtaagagaaagaacataaataattaaatactatttacgaaagtttgtaactaggacatagtactacttattatgaaaaagtttatagctatgacatactacttattatggaaaagtttataactatgacatacttatatttctcatatatattgttgctaacacatggtgcctgcactgcatgtgtatagt

SEQ ID NO: 57342 - DNA, 1501 bp, Oryza sativa
tacttaggccttatttagttggggaattttttttgtttggttatcacatcggatattcacacatttgaagtattaaacgtagtctaataacaaaataaattacagattccgctaataaactgcgagacgaatttattaagtctaattaatctgtcattggcaaatgtttactgtagcacaacattatcaaatcattgcttaattaggcttaaaagattcgtctcacattttatacgcaaactgtgtaattggtttttttccatatttaatactttatgcatgtgtctaaacattcgatatgatggatgaaaagtttttgttttggaactaaacaaggccttaatagctgagagaaaaacaaatatacctaggaacaagcacatgtagtagatgttaatatttttttcccttgataaaattttcaaggaagctagttggttccttccctcggacagacagctaaagctggactggcactgcaaccaaaaccaaaccaaaaaaaaaaatcctcctatgtttacagttactaggaccagttattacagcttaaacctctaacttatcttacttctccaaaaaaaaaacaaagaaatgtatctttcacacaaaaagaattgaagccatgctgcattgctattacttgctgcgtgtcatcccactcagccgacctcgacaactccctcttgtgcttttgcttttcttttactcctcaagccttcccctgatcagttcttgatctgcactttttacattttcttttagctgcaaaagtttcaaactttctttttttttcccttttgtaccatggatttctcatttctctatactaaaaatgttagtagttgtggtgtccattctcacgtcacacctctactactgacatgtgggccctataatctatgctattacatcacctttcaatgcatgacccgtttcactattggttcttcccaaattttaaaatcacctacttattcaataaggaaaatcataatattacttaaactacataaatgcttattaattgattcaataaggtagaaattcaatttgttttccgttgcaacgcacgggctctaggctagtctttttaagaggtcactagactgatgacagtgaagctgcctcttctccactccactgcctatatatctgctgccctctatctaagtccattgccctctgagtctctgaaatcctgaagcttcttcttcttcttccttcctcctcttgctctcttgctcttcctatgctagcactctccatgctcttcttgcccttgtagcattggctccttggtttccatccatggatccacgctaaatgcattgcgaggctgcaaattggtagcattcccttccccgttgcatgtgctgcaactatgtaagcaggagtgtctgatttgacacgcctgaatacagcttctcagatcttcagttttgttgtttgtctgagaaaaggagagagagagaggcctcttttgggtccaagaagagaaaaa

SEQ ID NO: 57343 - DNA, 589 bp, Oryza sativa
ataaataaaaccagtggtagttcgagcaagcaaacaaagaaggatatgccagaagtaaggggtagcaactagtgtgacttttaaaaccaataaaattaaaaacatgaggatgataaggtttggttttacaatgtcttgagacaacaagataaccatttaataaattttaagtaaaacatattaaaatatatataattttatatggatgctaaccgcgcaattgcgagggccacccaactagttatttgtaaaaagtatattaaaagaagccagttctcatcatatacacaataagaagaatatgttataattatgcaagaagaaaatattaatttataacgtgaaatagaacatagactttaatatactgaatgttaatgtctatcacatgcaaacaaaaatcactttgtcactattatatgtaaactggtctacaaccatcattcgcaaacataatataggttttgtttttttctttcttttattatacatctaattcacttatgccatggtaacgtacgaaggaataatttatattgtcatattatttacgctaactattaatactatttacatcagcgcggcataa

SEQ ID NO: 57344 - DNA, 1188 bp, Oryza sativa
cccaaactaattagctaacttcctgtctgagctaggaatcccacaccggtattacctgagataacgaaaattcttcgcctcggacgaccggcgtgggggagcgaaatcgggcactcttcccccatgcgacacgcatgccagtgggccccaccatttatcttgcctccacctgccacgtgcccctatcaaacatgtttcaccaaaggtattcacaatgtttcactatgtatatatataatgttgtagtatattgaaatattcttttgcaacaaatcacccacatattttggaaaccctctattaatgaaattcgtttcattttttgttccaccaaatatgtttcacctagtgtactcacaatgtttcactatgtatagatctaatgttgcagtgaacgaaacattcttttacaacaaatcacccacatattttggaaaccctctattaagagaattcgttttattttttgttccaccaaaaatgtttcacccagtgtactcagaatatttcactatgtatagatctaatattgcagtggactgaaacattctttcgctatttgctgaaacattatttttatataaggtaaaacaatgcccgatttaaacgatagttccaccaaaaatgtttcacccagtgtactcagaatatttcactatgtatagatctaatattgcagtggactgaaacattctttcgctatttgctgaaacattatttttatataaggtaaaacaatgcccgatttaaacgattgaaacattttcgatatacttagtgaaacaattccgatatatatggtggaacatcgtgtaacttttaaaaataattcaataataagctaaagaaaatttcgtcggaatatatccatgtgtggttttgttttgaagatttaattgcaacgaatttaatggtgcaatcggatcatgatttgaataaataatttaagaaaaaaaatagtttaaagtagttttgtacgcatgtgtggcgctgacgtcatgcccgatcggtagtcccctccgataaataaataacaaaaacgcataaattggacttcgtgttgtcaggtattttttagaactgagttatttcttgaccgccgctgattccctcaaaatttctgcatatatatatatatatatatatatatatatatatatttatctcactaaatgaaacaggcgaaga

SEQ ID NO: 57345 - DNA, 172 bp, Oryza sativa
ctttgccgtcccaagggcaagctcggccaccgctcatcctccgtgaatcatcgccgaaaccccatccctatcactcaaggtgagctccacctagtactgtcgctaccggccattgttttagctgcaccgctccggtcctcccctccttaatccctcattccccttccgcagg

SEQ ID NO: 57346 - DNA, 337 bp, Oryza sativa
atgatagttaatgtgaatttttttgtgcgagaaagagacttcctactgacgttaactcaattatgccccctactactgcagttttctgttttaatttagttgatataaaatagattcagactgatacttgcattttgtgcgagaaaacgtctatcccttgttttaaaaattgtaagagggctataaaaaactggagttttaagagggctaggcttgctaagatacatgagttttggcttctcttatgattatttcttgctgagagaattgcatttgcttcttacttcatggtttctgtttcttgtcctaactgcttatcctgcatggttctggcaga

SEQ ID NO: 57347 - DNA, 472 bp, Oryza sativa
caataaagaacattgttgacgagtgtggttccttgctagtaatttctttgatccaaattatgcatggcttatattggggctttaattaattggattcaccatttcattctattctttttttaatactagcaaaaaagcatgtgctttgcaacgggtaaaaactattttaatattattattattattatatggtttagttacaattaagtttaccgtctaaagttagcatgcgagttttcttatatgactatttctgtatttccaaaagcgaacgaatttaaaaaccgactcaaatacggatatgtatttccaaaagtgaatgaacttaaaaaccaacttatacacagatgatgtaccaaagtaccggcaaaaacatctttattttttatatattttttaataattgtaagttgtgggcatcctataattattcaaacaaggagcctgtttttttctcactctccaaccgaga

SEQ ID NO: 57348 - DNA, 1501 bp, Oryza sativa
ccgcagccgagccgtccgctcgcgcgcgcgcgtccgcccgctgacaggtggggggcctgtcgtctacctccggccggccgccgcccgaaccctagccgagccgtgctgccgtctccttccaaattcggccgcgcctttccttctccggtgaaatcaattgaggggaaatgtttcccgagatctcctctaccttttctcttttggaatcgtcggctaatttcgtttggaaatccgtggattcgagttcgattcggatcgatccctctcctccgaaccctaaactttccttcgcgtcgccgatcgccgtgggccttcgccgccgcctccttgcccctttaaaaggacccccaagcccgccgctacccgccgccacccttgctttcgcctctcgccgttggtagcgccctagcaccgtgtagccttgcgccgccgtcgtcgccgccgctccagccgtgcgtcgccgtcgctccagtcgtcgccgtcgctctggaaggccgccgtcgtggtcgccgtcgcgtcgccgtcctcgtccgcccctccatcgttgctgtagaccgccggagcaccgccgtcgtcgtcaagccgatcttctccgccgccttttcctcgacgccgtcgccgtccgttgatcttccgccgccgttttggtcaccggtgagttcgccgcgtcgctctctacatgctggtgccctccgttcgtgccgtcgcgccctcgttcgccgacgagcttgcgcgcccgagccgccgccggtggtgacgtcaccgctgacgttatcgtcgtcgtctctcgtggtccggccgtggaccggtcgatctcggccgtccgttttggatggaaagatctcggccgttcgtttctgtgagccgccgccgtgcacccggtccaccgcaaaccctagccgctgacgcaataaacccctttttccttttcaaaaataattcattattgcgtcataattcaattaaaacccatataattgatttaatccgatttaatctttgaaaattcataactaattcatcttagctcggatttagttggttcaagtctctaaatttttctaaaattgagatctacatgttaaaaatatccacatgtactgttcatgcttgtttatgtgttgttttggtgtttttgctcttttctgtttagattccgacgtttccggagagtccgttttcgcaggagaagaatttgaggagttccaaggccagcaaggcaagtcacacagatcctaaacacaatcttttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcact

SEQ ID NO: 57349 - DNA, 1116 bp, Oryza sativa
  unsure (1)..(1116): unsure at all n locations
aggatgtttattgttaacctatnnnnnnnnnnnnnnnnnnnnnnnnnnnnnnnnnnnnnnnnnnnnnnnnnnnnnnnnnttcttactactagggttttggttatacaggggaatttacatggttacccttatgaaagggacatttacatccatgacccgaaattaataaacaaagcgcgacatgcaaatatcaaaaccccatttttctacacgtatctacacaacctagtcgattggcaaatttcttccctccaattaacaaaactaggaaggaagcctggatagatacgtaggcaatttatttatctatctatctattattattatatattaaaagtccattaaacttcctacaaacgttctcatgccgccacattggactcctacaaacgctcctaattaagccgccacgtggtaatctaataaaccggtggacccactatttcagatttttagttattagatttacacttatttggtggacccaataatacatggaattagttctattttttggtaaaaaaaaatccacatcccgcttggtccgtgcgtacgggagatcagagatacacgccctccctcccctctatccctttaattctcacctatttccatgctatatgatctctcttatttccatgctatattagtttctattttcatgctatatgatctctcactaaatcactaaatcaccgtcctatacacatacgtacaaacgtacatacgtactccctagctccctcctgttccacacccggtgtccgccctttctatattgattatgtaaaaaacggaaaacctaaaaaaaattataacatataaatcaagctgctaatttaaattagagataatccaataaataccattgacaagtgtccaaatctaagaaatactatcgataagcgtgaattccaagaaataccatcgtacaaatgattttgtctaaaaataacatcgccgttagggttctgtccatcccgcgccgttaaatacactgttcataacccaacgagacaataaactctaaaaactataagatccctttttaaaggttcgggcttctaaaaagtaaaaaaaaaccaataataattatgtttgaatttaaaatctcaa

SEQ ID NO: 57350 - DNA, 939 bp, Oryza sativa
gtgtatgctttgacatttaggggggtacattatagtaaagggatggaaattatagagctccttgccctaacactttctacggttggctagtagagatagaatccagtctgctgtacaattgaaaaaaaaaagaaattaggagggttcagaacattgcatgctatgcaagtgctggaggattcgcaacatattatctccagttgatctgcagcaaatggtgtgttattagcgatgctttgggttggcaaagttctcctttctcttttgatcatttctttcaccttgttattgggagagctgggcgtaaaagaaatagaattcttgtatgtgtgttggctgttggcagttgtggttattcaggaatgacattatgtttagagagaaagtttacattcacccctaataattgtttttcgaattctgttccttatgcaatggaagatcttactgaagtcatctgaagcagaagaaatggaagctctgatcatggtgatccaaggcactggacaaaatttgaggactatcaagatctggagtgggttgacatcagtctttggtgaaagtttatttgtggttgtcactttagccttagccaggtgttttgtgatgtctataatgtagctttgagcatgcaggtgctttggggatgtcggtgccctgtgatgtatagacaagctggagcccccagcagtaaacctgtaaggctcttatgctttcaaaaaagcttttcaacctttcctgtaaaaaatatatagcagcagcagttctattcttctattatgggtctgtttgtcacagctccacctccagctccacctcttgaagctctaccaaacaggccctatgttctatcagtatcttggcacttaccttcctcagatcaataaccagttaagttttgatggaaactgatgaagtatacaggttgcctctggtgga

SEQ ID NO: 57351 - DNA, 1501 bp, Oryza sativa
ccctgtttggaagattagcccagggctaattttgagagctaatgtttagtcatgaattggtaggctaaacattagcctaacatgatatgtttggatccataggctaattcaagactaaaaggtggagagagagtagaaagagatgagagagaaggagagagagagagctgcttttttatggtccccacacaaaattagccctattagcactctttggaggggctaatgttttgaggggggctaattcacattagctcaaaattagtccacctgtttggatccttgagggctaatttgagactaaaagatgagagctgaacattagcctatggaaccaaacagggcctggtagcctggtacacatggcgatcgaggaaatttggtggttagtgccacgccttcgagtacccatagtcccgtatcatgatgtacgcaccgatttggcatgataatatagttaatgtgttcagcatttttgcctcctttaattccgccgtccaagtccataagaatggtttgcaacacgctttggtatgaccaagaagagatgtacactattccagcattaactcatactccttacgtactagtaaaggaagtcgtttaggacagcggcatggtctccaaaacacaactttgacttcttgtttctataaaaatatttattgaaaagtgatatatgtatacttttatgaaagtatttttcaagacaaatctatacatataatttttacatttttaaactcaacaacttgagagttatttatgatttatattcccaaggtttgacttaaacattgtcctaaataactttctttatgagtacggagggagtattccattatttctataaaaaaaacttctagccgcatcataactagaaattggatttttataggatggagggagtagtcacgtacttatatacagccgcacctgagcgttgacatcctgcatcctgtgctcaacatgaaactgatttgattttggagaaggaatgtcagatttgatctcgtgtgccacactggaaactggacaaaattttgtctactagctgaagttttcatttggacccgaaacatttttttgctcaggaaaggaaaatggaacaaagtagagtccacagtgtccactgcattggtatgtgggatgaacttgctgtgctttgcaaggtttagaagaatatataaacctactcacctgcgtacgtgttgatggcagaggcataaaacaaccatttctgtctggaatagttggcaaggatcattcctgagtccaaacgctccagcgttgaggtctgaccaagataagaagattatttattattcagataacctatcatatttctcgaggcttgtttcaggctaaacacaacgtcgtcagttgacaaggtctgatttctaaacagcaactgaagctgcttgcaggaccatcatctgcttcaatcccactcttccctcagtcctccaccacgccttccccttgttcatcatctgcttcc

SEQ ID NO: 57352 - DNA, 305 bp, Oryza sativa
atgtgcccccccccccccgaatttttttatttttgttttatttgtttgatatttttttcacgcttagggacatacaagaaccaaccatagaaaaattgaactcaaatggacgtaatatgtgacatgtagaatttttcctctcctctcctctctccgaactagtgcagaggagagagatgtgcaacttttttatttttattttacttttttgatatttttttcacacttaggaactcacaggaaccaaccacgtaaaaaataaactcaaacggacgaaatatgtggcatatggaattttccaaagc

SEQ ID NO: 57353 - DNA, 1501 bp, Oryza sativa
attagtgggggtggagtcgagttgtggttgtgctgcttactgttgttgtgactgccaccgttgtagtcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcatcctggcggatagccttgtccacaagcttctcaaagtcctcatagactccggagattagttggttggtcaattcatcatcgagcccaaacaaaaacttctcctgcttctcagcatcggtgcgcacgtcctcgggagcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcaccatctggaggaggataggtagaaataagagaaaggaagaaaacagacggctcggaaactaatctttcttataagattaagtgccattatcttaatcttgattaaaacactgaaaaagaggcacacaactcctaataaaggctgtcataccactcacacatgatatcgaccgccgactaacccacaagcaacaaacctaaacacaaaaactagcacgcaaacagactaagaagacgataaagctaagggcggcgactctgaagcttggagcggcgcttgcgatcggagaataggtctgacatctaaagagtacagagggataggaaccaacacatgctcaaaaccaaattaaataaagcaacaaatgactcaagtaacttgccgagcatgatgatttttatgcatagaacatttttcatgaacccggataaagacactaatgcgactgactaaaccatagcttaatgcataaactagttgcatggaaaatgatgcgcataaaattgccccatcgaacatagacacgacctaatgcatatc

SEQ ID NO: 57354 - DNA, 1501 bp, Oryza sativa
gttctctagccattgtttaacttttgggaaataagattgtttcgccctttggataaccacggcaaattcttgtcttaaagagaaactgatctgaagaagagaatttatgtttctgaagattctattgttcctccagatccagatactccatgccattgttatgactatctccatatactcaattttttcagattgaatgcagaaaaaggaaaatgctttatactaccagtgtgttttgggtcaattcgatcgacacattcactgttaccaaatctgatactaactgataagcactgaggactgatatgttatgggcttttggatcaattcttgggcttgttcttccgcgaagggccaactggccatgtctgaactcacaatccaaaaggaagacaattattaggagtatcaattatcataaccatccaaaaaaagatcatacgagggaagacttgcagaaggtttcagagcaatgatcactgtccgtcaccaactacccttcatcaaattgtttcataaaaacaaagactagcagtggactggtaccaggttacagctttgggattgtcggcaaagccagttcatacttcgccatgcggctccgaccatgtactgcaatcacacaaacagcgagaaaaaagaatatgagcattaaacaaaggctaatgcaggtgtgagcctgcgccccacaattgctttcatctgcacgactgactttaatttccctccagtaatcaaatcagtgggaatatttacaaccagtactccatatctatctatacacgtacagtagttgatgaactaagatgaccatatataggttcagtcctagttcatgctcacactctctgctctgttgagttacccaatttgaatagagtaaacttatctctacagtaaaggattcagatatctcaaactgtagatgtaaaaacaaaatgatttgaagaactaagaatgaagaaacttttaagaggcacaggggtatggcctcctgaggctctaaaaggttcaggcaaggaccatgtgaagttacaaccgatgccacattttctagtaggcagtcaggatccctggaccagcattccattcattgcactcatgaccaatcggcaatcgccatgcgagtccggggtaaatgattgatcaatattccagcacaagaataatatttgtcggattctcgatcacctttgctctagacaacaacttcatccctttcccaatgaaaaaaaaagaagaagatcactgtacactagacaacaaaaatatgtcatgccttttccaataaaaaaagaacccatgccatcctgctcaattccctgataacatttgctacccctttttctcatgtgctcctcaccatttcctaacacctatttaagtgccccaagtggcaagaaacttaagtatccattccaacattgtggcagctccctctgaaatcccctcttccaatcatatccaccagctcacagtttgtgatccactatgactatcc

SEQ ID NO: 57355 - DNA, 1501 bp, Oryza sativa
tcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccactgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgatagtcagttgggaatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcatttgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatgg

SEQ ID NO: 57356 - DNA, 1501 bp, Oryza sativa
tgtatagacacttgttaaagaaacgtatcttttagcagttgggtagagcacataaaaaatgagagtagtgaggttgggaacatcgagggaagaacggtctaagatgccatgaagatgactaacgtaaacagaattgttaggggtcgcccggccggcccatgtgttcaatctggcaaaaaaaatggcacatcaattctttcatgcgagcattgaatgttctaaatgatcaatacttgttcaacaatggaggagcattggatgccctgaagagaaaagagctggcccagctatatatgcatgcatggtatctgatttatatagtttgctacttccttttgttttatattataagtcgtttaattattttcctaatcaaacttttaaaaaaatatagtagtacttttaacacaaaacaaacatctatttgatgtttaagattgtgctaattttttctataaaatttgacttagaaaaaggtcaaaacgatttataatatgaagcggagggactatatatttgtgtcaatttgaggtgtacatattttttttctttttttaacgatcattcttttccttgttggagcatatactattaagtctatatgacctttaactctttttttcccttcccctcaagtcaccttgctgaccaacgacggatgacgcaccaaagaaagcatctcttttcctttcaatctccctgtacatatgctgtcggcctttgataaatatatatatctacagctagcatccctctccctgtgatcaaattaaagctgcaggacaaaattaaccactgctagagtattagatagatatgatcgatctaaggcaggagaaaattaagaacaggccggattaatttgcatatactaacaactgtgttaatttggaagatctctcctcatcagtgtctttgacacatacatatattaggatcattactccttgttaattatatatgtaatctaacgcgtaccttttccaagctagccaaagaatccaaacctctctttcctctttttttttaaaaaaaatgcttgcataaagttgatgaacaaattcttcagctttttttaaaaaaaatattttggtcatgcaggtgataattaattataaattgttcatcttgagtggtgtaggaattaaagtaaagctaattaataactaatacatttgttcgtaccataccttattggcatcattcttgagtgcacctaattaaagcaaagggcaaatacgcccgtaccgcgtgatacatgtaattaagcaaggaacggaatattgtcagattgtcatcacttggaggccagggcaggcatgcatataaattcttgccacctgcagcatccttgatgccaatatacttagcagtgccaaagcaattaacaaccacatatatatatacacacaaacacacatatttcagattagctttgtagctagctagccattgatcagctagatagagatcgatcgatcctgaatcgatatgggtagct

SEQ ID NO: 57357 - DNA, 611 bp, Oryza sativa
aagaatgaaattgaatcggtgatatagcaccaactgggcatctatctctatgacagaaatcatgacgaagtggcatggttcaaatttccaaaaatttcaatggcacgcactatgtttcacgaataatactggcattttttttatatatgacatgtttgcaatggcatttaatccaattaatcctattaaaaacacgacatataaaaactgccatctctctccaccttatccttatcgcttcactctccccaccgctcatcccttcactccccaccgttcccatctttctgggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccaattaaagttctcccaataaaggtgcagtgttaggggtaccccaagacgatgaaaaga

SEQ ID NO: 57358 - DNA, 1501 bp, Oryza sativa
acaccatcagcatcactatagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcccggctgcacagttctatctccaaaccaggaatataccattccaaaccaggagctaatcaaattattactagttatagcatcttttattatgatgagaagtgtgagactaatcacgaaagacattgtttgacccgcccttaaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagctgttgcccacgctggcttgtggttggcacggttaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaagattgtgtttaggatctgtgtgacttgccttgctggccttggaactcctcaaattcttctcctgcgaaaacggactctccggaaacgtcggaatctaaacagaaaagagcaaaaacaccaaaacaacacataaacaagcatgaacagtacatgtggatatttttaacatgtagatctcaattttagaaaaatttagagacttgaaccaactaaatccgagctaagatgaattagttatgaattttcaaagattaaatcggattaaatcaattatatgggttttaattgaattatgacgcaataatgaattatttttgaaaaggaaaaaggggtttattgcgtcagcggctagggttt

SEQ ID NO: 57359 - DNA, 544 bp, Oryza sativa
caaaatatcaaatgcctttcatgctagtttatgtttaacatgatttctgctaaaaagttaaaacaacctcatgatgttttggattgctcaccatgtaatttgaataagatgaaactaaaagatgctttaggtcgtgttgagtacatggaagatgttgtgaaaaacaatgaactgctttcttgccccaaatgtcgtaaaagcaaaggtgtcatggtagattgtgaaaattgtgctaatttggaaaaagaggtttctcatttgaaaaattctttgctaagattttctgatggtaaaaagaacctcaacatgattttagatcaatcaaaggttagcacacataaccgtggtttaggttttaatccttatgatcataattctagacatcctcctgttgtgttaggtgttggtgctagaagtggtgagattttggttaaacctgatactaacaaaactgtgtttaaatctgctggtatcatgtctactatgagtgcatctttttcaaaatccaatgttatgcatgcaaaatctcctgttgttgcttgtg

SEQ ID NO: 57360 - DNA, 445 bp, Oryza sativa
ttcctgcagcccgtcgagggctacaattttgatataaagtttgtctttattagagttcacatgaaaaagttatgaattattttttaatataaagtttttagactgtcctgtttagggaccggggtgacacaactgaacaagttggatgtcacaccccgaagttttcctcccaagtcaaaatggtaatttgcaaatgaccccaagaaaatgcaggtaaaatcaggagaaaaccctaagaaagtaatgcaaataataatcggacgtgacatgtggaatttttcttgagttctacatgtcaaaattcattaacaggatttttagtggaattttcagagcgctagaaataattttaaccaattaaaattgagcaagcaatattttaattccagggaaaaatcctttttccttttctttttcttttttcctttctttttcctcctttttg

SEQ ID NO: 57361 - DNA, 186 bp, Oryza sativa
cctgcagcccattgctaacctctttcgacagaaattacatatccaaatcttgcagattttgggacactggattagcttcaatattcatgctcctggccttctcctccaactccggcgacctcctcttcttctctgacgctggcgacactttagactccggtagaggaccctacaggttagtgtccc

SEQ ID NO: 57362 - DNA, 1501 bp, Oryza sativa
ggcggagatcgagttcggaaatagagcaggaatcggctggagtccggatcggctacgattaggatcagctgggtctgagtcggactaggaaagtcgatacagccgattccgataatacaacttgacgtgtgatgtcgggttggattgaggtgcttcaaggagattgccgcacatggatagagtcctgaggaggcaattgtatctattaattaggatgctttatgtaatttctttagagatacgattgggcaaaagtctgccgcaaagacttatagtatcttagagtttgttagagatggtaatcgtgtccattatggacatatcttgtaattctcgggtataaatagaaccgagccctatgtaacttaaaaacacacgttcaatataattccggcgcatcaccacccttttttactttagttttgtttcgacgagttcttgcttttgggttgagctgcatcggtttcgatcttcaacaagaggtaaaacttgttatgacggcttgcgttcttgagattagcgcttccatctctatgatattctaatcttgtttatgtgatttgtcgagttatcatatatcttacataatctctggcaatatcgctatctaacctacaatcggctaacatctatcgaggaaggcagccgattaggttagattctgacgttgactcagattatataagatatctaccactctatgaaacttccagcggcttgattgtctagatattgttcttcttttcatacttaatgctgcatcagttgagtttgatctattaagtcatgattagaatatcaatctctagcctgtcttctggttgtcgattagggtagcatcggagtgtcagccgatcttatctgatttaattatatttgctctatatgcttcattgacatgttaaatctgccctttatgtcaagatattatttttttaagtatattaggcttctgtttgatatattttacctgttttaatatcctaatatagagtagtatcggagtattagccgatacatgctcgatctatctgatggggctatgctataaacatatatagtcctgttattaatatatattttgatctaagtgatttatacagtctcggcatggcgaccgatctatcccaatcacttgatttaagtatatatcgatataagaataatatattgaaaatatctacagccgatcgaatagatttagtcctttattgtttatttgcaactgccgatagattcacatatgacatcggctcaaagataaatgatatgtcatcggcacctagccgatcggctatcatttatagatttaaccactgtttctttgcttctatttcttgttgattacaggatcaaatcaactggcacgctagcgcacccgaaggcgagctttggacctgcactagagttaagcagatctcccaggcctcgtgttttatgtcaacacgcttttggcacgttcggtgggtccactaagaagtcagccaacaatccttcctca

SEQ ID NO: 57363 - DNA, 302 bp, Oryza sativa
gatttagcaccaggggtcaataagtgcatcggccgggtttgcaacgcctggtggtcagcctgtacaacaatttgtaaaccaagttgtcccagaacatttgtttcaccacgtacagccggacggcacagtaatgcctcaggttgttcctgagcacttggtgcgcaatatccagccgaaccttcataattaccaagggggtaacttgagttatcaatatcagcctccttccccgcaagcccagtatcagccagggggattggctgaacctcggtttgcatctcaatatggttagttcgagccca

SEQ ID NO: 57364 - DNA, 1501 bp, Oryza sativa
caatacagatttcagaaggtctagcaaggccatcatacgggacaacaagaagagcatcacccttatgtttccaagggcccccatacacaactcggttgtagtcagcttcgcaagcaaactcaaccaagaatctattatcccccaaagaaccgagtctttctctgttgtgtcaggttccaagcaatactcatctcctcaaacaagcctttgacattgtacctttgtcctgagtagaagcgagcaatgatcagccacttagatttcatctcctccacctcttcaccaaggtccacatccaagacatcgtcatcttcctcttcaccatcagttagcttctttttgaaaagcaccatggcgctcgacaaaccctgatctaggttgccatgatgatcatccaagccctcaccaattggatccaagttttcgccttggtttatcccgtcagcccccgaaaccatagcctcggatctattctccttcgatgccattgatccaaactcagaacagccgccgcagtatgtacctccaaaaccctaaacttcccgacggcttcgggcaggcagaaacctcactggaatccccttagtcgcccccaccgtcaggaagagaaaagtttgtggaagaaaacagaccaccaccgtcaagacgagttgcaacaaactagggtttgcagccggagagtcaacaggaaaacgtcgataccaggcccaagaccacaggtcaagtcccagtcaaaaacagaattagatccgctcccgtatacaatacgtagcggtaatcaactcaagaaaacaaaccaaaccaatcacgagcggatcaacacagatcaagcatattggatccggccataaaccctaaaatcgcccagctctcgccctccgtgaaaatcagcatttggggtttttagaatatctatacatttgttgataaattttcttctaaacatttgtaaaatgtaaatacaatacaataatagttgtaattatattataacttacacataattacaacgtaactggtatataacttttatgtaattttgaaatctttaaatttgcttaaagattcatgcaagaggagatgaaaaaagtcacagcacgcacacaagcgagaggatttggtctcttagacctccgcttggcgaaaatagcatgatatcacaaaatttttgaaagttgcattcaacttgtatattgtagttatatacaagttacgatgtaattacattacgattgcactatatttatatccatcgaatttttgggagaaaaaatattggcaaatactcttatatgctgtagcaaaaactgttgtctttataccaatattattaaggtcgggccggggaaatattccacgtggatcgggcccggtatccctccataagcccagtcccgcgcttcccaaatacaagcaagcccagaaggggaaaacaatcccccgattccctccgcctcggggccctatcccaattcccaacggacgagacgcgtcgcgccgc

SEQ ID NO: 57365 - DNA, 1199 bp, Oryza sativa
ttcctgcagcccaggcatctgggcatagtattaaaggattaagggattatgacaagacagaataaagttcaattaaaggagccattcatacatgcatatgaagcagctgttttgtgtgagaccaaatattttacctcatcctgtgcgaagcctgaagcttccagttcagttagcagttcccttgccttctcaaagagaccacctttagaatacacctttaacaaagtggtgagtataacctgcaaatttaatttaatttacaaattagaatggcaacagtagcagaacattttcggtgaacaaccaaagagcaatatatgcaagttcagtaaagaaacaaccaatcaagataacatgtagttatagttgatatgtggagacttaagaggctttttaaaaaaaaaatttatcctggagcactacattccaccttaacccaagctatcgaaagctctattcaatacatcacgtgccaagcggcaagtaaacatggtaccacaactttgatggaatttgatgtgcaagctttctctacttagtgtgagaatgttctttccaaccatggcatttgtttagtgcttattgatggctatcatagggcagtatttgtttttcatatacatcgacaggcatcattcacagacattacgcggtgaagttagaaggcactaccgcactagtaccaaataaattatgcagctggagaaaccaacttttgcaccaaaacaccaacaccatatactatgcaagctacaacctgtatgtgctatctagcatttcaagtcatccatagcaacaaactatccaacctgtggtgtaggtatgcattatatctaatgagaaatcaattctactgccataaccaaaaagtgaaataacaagactggggtctcctgcaaatcataaaactcagcaacagagttaattaatactccctctgttctacattataagacgttttggcctctccattcttcgtctagattcactaacatccatatgcatttagacacatatgaagtacatatatgaatccatgcataaatctattagaaaacaaaatgtcttataatgtgaaacagaggaagtaaataacaagaataagaagcaaaccttgttcggtgttaaccctgaggacctcaaatctttcatcaacagatcagccttttcataattagcattttctgaatatgcattca

SEQ ID NO: 57366 - DNA, 381 bp, Oryza sativa
  unsure (1)..(381): unsure at all n locations
gatccacctntagtggaagttgagttgggtaaacggctctcacaaaataaactagatagatggagttggatttataccgtttccacgcgatacatttagaatgtaataaatatcatcctatacggtatacatgtatttgcctcaaactataccatcataccataaatttctgttaaattttacaaccttattctaataatataaactaatggtacgttggaaatttaaaagttaaacaaaatctaatcttaagcgtcgtcaaatatatgacctgaaggaggaggtgcagttcagtgaaattatatttgcaagctaggcttgttgttttgtgcaataggacaagaagtccatagcatacagagtgggagtttaattttttta

SEQ ID NO: 57367 - DNA, 1501 bp, Oryza sativa
taccactgtttaattactaattaattgatttacctgctttctcctttcagaagcaattcaggtacaaacaaggcaggccgcaaacaagcagaaatgaagatgcaagctcacagggaagtgcgctaattgacgaggatattgaaccacatggtgaaaaggaagtatcggatgatcctgagcggttaattgacgcggagaagtcaccacatgtacctgataataacaaagctgaacgcaaaccattagcagacaggattcgtgttcttgttgcttatgatgatctatttgaagagggagagatacacgaaggggatgcgccatgaagtatttcgaaagtcttgccctttcaacccctcttgagcgttaattcttgaagcaaacatcaccgaatgggaaaaagggcatgtgtattaatcgacattacagtgaggcaattctttttccaattttgcctttatatgtgcctgattgggcagtaaggcagcggatgagttttttgttgagagcagtgagctgaaacaaactcaatattaatggaaagttacggcggtatgttgggttgtctatgcgtttgcatatctcaatttctgcccccttaaaggcttgtcttgtctggataatccaaagagcgaggaattggaggggattgaattggaaataattttacaccttgtgaaggggattatccgaacatactcttatttgtgagatcaaggagggcccatgaatattacgtaggtgggcttccagtaggattctggttaaatcagagtgctcataaatattagggacaatattatacacatgcagatgtgtttttaataggatttgggatcaaggatactcgtgggtatgtgatatgtgtgcgtgtgcttgttccgtgtaatcggaaaaataaaaataaaactctatttttctattgatggagtgcattagtagtacactgggaaaaaaataaaatatgtgcatgacaaactgtcttggtggtctatattgtgaacacaacaaaacatgcattagaagcagctattttccattaatcaattattaaaagaggggaaaaaaaggagaatagaccattactgtttgccacggtgtgtatattgagggctattttgaatcacaggaataaaaaaatcaaagaaataaaaaaagggtaggatcagataggaatacaagtgaaaaacggattcagatagaaatacatgtgtaaaacagagaattaccataggaaaaacaaaggaatttgatgagagataaaaaaatcacttgattctttccatgaattttacctgatgttaaatttcccctaaaacttgcacgataagaggtattccatagaaattttataggatttaaaaaattatattagaaaaatttctatagaattaaaatcctctaaaattgatatgaattcgtttgagccaaagtcgacctgaattgtcgaccggacaatatctcttccaagagaaggaaacgccaacttcacaaaaatcacatt

SEQ ID NO: 57368 - DNA, 291 bp, Oryza sativa
ttgcagttacatggattagtttgttaagtgtacttgagaagtttggcgtttctcagaagagtctgaataatatttgcaatctgcgtacttgattggtggcaaatccagttgcagttaagtttctgttcatagttatgtatatgttatataattcagattgtatgtaagaaaaacatgaaatgtctagattgcccaaaaatcattcgagttatggataaattggtgtaggtgatgttaaatcacagttgtggtgaatagtatgtaatattcttagttttacttttctgaagt

SEQ ID NO: 57369 - DNA, 301 bp, Oryza sativa
tgatatgaatatttcccaaagtctaaagttgtaaaaccacctaaggttacctaattaaagcgaagcatctacctaaaatttatactagggataccatgagtaaagtgtccactagttgaggttttgcttgtctagggtgaacaaggtaatagtaataacaataacaataataatatggtcataacaaaggtaaataggcatggctaagtaaaacagtgataacgcgggaatttaaataaagcgataatgcaataatttaaatcaacataattttataaactgggattcaatatgatcaaga

SEQ ID NO: 57370 - DNA, 1501 bp, Oryza sativa
tggagattaggtggccggtagtttagctaaggttgttttgattacatgtaaataggatcccggctaaccaatctctgacgcatacatatatgtacttctcctcctcgccgttttgctacgatacaattaacacgaaccgtcgcaccgacgagaaaattgacatttagccactttcaaggacgggtttcgctgtaatgccattccgccaacttgcttcgctaaaatgccattcccacgctcgcgcaacacgctgcttcgccgtttttccaatttcactggattaatcccgtaagtgagttgtctgctgaccaaattgcccctgggggtccttttgtgccaaatgaagcagcaagcgccgccacgctgccgctctacaccgtcgccgctctgccgatctactccgccgccgcgctgtgccgctttgctccgccgccgccactctactccgccacaacgctgccgctctacttcgccgccgccgccgtgccgctcttatctgccgccgccgctgtgccgctttgctccaccgccgctgtgccactttcgccggcgctgatttgcggagatgagaggaaaccctaaccctaggggggctatgcagcgaaggtatgcagctggaagcgaggatttcgggatgtcgcaaggtagctcctttcctgctcggctacccgtaggatctagcggccttcctctcattcgttgccctaggtgtggcgctgcagtagtagagtgcagatcgatgaggcatggtggaaaggttttcttcaaatgcgaggaaaacgaacaagatgtgagtggttgaatttgttgcatttgcttgcttttggttattggggctaattttgtactgatgtatgtataggtgccaaattgttgcaagtttttcaagtggatcgaaagttataggaagatggttgaaggaatgagtgagcatgttgttgatgaaggtccaagtgatgttgcagtggttgatggttctatagagatgaagtggagttcagttgatgatggaaagattgataagctgataaatttgattgaagtattggtgagcgcgagattgggactgcgacggcggcgacggcggcggcggcggcgggtggaatggcgatggcagcgccgccgtgagctacagctgggtgagggcgagaggtgactgcggcggcgggtggaatggcgatgccgacgagatcgatctagggcgccgccgtgagcaagagccaacgcatctcgatcccctttctctcactgacctaaagaatgacccaagggcacattggtcacaacactcctgattttgtgtgttaatccggtgaaattggaaaaacggcgaagcagcgtgttgcgcgagcgtgggaatggcattttagcgaagcaagttggcggaatggcattacagcgaaacccatccttgaaagtggctaaatgtcaattttctccgcaccgataacgttactccatattagttttctttcatggtatcagagcctattggcataga

SEQ ID NO: 57371 - DNA, 1501 bp, Oryza sativa
gcgcgcggcgcgctctcgacgacgcagaacttgcctccgcccccacccatgggcaccagcttgggatcgccgccgaccctccgctcccgcggcgcgccgccctgcaggaacgtcagcgtctcctcgcacgccgtccacttcggcggcggcgcggggtcgtcggcggcgtcagacagatggacgacgtcgcaggcgacgaggcgggggtggccgccggcgccggaggaggatgcgccgatcccgacccacgcgtccaggtggcggtcgtagtgcgcctggcccttgaacggcaggcgccagccgccgcggcgcgtccactcgccgccgcgctcggtgtcgtaggagaaggtgccgtcctcctcgtcgtcctcgtcgccgggatggcggcgggcgtgggtcttctcgacggagacgaagatggtgcggccgtcggggtgcagcgcgtgccccgtgatgcgcctcccgccggagaatggcggcggcgaagtgctggtccgccacgaccaccgctcggtcaatctgttgcggtagtacttgtccttctcgtcgtcgtcgttgtcgtcgccggcgccgccgtacgaccttccacggccgccgcgcgccgccggtttctcctcctcctccttggggtacaccttctccactttctcaaggtagggcatgcccacggcggcgcggcccggctccggcgaccgctgatcaaacggatcaggcagcagcaagtagagcctggtcccggccttcaccctctccactttctcaacgtaggggtagggcgccatgtccacgccgcgttctggcgcccctggccatggcggccgccggcgcggcggctccggcgacggcgacggcgacggcgaccgctcgaactgaggcagcagcaggtagagcctgttcttcccggcgtccgccacggcgtcgtagctggtcaccaggtgcatgtcgtccgggagatggtgcgagacgtccaccgccgccgtcgccgtgtcgtagacgaggatgaggcgccgccgtcgccgccgccgccgtcgacacggaactgatctgggcggcgctgacccatgaagatgatcttgctgcctagggcgctgatgtgcggccacgagccgagcgtccggaaacctagccggaggagaggcgcggggaggcgccgcggcggggaagggtcgtcgccgccgtcgccggagttggcattgagatcgagcttgtgcaggctgtacccctccttccagtcatccagcaccaagtagagatggccactagtgcttccggtggccgaggcgtacgtacgcgatgtcggagagctcgcggcggcgccggcgccgccgccgcgtgcatggcggcggagtagagggcggacgaggcggagcagcatgggtgtaccgggtagatcgattttgagagatgatcaaattgggaaattatactacctccgtcccaaattatatggcgcgctctttttaagaaaaattaaacttgataattttgtgtaataattata

SEQ ID NO: 57372 - DNA, 1501 bp, Oryza sativa
ctccggtgcatcatccgctgcaactccgcggggacgacgacggcgtcctgctgctccgccgccgccgccgcctccatctccaccccggacagctgctgcttgctcctcgagaagaaccgcgcgttggatcgcgtgtgcagcgtgctgatgtactcctcctcaatgctcatggattccatggctgctccaatacaaatcaaccaaaatcctcagcattatgagcacaaatacaagaacagataaacagatgacgaaaagctcaatgtaattctgtcttttttttcttcttctctctactgatcttaccttggtgtgatgggcacatgaatttcttcgagtttcttgatcttttgggacaagcactgtttgcttttcttggagttccttgatctttttgggacaagcactgttgaatcgcctctcttatccagatgcggctttggcttggcttaaaatggacctcacctgaagcctttatacgcaagaacccctagaccctgacagataaaaatctcaagctttgtcttgtactgctaacttagctagctaagctaactaaaactgaacaatcttagctgcctccccggatgacacccctggatatcagggagccaatatctccattcctgatccccagccttaggccgtgtttttttctctctctttttttgtttctccatcatggacaattcaatccttgcactccacatcaatcaatcaatcaacggctcgccggtcatgtctacatgtcgatccaacgacgtgtatctgactatcttctcctgtgtccgttctttagattgtgtgcaagcatttcttggtggtttctggtgtgatcccagagagaaagctgacaaggaacataggtgcttcgtcaggtgtgcaagttggcctgaaacggattgggtttctctttggtttgtagcactgtaccaacacacggccttccagttttgattttctgtacgtgctcaggtactttgtggtacaattcaattgtctcgtgttcagaacgtgtttgttcaggaacaggctggcctaatgaccaaagaattggacaatgtattgtatgggacagatgatcgcttttcatcaggtactaggtttaattggcacgtgagaagaacaggtagatcaagatgtatcagatgttcagatcatttttcaggattaaaaccctgaatatattcttactactgaaggcaacagacattgcgttaataagagacaaattttgttgtgaaacccagggggaagtctgcagtctgcagtaaatatatgtgcgaaatctatgggctactagtaataccctggttttgcaaacaacctttagctagtggattccatgctgaaattttaatatatatatttgttttctggtatttcaagtggttgccacattggaaatgcattgcgcctgttcttgcttgcacaggaggacgagcatctatctttgtggctgatctcaaaaacaaacaagctatccccaacagatttttaa

SEQ ID NO: 57373 - DNA, 1501 bp, Oryza sativa
cgccgccgcagtcacctctcgccctcacccagctgtagctcacggcggcgctgccatcgccattccacccgccgccgccgccgccgtcgccgccgtcgcagtcccaatctcgcgctcaccaatacttcaatcaaatttatcagcttatcaatctttccatcatcaactgaactccacttcatctctatagaaccatcaaccactgcaacatcacttggaccttcatcaacaacatgctcactcattccttcaaccatcttcctataactttcgatccacttgaaaaacttgcaacaatttggcacctatacatacatcagtacaaaattagccccaataaccaaaagcaagcaaatgcaacaaattcaaccactcacatcttgttcgttttcctcgcatttgaagaaaacctttccaccatgcctcatcgatctgcactctactactgcagcgccacacctagggcaacgaatgagaggaaggccgctagatcctacgggtagccgagcaggaaaggagctaccttgcgacatcccgaaatcctcgcttccagctgcataccttcgctgcatagcccccctagggttagggtttcctctcatctccgcaaatcagcgccggcgaaagtggcacagcggcggtggagcaaagcggcacagcggcggcggcagataagagcggcacggcggcggcggcgaagtagagcggcagcgttgtggcggagtagagtggcggcggcggagcaaagcggcacagcgcggcggcggagtagatcggcagagcggcgacggtgtagagcggcagcgtggcggcgcttgctgcttcatttggcacaaaaggacccccaggggcaatttggtcagcagacaactcacttacgggattaatccagtgaaattggaaaaacggcgaagcagcgtgttgcgcgagcgtgggaatggcattttagcgaagcaagttggcggaatggcattacagcgaaacccgtccttgaaagtggctaaatgtcaattttctcgtcggtgcgacggttcgtgttaattgtatcgtagcaaaacggcgaggaggagaagtacatatatgtatgcgtcagagattggttagccgggatcctatttacatgtaatcaaaacaaccttagctaaactaccggccacctaatctccaactcatatggtttacaatggataagcacatactctaacaggcggtagccatgaacgccagccctacacaagaacgctctgagcaaaacacaagaacacaaataaaaaagactacaagaatatggattctaatctcttggtggacgtccacccgttttttcgtgtcaactaaatggttatgaatttttttaaaaaaaattaacaagatagattaatatgtaatatatcactttacaaatatgtaagttcatatttgacttctacaagttgtaacaaaaaacttttttttaagttgtaacaaatatgttacaagaaacgggtggacgttcacccaa

SEQ ID NO: 57374 - DNA, 1501 bp, Oryza sativa
aaaaaagtacttgaacagtgttgcgcagtgttgggcaggggccaatcgaacttccaatgttcaatatgtcccgcatgaacagtgttgtatagtgattgttctcttttttaaaatttttttatcctatcgaattgtggttgtttgatatgtacccctatcgaactataggtgctaaatttatgattttagctgattaacttctattttttataattttttattagaataatattatttctctaaagtttcagtttcatgttcttaagggttacttctttcgtctcaaaataaaatagcatatttcattcagtactaagttgctttattttaaaacggacaaagtaaggaagataatcaattagtggatgttcattcccgacgtcaagtagatcgatcggcggtttcttcgacggactctgaagcggagcaaggcatcgtcattcatacgtacatatgtattattcttgtccataacacaaaagatacaaacacagagcaagtcatatactatatctactctctccgtttcacaatgtaagtcattctaacatttttcatattaatattgatattaatgaatctagacatatatatctatctagattcattaccatcaatataaatgtgtgaaatgctaaaatgacttacattatgaaacggatgaagtacacaataaacaaatacacgctgactattttttggtgaaaaatatggcaatatagctactctctaaacaaattaaacggcgaccaccgcacaagaccttgttggacccacccacccagcactatactaccaacggccatctccatcgcatgaaaacaacatagcatcagcaaagaatcaatgattgattgatcgatcgatggcactctctatagactatagactatagagggaaaaaatcttctcgatttctacttactcgtcatgccatatagagaaagaaaggaacaaagaaagatatttctccctctatttcatattataatttatttgatttttttataatcaaacatttttaaatttaatcaagtttatagaaaatataatattattttcaacacaaaacaacatattaccaaaatatatttaatgttagatttttttagggaatatttaatgttagatttaactaaactaatttgatattttaaatgttgctacattttttttataaacttaaccaaatttaataaagtttgattagaaaaaatatcaagttgacttataatagtaatcagaggagtaccatacacgggcaccgctagagtgaggctcaccgctcacacaacatcacgaaagaaagaatcgtgttagcctggtcgttctttcgatttgtttacgtccacatgtgcacaagttggaacctcgcttttgttgtcctagatctggcacacaccaaccgatgtgtagtgtagctcaacattcgcagcatcagtgtgcgtgacaaattttcaggagctaggtgacatgggcgacttgggcggcggcggcgaga

SEQ ID NO: 57375 - DNA, 1501 bp, Oryza sativa
tgtacagataggcatacaacataaactaaagttgatacagtcctttcccgcaaaagaagttgataatagtcctgtccataccgatattttcgggttttttttttacttattttctcctcgaattgttgggctagtttgcaaaaaaaaagtacttagattgttgggctagtttgaaaaaaaatcctcgtatatattcaaaacctttcatagttgtgtttatttttcgaaaaaaaccttgtctataatgcgaagagaaaatctcatttctagtctagaaataacgcaataaacacgaaaagtatataaaattttccgcaaaacaaccatcgttggagatatagggtctgtggtcgtgttgtagatgacatcaatagtgtcccacacacgcagcggcggtgtagccatagctgcctgcctatcgatcaggtccatatttgtgtttctgttgaaaagtttgagaaaataaggttaaataagttagcacggtcacgttaccttcataaaataggtccagcagaccagcttttcgttttttaaaaagaggagcaagtgagctacaactcgaagaggcatctaattcaaaatagggtcgaaagcgtagtgcaagaaaaaaaaaagtttgaattaggtacctacttgcgccctgcgaaacctccagagacgtaaagttaacgcaaacgtttgaacaggctgaccacaggattaaaatcgaacggtcaatactgccacgtaacagcaaccatcagacaaagatcggacggctaggaaggaaccctagcacccgtggctgcctatataagaagcaatcctctcgccccaacccctcccttctcccgtctcatcccagccgccgccgccgcagcctcctcctctcgtcttctccttcgaggtcagcttcagatcttctctcttctccatatttgcgcttgttcatgttcgttcgtagctgcagatctggtttagtaacgtgaggtttcggtgatttcgagctggggcatgttgtgttcgcccattttttgtaacttttttctgtgtattcatctcactgcaatgatcttcgtctgctgttcgttgacgcgacgataaacttgatttgtcagtgaatcatctgcataggttgaaaattatcggcagaatcggacgatgaacttgatttggtgcagaatcatttacataagttgaaaattatcggtggaatcactagaaggatttttatctacaatccgttcgcatagatctctttccgtgtttctgtaattttttttattctactactgctgagtagatgttatcgtctgtacccggtttggttgggtcgattactgcgcctctgtgcaaatcatccgccgattagctgcgttagcacttttatagctgcccaagtttgatctgtgagcttgcctgctatatttatttagagttgtaaattatacacttatctttgtttctaatatttgtttcgttctgtgctgcagttgttagctccctccttattcaacca

SEQ ID NO: 57376 - DNA, 185 bp, Oryza sativa
cagtgcacaaactaactaatcatcattgaaatcctacatgattgatgtacatgccaaacatcttgaattctcaatacgatacctgttcgatggacggtggtggttgaaaagttgtgggctatgaagggcactatttgcatatgcctgcatttatgatttttgggctgatctcataatgttcaccc

SEQ ID NO: 57377 - DNA, 214 bp, Oryza sativa
ccgcgcatgaaaaacgaagcggtccattagcacgtgattaattaagtatttgttaatttttttcaaaaatagataatatgattttttaaagcaactttcgtataaaaactttttataaaaaacgcaccgttagtttgaaaagcgtgtgtgtggaaaacaagagtagggagttggaaccagcttaaatcttgaagtcggtatcctgctccatagt

SEQ ID NO: 57378 - DNA, 588 bp, Oryza sativa
aattcctgcagcctagtattttgctaagaccaagaagcttgcatgcagtttattttcttcctgatctacccctattaaatgtagatagttcaagcacttcctttcctcatgcatgaaaccaataggtcaatttaaccggggtcagattgcacacgcaactaattcgaccaatacctcctcgctcgcatgcatgcatgcaaattagccgggcacttttggctgaaagccccagcatgtcctgtgttttgggatgttaacaaaaaagtaatatgtgccctctaaactgggatggagggagtaattaacaatatgtggtatatatacctctatgtactcttcccaagaatcagaaatgctttgtcattaccaatcatgaatttatcttctaatcagtttaatcaatttatttttttttgtcactagaacaatagggaggtatatacctctccaaggatgggagaatagtagaataccaacatttagaaatatggataattgctcactctttgattaaaattaaaaatgatctttgatctattcacagaatcccactgttgccattttttcctggtctctcaaatttatagg

SEQ ID NO: 57379 - DNA, 994 bp, Oryza sativa
tggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgagcatcgttgaagtggtggttatgctggctgcatttgagatatcttagcgttcgttaagttttgcccacggccatggcactcgttgcatggaccgttaatatctgctcgcaatgtgcactatgttagtcgtttaaaactcgtttatttctattcggttaaaaacttggatgctctgagtcttattgttgcccttcggttgttgtggaatgcgagtacttacagtgctaaatcctttgctctttattttcgattgtgctatttggtgaaaactgaaagctcttttgcttggtgaaatctgaaaactcttggtacttttgaaatctttaacttggtatttcaattgtagagattgaaaactgatacctaatgctacccaacggtgtttaattgaagctctttttgttccaaattttgtgctgattggaacattattta

SEQ ID NO: 57380 - DNA, 1501 bp, Oryza sativa
ctgtggtcgtcgccctagtcttccgctgtttctcgttggtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcagtattttcgaaataaaaatcctctgttatttgtgaaaaccctctagtctttctctgtcttgctgcttcatttatcgccaaaatctgattttttttaaaaatgttgcttttctttttggttttgtttggagatggccggcagcgtcacccgtcgtggtttggacatgactggtttcgtcttggagctgcggggcatgtgcgttgtcctggggtatccacatggagtggactaccagggcaggcccgttccggagcaggaaggtgacgatgcagagccccacgctgcttgggaggccactgcagtgatcctcgctggctctcccgagcggacttcgctggcagtcaccgcgggtggagattctttccccgccgcttgcaaaagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgtcgtggcatggtggagaacaacatgaagatcctggagctgcgtcaggagaacttgcagctcaagaaggacctcgacgcgatggaggcgcagctgcaccagctcaagatcgcccagggagaggacagccgtcccaagcatcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgcctttttgagttgtgtggggcatggttacacaggtgtgtggtgtaactatgtcggagcctgtctttatttgtttgcctaagcaacttgaactctaatgaaccaatttaatagcagtgataaatttaagaataatagtagtcgcgggtggttagttttaatcgtcagctctctttctctgcttgctggttctgtgtggggttttcagatggtgacgaccaggagaaatgttaacaccggtgaaggcaaccaacccgagg

SEQ ID NO: 57381 - DNA, 601 bp, Oryza sativa
ttgaggccaaatcataggtatttagggtgtgtttagtttcacgccaaaattgaaagtttgactaaaattgaaagtttgaagaaaaaagttgaagtttatgtgtgtaggaaagttttgatatgatggaaaagttgaaagtttgaagaaaaagtgcgaagggagtagtattctatggccaagtttagttccaaattttttcttcaaacttccgcttttctatcacattaaaatttttctacacataaacttctaacttttccgtcacatcgttttaatttcaaccaaactaattttagtgtgaagtaaacataccctatgaatggacgtggaattatttttcttcattttcctctagccggtattaaaaaaagaaaaagaaaatccccacccaaaccctagccccgcgccgctccctatccctctcccgcctcctccccctcgcgccgtcgccatcgcctcgcgccgccgtctccgagcgcctccgcctcgtaaaagtcaaaaccgtgtgcagccctagaaagccgcacaagctgcaaaaccctcctcgtctacccttccctctctgctcgccgccgccgccgccgccgcacgccttcgaaga

SEQ ID NO: 57382 - DNA, 359 bp, Oryza sativa
ctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcacca

SEQ ID NO: 57383 - DNA, 389 bp, Oryza sativa
  unsure (1)..(389): unsure at all n locations
cgcgtgnaatgataactcattgtacanccaattcgtttggagctctcctgatcctagcttatcgantccttacccaatggctttgggcaactaagtggcttttaaatgctgtttactgtaaaacttaatccctatattattattcgcttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatatta

SEQ ID NO: 57384 - DNA, 204 bp, Oryza sativa
aattcctgcagccctgctatcagctgtgatgaccttcagctctactaataaaacaatccagctcttggagaccagtagtagcttgacttctgagtgcagaactcgtgtacctgtcgatactgactacatcgtcaaaagttgatggcttgtgcaattttaccgtagtcttaactgtctgtacttcatgtccatattgcgttcagt

SEQ ID NO: 57385 - DNA, 341 bp, Oryza sativa
cctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagt

SEQ ID NO: 57386 - DNA, 852 bp, Oryza sativa
actacatgcccgctatatgtgcatgcagtagcctatcttcctactcactagcattctcccccttcagatggccccccttttttttttttttttacctaaaagcggttttttttataaaataggcttgacatgagttttcttctaaattatttatattcaatttacaatccgattatatcttgaatttattgttattaaatatgtaaaaaaagatatcacataattatattcttatgaaagatatataaacttatgttttaaccatgaaaattcatgttcatacgcgatactgaaatgtttcaacatatgtttcacataatctttcagtatttcaatcactattttttttaatgtttcacctgtggacaacttaaacatttcaccccccccccaaatttttttatggaaattaggtgcctggtatcaatttcatgttggtacttcctcccgttccgtaatccttgatgttttggataagattgagatcaacaattaaaactttaactatcaatactcccttcatttcacaatgtaagtcattctaacattttccacattcatattgatgttaatgaatctagacatatatatctatctagattcattaacattcatatacatcaatatgaatgtgagaaatactagaataacttacattgtaaaacggaggaagtaacttttaaaatatctagtttgaagaaactacaacattatgcatagattaattttgaaacatgcattaataaatttaaataatataataaaaatatagttaaaaatatgttctcgagaccgtattattgtccaacacgtcaagaaatataatagaactgaggggagaatttagtcaga

SEQ ID NO: 57387 - DNA, 707 bp, Oryza sativa
tgtgcataggatatgttgccatctccgtaacccttatctatagtgtactctagtcttttttttttacctcaccccttaatctccataaaaaaacacccgacattgctatatttcgagacgtttttatacctcaccccttaatctctgaagtagctatattttgagacggatagagtagttggcaattattttttaatttgagagtttatatgcccaaatgtatgttagaagtgcttaggtatgtttggataaaatatatttttgaaatttcataacaactttggatggagataaactttacataaaaggttgtacggctcgatgagagctacaactacaaaggttgatgccattttcatctgaaatcacttattagaatgtcaagttctcaaactattaactattgagagtctagtatagtatgccagcaagaagtgtcttacacagtgagacgataaggatattacatatggagagagggtatactggatttgaatcccatgcaccatgcgtatttcacaagattgcgtattcacctaaacgactacgaattcaatcttgcaagcaccaatttctccgtgtttactctttctttacctcgtgaaaacaggcaatcacacgccctgcttctgtctacagcatggttacccaggtagtcaggttacgacggtagacactcgcatttcgttaccgccttgcaaagtgaa

SEQ ID NO: 57388 - DNA, 320 bp, Oryza sativa
caaaatgaatctgaacagggagtctataatgaatctggacattgtaatagaatgtgtcacatctacccaaaatatgttatatgttgggatggagttagtagtttttatttcctgttttacacttgcattcgtatcatattactatatttttctatttctatattttcttaactctgcttaaaggagtcgtaatgtaagtgttctttaaaataaaactagttctatcagtctttcaaaaaaaattctaaatttgtatctgtctttcttagcccataaacaaaattttagaaaaaaattttgttcgcgctgagctggctaaa

SEQ ID NO: 57389 - DNA, 943 bp, Oryza sativa
  unsure (1)..(943): unsure at all n locations
ggccgatgcnattttgataacccctcattgtacnncccccttgctttgatnacaccccttttnnnnnnnnnnnnnnnnnnnnnnnnnnnnnnnnnnnnnnnnnnnnnnnnnnnnnnnnaaaaaaccacagggcccatcattttatactcttcctgaacctctaggctcacatagctcgaaggcattatgtcagacctcacctacggaaaagtacaaaaaaaaacaaacagatcaagcacccaaatataagcttacgtcctttataccttataagtatatataaaaaaagaacaaccatcaactgcataaatacattgccactctaaactattgagcaattactacagttcccccacaatggctgcaaattttgtatgtacgataaattgttatactaaaatacattttctgaaaatggttgttcagagataatttttcttttttcatttcagctgtacagtcaaattttgtgttgcacatcatccagtagtttcagaactctgtttcttttttcagcaccactggagaatatatgcatttgtgtatttcacaatgacttcggttacatgctcctctctgataattctaccattgtcgaaacccttaaaaaaggaagatccgaaacggagccaggtcattgcagcttattaagacctatttgtagtcagatcgttgccacaattcctgaatctcttttgcaggtcatgtggattcctatggacataatcaagttagctgacaaactagcaaaataagccaagtccaatgttaatgcagcccctgtctatttttgtcaaaatatatcgcatttgtcttatcctaccagaagatgtcatgctaaatcatatctaaatatcaatggtcagttcgctagggcagcaagccatacatgcacagcaaaatcaatttaatattgttcatatttctttcaaaaaactattgt

SEQ ID NO: 57390 - DNA, 1179 bp, Oryza sativa
ctccacccctctttatatggcacagtgtgacgggggcccaccagccattgggctgggcgcccccgatcagggcgcgggtcaaggcccccttgagccgttgggctcaaggggagggagatccatctaacaaaaacatcttattactaatacgtacatcctctaggtttctcttgcttaacagttatgattatttcaagcgcaaaccaactctatagcatatgcatgagccgaaccggagttaaaaaaaacgttcattatcaaaataaaatgactatatgagaatattttaaggagtaaatatacgaccggtcttttaagacagtagcgtagctaagatttaaagtaaaggtggttcatctatatgtaatatgtcaatttaaagggtggtccactatacaatttttattatattaactaacatatatactataatttcaaatttttaggtggtccatagaccacggtatcacctagctggctacaccactgctttaagttgtctcgacccctcttacctatggcgtcaacgtgtcgaccggtctcttcatccctatgatcctccaagttttaaggtatagacaacctcaagttaaatttgaactataacaaagattgtctggtgggagatccagtgccttatcggtggcgcaccatggttgtgtgacactgatgtggcctatacaactaaatgatcgattttatatagtgaatgggctaaatgaaaaggttctgccagggtggatggccatgccaacgctttggctctatcaattgcactttgtacctcacattgttaaatttgtaaaccatggattaaatagttcaagtactaaaatatctcgtgacaaatttaaggactagccatgtagtttactctagctactttaaatttaactgttaacttttcacagcaataacattttttagcccaagtttcattatatatatctgtgcgtccccgactggtaacaggtgtgcatcatgggatacgtatgaattaatacgccagcttttcaaaacgttgatagttgatccagacactgcacacagaacttggtactcgatcctactttcccaagttcctagtgaggctaggaacgtgattaatacggtcgtgccggccaagcaaaaccaagtgatccacgcgatggttgcacgtacgggtgcaaggaaccccca

SEQ ID NO: 57391 - DNA, 1501 bp, Oryza sativa
gaagctgatccacatccaccggtggttgtcgtgcaggcaagctgttcgacggaatgcatctttgcttgtcggaacaaggatccccgcggacccagtcgccggcggcggtggatcccagcttggacagatccggtgtgttgcttaagtcctatgtgttattgcatacgttcttggttgtgggtgatgtttgctatggagcgtgacacacccggccggtggctcgtgcaggtgtggtgctcggcggaatgcccaagaagatgtcaaggttggagttggacgcgggggtgtcgctgtgggcaggccttcaaccggacatactgggaatcgtgctccacttccttccatgccttgccgaccgtgcgagggtgcggtcagtatgccgtcactgacgagccagcgcgaacggccacgtcctgccaccgccgctgcccctgctggtgcttcctggtttcaagttctcgagcctatcagacaagggggatttcatgcctgtgcggtgcgtgccggtgcctaaggaggttgcagctgatgatctccgatgtgtgggttcttttcatggatggcttgtaggtgtgactcctaacaaggatcgcagcgacgagtacaacagagatgccgatggtgactgcttcctggtgaatgttttctctcgcaaggtcattcgcctaccgcagctgtgccatatgcgttacaattttcctgcttactccagtaagaccctccgcatcgtcaatggttctggtgaggtccattttggtgtcaatgatatatacacaatgtcactatgtaatgtggcactatctgcttcacctgagtcatccaagtacattgtggctgcttcctcagaccacaagggtgcaccagtaccagctctctggcagcctgggatgatttcatggcaggtttgctctggagttgaaattgatggcccaagagatctctccttctaccaggggaagctttatatgctcatgaggcacaggacacgcctattcacttgtgaacttgaggaggatgatcgtgggttcatggtctctcgtattgagctctctctcactgagctgcctcgcaatcatccctaccaggaaggtggtgcaataagttgcaatatggttgtgtggcgtggagagctattattaatcatcagacactacaatggcgattaccgtaagagacaacttcataaagttgaagtgtttgcactggatgttgacacaaacccttatggactaactgagattcacagcttgaatggtgactgtatctttgttggcttaggtggctgcaagtcctttcctgctggtctacatcatggagttgaaggtgaccatatctactttgtccctgatgattggaggccttatgatacatttgtgtatagcatgagagatggtaagatgaggtcctttgccgtcaaactattagcttccgaatttgatgtggaccagttgagtcgtgatttcccggtgtggttacttcctaccgaatgatgctgcgcagc

SEQ ID NO: 57392 - DNA, 1501 bp, Oryza sativa
gctccggctgtacctgacgacgcgcggatcggagaggcactggcccctggcctggttggcctgatcgcttaggtacattttgggtttgttcatggtttgatggttgcagcttgggattatacatagagactttgttttgaatttggggggcaatttcctaaatctctgggtgttagggtttggacctccaatttgggcgtggaatcgctacgatttgtgctgatccgtgcccgatcggtagtagtacaaaataaacagggccggattttgaattgtgtagacgagactgctgactgcatgcgttgtattgctctctggtgcgttttttttttctgggatttcgctctcttgctgcatcatgcatgtagagttcatgcttgcagcgccgggtatgaattttcactgtctgccatcaattttgcatatgaataggtggtgaggacttctgaatttgctacccgggatgagatgagctgataaactgtgacattttagggcattcaatctgcctctatatagggtttgtatgactctttaaaattcatgcaaccatgccatggatgatggattgtattgcaattactctgcgcgtacagatgtactagtcataaacatggagatagtacctttggttcacgatgcacaactgcgagatcgatcaatgacctcacatcacctcaacatatcgttcatgcaacttaaacaaaagtcgttgttaatgtatagcagtcgatcagtcactggttgatttggttcaaaatattgtttatgcttgttatcatggagtttgtatatctgcaacagcctatgcctaagttcatcgtatatgatatgttgcacataagattctccatttctagggcttttgtatgctttttttaataggattaatgagccgagcaaatttctgttgcagatttggcctggtgaaccttatgcagttttctgttgcagtgttgctgcaatctgatactgggtgagttgtatctgctattccttttcctagctattttcaagttgcagtgttgcaagatgatagctttgtttttccatgtttcctttgtgtcacggcggcatctgagcaaggcattcaacctgagacggcaacagcggcccagcagcaagatcgaaccaaaaggatgaagcggcccaacacacgcttcccgttgagtgagtggacccagtagcgaaaggctgggccactgtcagtgagagagactagatggagcattgctatatagttggcaggtgcgagagagcgggatatgaaatattgtattcaaactgaaacctcaaactcaattccaatctccctcctgctcctctgcttctcgtgtctctgttcttcttcttcctcaagccagcttcttttcccttccaattcgagtcacaggagaaagttcgttgtgactcaaatctgagttcgtgacatttggtatcagagcatcgatcctggagaagccaaggtacacgtcccatttgcaatcgcaggttgaggcca

SEQ ID NO: 57393 - DNA, 1501 bp, Oryza sativa
tccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgctcaacacatgagcctcgtcccaacacatgagacgcgtcacggcaaagcttttcgataacctcgcattggcagtatccgctccatgaacttaaatcctcatgcactctaggtgtccatgtttctagcagtgtgaggagttctggcgctcccggaaaagagaagtctcacacatattaaattatggttcaagttaagttctctctcacacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatccttcgtccaccccagtcgaaaacaattgtttaattttatttctcctttcacaaatcatgtcatcaacatcatggcaatgtggcgctcatgtctccacatgccgcatctcaattaccttcccaaaagtaattgcccaagcatcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaattttacaattgggatcaacatgttaaagaaatagtgatgacttgccttgctcaaagtcttgcgggtcttggccttcacttggatccgcaactccctcgggctctatagttacgtgtgaaaattgatttgaattcggttagaattcaaataaaaatccaaataaatccaaatggaagtcgaacgcttaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcgcaagctaaatatcggacggaatcctaaaattatcttataatattatacaattaaattttagtctaggactaaacgactaaatataatatacgtctaaaattcctagtgattaaatccgaatttctaccgtaaatcaattacttatagagattacccaaaataatctataatag

SEQ ID NO: 57394 - DNA, 1501 bp, Oryza sativa
tgtggacacactcattctgcacaggattaagagactttggttttctcaagcagtaccaccggtttgcaactgatgataagctgtaattcttataaaccatttaagattaatctgtgcataaagatttttgtatatggtttttaatacttaaatggcaacgctggaaaataagctacgaagaaaaacaacaatatcaacttagaatagtttttagtcggagttgataagctgaagaacaaacgatgaagatgcctgtaagattgttggtagggtcaaatccgtaagttttgataggataaggttacatgtcaattcaattgaagccaccaaacgactaggagggcaaactttgggaccaaatcacattagtcatagggttcatatgcccggtttgagatagttgtaagttgatggataatttaatttttgtattgctatttaatggtataaacgaaagaaatattgaaacgttattgttgaaaagcactccaaaaaaaatttatgtagaatgttcttttgcatgaaatatattgtttaagaacttgggaagtgtgcaaacgaaattctaaaatccataatcaacgtggccatagttccgcataagagattgtgcaattttttttcatgttgtatatttaacgcatattctataactttatacaattatatcggttgcaacggaataataggaaaagatgcacagatgggtttcattccatacataaaggctgtgtacgcttttcaaactgttaaacggtgtgtgtttaaaaaaaatatataggttgctttaaaaatcatgttaatccattcaagttagttttagttaatagttaattagtcatgcgctaatgagctatttcattttccgtggcggagggatatgttcccaaccaacacaaactaacacaacctaaggctctgtttaggtcccacgcaaaaacttttcacactgtcacatcgaatgtttgaacacatgcatggagtattaaatatagaaaaaaaaaactaatcacgtagattacgtgtaaaattgcgagacgaatcttttaagcctaattgcttcatgatttgacaatgtggtgctacagtaacatttgctaataacggattaattaggcttaataaattcgtctcgcagtttacagacggaatctgtaatttgttttgttattagtctatgtttaatacttcaaatatgtgtccgtatatccgatgtgacacgccaaaacttttcgtcctgcgaactaaacagggcctaagtgtggtacaaaccatgtacactctactgcccttgtagcttcatctgcaagatcacgcacatcagtccatctgcaagaacgcatttttgggtttttatttccaacgtttgaccgtccatcttatttgaaaaatttatgaaaaaaaaattaagaaaaaaagtagcgtataaagtatttttcatgttttatcatctaataacaataaaaatagtaataaaaaataaataagatgaagagtcaaa

SEQ ID NO: 57395 - DNA, 1501 bp, Oryza sativa
gaatgtgatgtcgttgcagaccgtgaaaggtccacagaaagcgtagacatcgcactgcgatttgggtgccgtgaagatggtttgccaatcccgcgacccctcgaaccacacaagcgccttcagctggccggagacatccagtatggtacgtgatagcaccgtgggatctgcaattgcatactcgatatacttctcttgctcattgcttgtaaaattcagtgatagccatgtctgtcctaccgtctccggtatgttgctgaagtaccggccgttccagtctccgctggaccaatacggattcgaggagttgaacgtggagaccatggaggtagggccgttgtgtccgagcaactcgaaggaatacatgccaggagcttgatcaacggtgttcttcctggagacaagacggcggttcacaccggtggcgttgttccagccgatctttccaccctgcagaacagtgtctgtcgggtgatcaaagctttgccagagaatggtggatgatgcattggttgtgctagtgctacgcaggacaaggtttccatcgtccaggagaacagcatgggtggtgttggttgggatgttggctttgctggaccagaccatggaggagttcttggcatgggtcgttgcaacgatggcgaggttgccatcgctggaaactaggagcttgcacgacgcgagatccgcgacagggttttcgccgttggcaacccatacaggggtgaatttggggacggtgttgaaccagatgcctaggtaaatgttcggagtgctattggaggaggacttgttactgtcggtttggaagaagccgagggcgaacctgccattgctggacacgagcttgtcgccggcggcgagctcttgtcccggtgagatggcatcgagcgttggctaaagaatgggagggacatagggagtagccatggtaactgagtcttttataacatccaagatccaacttgacgttattgtttgtaaatagctagtccttaagttctttatgacatccaaattgatgttcatagtatgaatcttgtacatttaatgtactgcaacttgtactcctacttgatactgcaactggattatattaaacgcgacagttccatcagccatcacaggagaaaaggcagtgatactgcaacttgtacatgattgcaactggattgtaaaaggacaagtcagtcgttagtggcaagtagagagattctttttctcaacatggaatagttggaagttgttttccgagtattctttagtctttcctgtaaattattttcaaatcttctgtggaaagtttcttgaatcatgacggtcttttttaatcatatctaatgaaagttgctaaacataacttttttttaactattactagaattgaagcgtgtgaattcacgcgtttgcgcgttagactacccctgtttctttggtctttggtttgctcgatcagtgcacagctggatgacttctggtcggcatgggtctaacctgtatt

SEQ ID NO: 57396 - DNA, 1501 bp, Oryza sativa
aagccctttgaatactgagccaaaaccacctgcccctagcttatctgaaaagttttttgttgcatgttgcagatcagcatatctaaatgcaataactccactaccactatgaaaattctttcttctgtgaccaagcagccaactcttgttccttgggatcttcgctatcaagaagagtgccaaagcaaaggaagcaacacttgcagtgatggcaacgccaatgaatattgatcgtccactgctttttatactttgcacctctttggcagcaaggcgaaggtaaagaattgctccatcagtattagcaatatcaccacattgtagctgtttcacattaatcaattcatcattccaaacagagcatccagtattaccatagtaatatgctgtgcaagtgcagttgctcaggcaaatttgtgcacatccacctgcacttgtaacatcttctatgatttggccattactgggtaatccaacacacggcatagggtggaacctgtcttgcatactggtgtttctgtttataccacagtctaatggagtatttctcacacagccgcctgttcgatcatctagctcccagtcattgggtgatcgtacagagaagcccttcatacacttgcagataggaagcttgctctcttcgcagactgtgaaagctccacaaatgccatacacatcacactgctttgggttggtgtaggttggtacccaatcttgcacatgctccacccacaaaaatatcttggtctgaccagagatgtccagcataaaacgcatgatcgttgcgttatctagtaaggtatatgtgaagtacacttcttcatcattgttgacaaaagtaaaatcaattaagcgttgacctgtcatctctggtatggaaccaaagtaatgtccgttccattctccactagaccaatatggtatagaggagttgagagctgcaaggatgaacctggtagaaccattgttgtcagttaactcgtaactgtacatgccagaagctgggtctacagagtttttcctggaaacaagacggcggtttaagccagtgaccttgttccggcctagcttcgcaccggcgagatgggtatttgttgggtagtcaaagctttgccacaagacaaccgaagaatttgaggtgttctgcaggacaaggttgccattatccaatagcttgaccattgttgtgtttgctgtgatgtcagcttgggttgaccagaagatggactttgtggcctgatctaagatgacaaggtttccgtcaccggagattgtggcctccggcgaagtggggccagtgacaggctcatctccattggcaacccatgctggagtgagctttggcacctggttgaaccatatccccaggtaccagtttgaagcattgtgggaggacttactgctggttgggaagaagccaagcgcaaacttgccgttgctggagacaagtatgtcattgccggcgagtgtctccccagctgagatggtgtctgtcacc

SEQ ID NO: 57397 - DNA, 1501 bp, Oryza sativa
acgaattgtttgatcctcgtttcgcttggaatggactagggttccggtagaaattggcgcgcgcttgaggagacaaaggttaatggggatttagagttcatctctcacttagcagtttgtacatttcaattttcaagtctacagttacataacgttgatgcaagtattttttggctgatcagagttacgacgaaattagattattttggggggtgatatgttccaaataccgaagactgattctgattgccgctgctgtttgttggaggaccagaagacatctcacaaatatttttggggttggcatataatacattattatgcagtctcgtgaggtcttaatctccatttcacaagaagaatcctgtaaatgatgcacagctgttatctcgtctcataaggtatatttaaagtgctatcctcttccattgttgctaaatgtacagtttggtgctattgacataacatggctaacatcaaattgagctattgatcgatcccttcttgttcaagcagtgtgtcttggttcagtaaaaaaccaagtgtggctggggagatttcagttgtttgaggatgaccttactcatgatatattccaggtacaaggttgacaaattcttactgggaacaacacaattagacagcagtttataccggcaagcttgttctaaataatctttgtaccggcgagaaatttacttatcaggtgctcaaagctgtgccacagattagcagaggactttggtttctgcaggagacttggattatcaaatcatcactgcttttattttgacagattagactccaggcaactactgaagggaagccccaggattacatcagagctactttcgtgtcaagaatgaggtgcacggtgctctattgtatcttacagttggcctgcctcttctgaagcttggttcaggtacccatcaactacctgcacatataacaaaaaaaaaagatgcagttaggagtgctggcatggaatgttgatgtgtcatattcttttatgatattatacaaaatgatgtcatggaaaaatatcatgctcttatcatgcctctcagccgcacatatatttctgggattatgataagttctcaatttaagatgtttgtataagaaaaattctgcttagtgctcactttgaatatgggttgcctgcaatagcttgaagtagtcgtggcactgggggtatgccaacttcaagaagaccttcgagatattgaacaacttcactcattgtaggtcgatcaagctcattatcttgaatacaccagcatgcaaccctgaaagctctttctacctgctccaaatcaacatcgccatgtaaattttggtccaccaaactcccagcattaccatccagcagcttatgtgccactaacagagggaaatattcatagtcatcacgagttgcaaattctttgcttgagttcctcgttcctgagatgatttccagcaaaaccattccatagctgtagacatcaacctttga

SEQ ID NO: 57398 - DNA, 1501 bp, Oryza sativa
acgtatacctacctagctactttgccaatgttataacagctagccgtggcggacttgcacctattcttaatttatttttgtactaaagcagatgtatttaatcaacctgtaatagtagtacgttggaggaaagatgcaaacaacatactcttttcattttaaaatataaatatcgacatcgtcctgtcatttccgccggcgccggagctatttctcccgtcgccgatgttgtccaatcttcgccagcccgcgcactacagcgggtgagtatccaagcaccatatacccacatatgcatgcacgggtttgcactaaaacgggctagagttcgccatgcactagcatgccaaagctcaccgccgacactgatttcggttatcactgtacacgagaccaccaccattagcttcgcaatcctccactctacaaatcctctttggccgcacctcacgaaacccccactctacaaatcctcttttggccgcacctcacgaaaccccgttcaccgctggcgccgatgacaagcttgccgaccaccacttcctctgctccttctcacgccgagtcattgccatgtaggtctaagggcattcctgacatttcacatgatttctctctcctcttcaatcggaaattatttagtcagcacggtgtccactggcaaaataccatgattatgaagtgtccccccaaaaaaaagttagtattttgcgttgtcttagggttaaaaccatataatttcagcgtcctgtagcaaaatttgtcttctagtagtagagtcaaagttttcatctagggtccgtttatcatagatttcacaattcttagtttagatggttaatttgtcgatgatagccgtgttatagttttcacttttttctttaaaaaaagattaaccattttattgtaaatgttattgtaaaggctggcaaaataccacgattatagattgttttctcccaaaagttagtttttgcgttatcttagagctaaaaccacataattttagtgtcatgtagtaaaatttgccttatagtacaatcaaagttttcaactgggtatgtttatcatagatttcacaattcttagactgcatggtttggcaatgatagacgtgttatagttttcacttttttctttaaaaaagataaatcattttattgtaaatgttattgtaaagactggcaaaatacaacgattatgaagtgttttctctaaaaagttactttttatgttgtcttaaggctaaaaccacataatttcagtgttctgtagcaaaatttgtcttatagtagattcaaagttttcatttagggtccgtttatcatagatttcacaatttttagtatgtatggtttgtcaatgatagccatgttatagttttcacttttttcttaaaaaagattaactattttattgtaaagtttttaggtctgatcttacatatgaattagattatctctattcttctctcgaaatttcacaaactggaactggaagt

SEQ ID NO: 57399 - DNA, 1415 bp, Oryza sativa
tgtaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggaggggggaggggcaaagaggcaccgccgaggagccactcgacggccgcgcgcgcacccgcgggtgcacgcgcgcgccggtgagggggcccgcggcggcgccgccatctccgtttttcggccgccgctctctctcacacggtgggggctagagacggtggagggagcggagaagagaaaaggaagagggcgcaagggccgctggcggcggcgacgccgctccgctcggccactccgcccggcggcgcgctagagaaaaagtgggcgcgcggcagcgcgaggtcgccggccatggcgcggcggcgcaagggtcgccggcgtagatgacgccactcggcgcggccgcacccgcccgcaagagagaagaggctagggtttcggccggccggcggctggggtcgggttttttttttgtccctccgatctcagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttagctctgtttaaatttgaaccaacgggagaattttacagagagtaaataacagagtttttgttattgtttatacgaattgtacatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgtcatgtctattttctgcccaacggtgatgtagacttaatacataataattttaatgttaattttgttctcacaatacatgattatctcaggtggctact

SEQ ID NO: 57400 - DNA, 426 bp, Oryza sativa
tatgttctgtgccttctattattgttcagaggtgacgaataacagttgtaatgctggttgagtctactttgtagggtggaatacctaacgtagggaatgcagttctgccacttactcgtgatgatctaaaaggattgccattcaagtttccggagactattattaggtttgctactgccccttttgcactagtttgcctgcattcgttttatgtccttcatgtgtatgcaggactaagaaaccatacagttttcttttttagatataaagttgggtgtgtgccgtatgggttttacccttctttaatgcaatgatacgcagctctcccgcatgttcgataaaaaaagttgccttatgatctattatagtcttactataaagtgtgtcatttttccagagaagttgttcgcagccctatggttgaag

SEQ ID NO: 57401 - DNA, 392 bp, Oryza sativa
tggtggatttagcagagacgcaaaggttagacattcatttatcatgccatttgcttcaatttagtctttacccatggctcttcctcacctcaccattttgagatccgtctttcctgcagattttggctggcatggctggcgcaatagtgttagcggtcagtttgtggagatactcacgtagcacattgagatcatagcacgtctatcacgctctcgactgttttagtaagatccaaaaatggatctgtcaagacaatcatctgcttgactccaggtacatgagctgacgacaagattttggtttcctcctgggatgctgcttcctatctgagagtggatgtggtgattgtccgtcacagaagaaagtatacagaaattggtagctaacagat

SEQ ID NO: 57402 - DNA, 1274 bp, Oryza sativa
tggtggatttagcagagacgcaaaggttagacattcatttatcatgccatttgcttcaatttagtctttacccatggctcttcctcacctcaccattttgagatccgtctttcctgcagattttggctggcatggctggcgcaatagtgttagcggtcagtttgtggagatactcacgtagcacattgagatcatagcacgtctatcacgctctcgactgttttagtaagatccaaaaatggatctgtcaagacaatcatctgcttgactccaggtacatgagctgacgacaagattttggtttcctcctgggatgctgcttcctatctgagagtggatgtggtgattgtccgtcacagaagaaagtatacagaaattggtagctaacagattcattgccgcatgcgtgcgctaagcctgtaacacaacaccatacgattcttttgtcgcagcatacgtgccccgtaacagccactgatgtatattgacacctcccatttcatttgatcctctagactgcaagtaggaaacggcaggttgcatgctattagctgaagtagtagcggttttgtttcttggtgagctttggatgtgtgtttgtgggaaaacccagaatgataaaagaatataggagtaaggatgcagacatttgtatgcactgtatttgttaccttcacccctattctttccgtgttctgttccatgtgctctttgagtccaaagttagatttctgctttattttttttctttctgttgttgatacgatggatgataatggacttatcctgatgaatagtactccatgatttggatcgaaaaggggagacgtggcgatcgaagcaggcgcagggcctttttaccccaccgtcccacgagcagcaccgaccaaacgtgtgatttggcacccttgcgagtttttttttctttttttttggatactcctagtatatatgggcgagagatttctcaagggaagaggagaagatgtgacgagacattgaagaatccctctagaacactcgtcacgatgccgaaaaaggcgttacacggatagactagaccaagagaaacaggagagagatgcgataaaaaccagaggcaaagcaaaggaaacaacaggccgctgctatatatccgcctcctgctaatccgcgactagggagtgaagagcgaatcaaacaccaccaccatcgccagcgtcattcagatttcagagggagggagggagggagagagaaaggaaggggaagtgggggagaaggaggggagagga

SEQ ID NO: 57403 - DNA, 270 bp, Oryza sativa
agggagtagtatcttttttcatcactgatgcaggcattactgatttcgattaagaaatggaacatgacaacattatatgcagctaataaacaatcttcacgcatctgacggctgcacattgggggtgcaaactgataggcaataattcagcaggaatgcaagaatcgggtctatctatacatttgtttttttttttcgaggaaaacggggagctttattaattaaagattaggagggatacagtctttggctaagctctccttaacacac

SEQ ID NO: 57404 - DNA, 278 bp, Oryza sativa
gttcacaacacactttgaaataagattaaccatttgtattttgtatttgagggcgatatgggcagtgatttgtattttggtatgcatgaattatgatatttctgtttatggtagtttttaaaacgtgatcgccaataattcaattttgtgagagatcgtatcacgcgcattaacgctgttgcctgtatccaggagatgctaaagatcgcaacagcacgcaatgccatatatatgctgctgagcaataatagtaactcgatcggtgcaatccgcgcaga

SEQ ID NO: 57405 - DNA, 1501 bp, Oryza sativa
tatcacaatgtatgatgcaatcccgacaactatcatgcaaataggcaaggcctctggcaactccaatggcaatttggtacctagtagtccaatccaaaactatatcattagcctcgaataaacacacatcaagggagcagtttggcatgtattcatacacaagtaacctattatcaccttcacaacaaaacccaatcagtttaactaagttaatatgttgaatgattccaattgaatttacttcagccctgaattgcttctctccttgacgggctccatcaagcattttctctgcgatggtagagtcgtttaggtaccccatgaacacagaaccaaaactgcctccccccaacttatttgaaaagtttttagttgcgcgttgcagatcagtatatcgaaatgcagtgatcccaataccatcctcaggcttttcctgtgtgcaagcaaaccatttccctttactcttccaaactatcagtagaaggatcatcaaaaacaaaacgccaatgctcgcaccaatggcaacaccaattatttttccactcatcttcctttgtgaattttgcaactcttttgcagcaagtcgaatgtaaagaaccccctcatccccatttggagaagcatcagataattgctttacattgtacaactcatcatgccaaatggagcagccaccattcccataggaatatgcagtgcaagagcagttgctcaaacaaacctgtgagcattcttctcgactggtaggagcctgcaaattttctgcattgtgaggcaacctaatgctttgcacagggtagaacttatctgtgagacctgtcctgtccttaccagcaccacaacttaaaggagtattcctcatgcaccctcctgttcgatcatcaagctcccagtccttcggtgatcttatggagtagcctttcatacagtcgcagaacggatccttattgtcattgcagattgtgaaaggtccacaaattgcatacacatcacaattcactacaggctgcctgtaatagataaaccagtcctgcaattcctccaaccatatgcccaccaaacctcttccatatacatctattccagcgtgcatcatcgtcgtctcatcagacaaggtgtatatgaagtaagcctcttggtcattgtggaaaaatgtgaaatttggcatgaaagagcctgtcatctccggcaattggccaaaataatggcctttccagtctccgctggaccaatacgccacggttgagttccatagcaaatgaccatccccattgagtcctaactccaaggagtatataccaggagcctgatcaatcaagttcttcaaatgacatattggccgacatcagggaaccgtttcacacaagttgcacaataatgcagtagtgcatgggccatgaccatcaaaaaagaagtcaagaagaatgtgtggaggattggaggagaggcaagaagtgagggagttagcacaagattcaacaaaaaagggaaagacttttta

SEQ ID NO: 57406 - DNA, 1501 bp, Oryza sativa
cttcgtaaaaaaacaaacctagacacggatataatattttctggtacaataaacctatctagattcattataatgtcacattcatgtttaagtttgtctcttgtttttttcatggagggagtactctacttcaacagtgatgtcgccttctcaagaattcttgcattgccgattgggcgagtgattgtgtgaactatgaactagtagtatacgtgaatctacgtatattagcaaatcatacttcatccgtacctaaatatttgacgccgttgactttttaaaacatatttgaccgttcatcttatttaaaagcttttgtgaaatatgtaaaactatatgtatatttaataatgaatcaaatgatatcaaaagaattaataattacttaattttttttgaataagatgaacggtcaaacatgtttaaaaaagtcaatgacgtcagatatttagggacggagagtatatcaataggcgatagatttgccgctcaaaataaaaaaagggtaagtctaaaaaaataaataaaagaagggtgtgaaagggagcagaaagctgtggctgggcttgcactgcagcacacagaagcgtgttaaaaaaacggccacagtcaaccaccaaaactatggtggcaggagatcaaaaaaaaaaaaactatggtggcaaacaatgattagcaaattaactattgccttaacaacattaatacattatcatgtcacgtcgtcgcgtaatcatgggtacccaataagtttggcactggcctccaaatctccttgagatctccatgtttagtgagagagagcattttgtcgttgagctgagcacaaatcggcgcactgaatgggcgttgagcgtggttgatgggccttctttacgtgtatttttattgggaataagttcacttctggtcctttatctttcagtgccatgtcagtatcttgtcatctaaaacaacttaggctgtgttgataagagaggaaaagagaagatcgagaactatattaaatttaaaaatagattaatatgatttttaaagcaaattttttggtagttcggaagcgtacacgcggcgaacgagagaaatcttcatcaatcatcatatgccgaacacaaccttaatactgtctttggattatattcgtgctggctttagaagatgagatatgcattataaccggttttgcggttgaccgatacgattgaaactcgactcgcttagataaaggatgtcaagtgaacttcttcctttttattgggctgcaccgctcatcgaaacgggccgtggctgggtttccgattggtccccgctcttgggcctcaccacgcggcaccacgggacggaaggtccatatctctctcgcattatcttcgtcgtctccttgggttgtgtggcggccagccgtcgccgtctcgccgccgcgaccctcgccggcaccggcggcccccgacggagatggagagtaacgggagcggagcctctccgcggctaaggtatgggt

SEQ ID NO: 57407 - DNA, 1501 bp, Oryza sativa
aggatcatcaaaaacaaagtggcagtgcttgcaccaatggcaaaaccacttatatttctattcttcttcttttctgaacctggcaactcttttgcagcaaggcgaatgtaaagaactcccccatttctgtctgaagaagcatcagatagttgcttcacgttatacaactcatcatgccaaatggagcagccatctttcccataggaatatgcagtacaggagcagttgctcaagcaaacctgtgagcattcatctccactggttgcagcctgcacattttctgcattgtggggtaacctaatactttgcatagggtagaacttatctgtgaggcttgtcctgtccttgctacttccacaacttaatggagtattcctgatgcaacctcctgtttgatcgtcaagctcccaatccttcggtgatcttacggagaagcccttcatacagtcacagaacagatccttattgtcgtcacagattgtgaaaggtccacaaactgcatacacatcacagtgaactacaggctgcctgtaattcttgaaccattcttggtttccttccaaccacatacccacaaaacctatcccaaagacatctagtccagcgtgcacgatagccgtgtcatcatacaaggtgtatgtgaagtaggcctctttgtcattgtggacaaatgtgaaatttggcatgacatcgcctatcatctctggcgctaggccgaagtatcgaccgttccagtccccactggaccaatacgccacagttgagttccatagcagatgaccctccccattgagccctaactccaaggaaaatataccaggagcctgatcaaccgaacttttcctggaaacaagacggcggttcatgccggtgaccttgtcccagccaatctttgcaccagcgaaaagtgtatctgttgggtagtcgaagctctgccagaaaatgttggatgagtttgaggagcttcgtaggacaaggttgccattgttcagaagcacggcaatggtgtcattggttgtgatgttggcacgggtagaccatatgatggatttggtggcatgatccaggatggccaggtttccatcaccggagattgcgagctccggtgaagtggggtccaccactggattctcgccattggcggtccacaacggggttagcttggagaccttgttgaaccatatgccaaggtaggagttgtggttggtgtaggaggactcattacctggcttgaagaagccgagggcgaacttactgttattggagacaagcctgtcactgccggcaagtgaatggccgggtgacacggtatccgtggcggcggcggagctcgccggagtgtgcagggagaggagcaggaggccaagaaggacatgacaagggagaagcatggggaagcagaagatgaacacgggggaagagtggtggagaaggaaaactgaaggaggaatggtttgaagctagcttatacacagcacgatgctgcaagcaggttgagttg

SEQ ID NO: 57408 - DNA, 1501 bp, Oryza sativa
ggactcattgcctggcttgaagaagccgagcgcgaacttcccgttgttggagacaagcctgtcgctgccgacgagtgcgtggccgggagacacggtgtccgtggcggtagagctcgtcggagtccgtaggtagaggaggatgaggaggaagccaaggaggacatgatgaaggagaggcatgaggaagcagatgatgaacaaggggaaggcgtggtggaggactgagggaagagtgggattgaagcagatgatggtcctgcaagcagcttcagttgctgtttagaaatcagaccttgtcaactgacgacgttgtgtttagcctgaaacaagcctcgagaaatatgataggttatctgaataataaataatcttcttatcttggtcagacctcaacgctggagcgtttggactcaggaatgatccttgccaactattccagacagaaatggttgttttatgcctctgccatcaacacgtacgcaggtgagtaggtttatatattcttctaaaccttgcaaagcacagcaagttcatcccacataccaatgcagtggacactgtggactctactttgttccattttcctttcctgagcaaaaaaatgtttcgggtccaaatgaaaacttcagctagtagacaaaattttgtccagtttccagtgtggcacacgagatcaaatctgacattccttctccaaaatcaaatcagtttcatgttgagcacaggatgcaggatgtcaacgctcaggtgcggctgtatataagtacgtgactactccctccatcctataaaaatccaatttctagttatgatgcggctagaagttttttttatagaaataatggaatactccctccgtactcataaagaaagttatttaggacaatgtttaagtcaaaccttgggaatataaatcataaataactctcaagttgttgagtttaaaaatgtaaaaattatatgtatagatttgtcttgaaaaatactttcataaaagtatacatatatcacttttcaataaatatttttatagaaacaagaagtcaaagttgtgttttggagaccatgccgctgtcctaaacgacttcctttactagtacgtaaggagtatgagttaatgctggaatagtgtacatctcttcttggtcataccaaagcgtgttgcaaaccattcttatggacttggacggcggaattaaaggaggcaaaaatgctgaacacattaactatattatcatgccaaatcggtgcgtacatcatgatacgggactatgggtactcgaaggcgtggcactaaccaccaaatttcctcgatcgccatgtgtaccaggctaccaggccctgtttggttccataggctaatgttcagctctcatcttttagtctcaaattagccctcaaggatccaaacaggtggactaattttgagctaatgtgaattagcccccctcaaaacattagcccctccaaagagtgctaatagggctaattttgtgtgggg

SEQ ID NO: 57409 - DNA, 1501 bp, Oryza sativa
attgctgccatacataggctgttggtgtttttgtttgtgctttcagctgatgatttgaagttgttgatctggttcataccaatatcagaattggatgttaaatgagaccatgtgttttctttgcagttacggacaatgtacatgtaatactaagttcaggctttaaaggatagctcttgttccgtagtatttgtgaaaacaagagctgataggtgttacaaattttactatcatccatatatgcgttgttaatgggttgatttgaggcatctgaaagtaggactgttgtggtattgaacatatctgtatgcattttttttatgtgtagaagttttttttgtagcacaattacacaacgaatccctgtgcctttggtagaatgctgtctgtgtccacctgtttagaatggtgctaactactgatgggatgaagtgtgatattttcagccctacataatccacataaggaacacgagaagcagctcttagttaatttaatctgtcattctagtccctgactggttagagctgtacagcaattgactttgcacgttagatgagaactactacagcacattttaatttagatgcaaacagttgcttggatatggtacagtgttaatcatatcatgccttttgttgcacaattcaatgctatgcaattaatctgcttttgtttaattattgttaaatgaacagatttagctctgatcctgaaacaaccatgggactggtacagcatgaaggtggcccttgtggtgtcctagctacagtacaggtaccgctcccttgctttacctaaataatgtgattaattaattgtcccttttggacagaaatgttaatctttagttccagtcttcttctgaactcagatttccatactgacttcatatttattgttacttctttctcatgctgtgacatgttttatcagtttatttgtagcacataagctactaaatgcatttgagaaacccttctaattgctgcaactaaattttaatacacctgttctgtcaacacaagctacgtttagtggacctttttggttggactgcctgtacatgatcctcacaactcaaactggacctaagcaacctgtctagaacactagataccaatgaaagaaattcaaagtatctttgatgattcaatgtacaaacagatatatgttagtaggagataggctggacttctctgctgtttcattagatttaatagaaaaatgctatttaaaggtaagtagcttttttagatgtttattttgtgtggtcaccttgacctgattttaattcttttttcctgatttgtgacactagtgtatcgctatctgatagacagacacaagatcaaactatttcttcattatttatttctgttttctgaaagctcaacatttctgatggtgtgtttcttaatgcaggcctatgttcttaaatatcttttgtttttctctgatgaattgggtaatccggaggttagtgatccgttttatgccc

SEQ ID NO: 57410 - DNA, 1501 bp, Oryza sativa
catcgctgatcacctcttataagatcctttccggagctttgacgcctgatgtccgttgctccacgccttgacatggttcaccacagcttttgaacaatgtgaataattcctgtgtctcataaagagtgcacttttcagtttttatacgacgtttgactcttcatcttatttattttttattactatttttattgttattagatgataaaacatgaaaaatactttatacgctactttttttcttaatttttttttcataaatttttcaaataagatggacggtcaaacgttggaaataaaaacccaaaaatgcgttcttgcagatggactgatgtgcgtgatcttgcagatgaagctacaagggcagtagagtgtacatggtttgtaccacacttaggccctgtttagttcgcaggacgaaaagttttggcgtgtcacatcggatatacggacacatatttgaagtattaaacatagactaataacaaaacaaattacagattccgtctgtaaactgcgagacgaatttattaagcctaattaatccgttattagcaaatgttactgtagcaccacattgtcaaatcatgaagcaattaggcttaaaagattcgtctcgcaattttacacgtaatctacgtgattagttttttttttctatatttaatactccatgcatgtgttcaaacattcgatgtgacagtgtgaaaagtttttgcgtgggacctaaacagagccttaggttgtgttagtttgtgttggttgggaacatatccctccgccacggaaaatgaaatagctcattagcgcatgactaattaactattaactaaaactaacttgaatggattaacatgatttttaaagcaacctatatattttttttaaacacacaccgtttaacagtttgaaaagcgtacacagcctttatgtatggaatgaaacccatctgtgcatcttttcctattattccgttgcaaccgatataattgtataaagttatagaatatgcgttaaatatacaacatgaaaaaaaattgcacaatctcttatgcggaactatggccacgttgattatggattttagaatttcgtttgcacacttcccaagttcttaaacaatatatttcatgcaaaagaacattctacataaattttttttggagtgcttttcaacaataacgtttcaatatttctttcgtttataccattaaatagcaatacaaaaattaaattatccatcaacttacaactatctcaaaccgggcatatgaaccctatgactaatgtgatttggtcccaaagtttgccctcctagtcgtttggtggcttcaattgaattgacatgtaaccttatcctatcaaaacttacggatttgaccctaccaacaatcttacaggcatcttcatcgtttgttcttcagcttatcaactccgactaaaaactattctaagttgatattgttgtttttcttcgtagcttattttccagcgttgccat

SEQ ID NO: 57411 - DNA, 1501 bp, Oryza sativa; identical to SEQ ID NO: 57354

SEQ ID NO: 57412 - DNA, 466 bp, Oryza sativa
gaatggggggcaggattacaagatagaaaccttatccaatacggtatcggtttcctaactctactttacaatcttatcaaaccaggactttaggccgttccgtaatatacaaggaaacgtaatacccaagtcatgatctgttacatatttcatatatataagttatcccctataactagtcggataaccatgccgtgtgggtatggggtacccataatctccacagatagactggattacgtgtgttccattggttttaaggttggggtgtgttttgatctattaagattcaattatttgacttccgctgatgtaatctaccattcaacatctctctcatagacttggttacttgtgttcgatccaacatataccacgtgaaacaaccacccaatactatgagcaccaaggcagtgtgccatgtcgtcgtcgacatcgagctccaagacgtagcccgcggcggcac

SEQ ID NO: 57413 - DNA, 907 bp, Oryza sativa
gtgagtggaaagttcacgagaatggaagaagcacaagacacgggcgatgtatacaggttcgggccgctgagaagcgtaataccctactcctgtgttttggtggatctgtgtatgaagaagctacaaagagctggagagccagagagctcttactctagaaaccctcttctcccttttttcctctcctgggatctactctccagatccttttctctttcagtcctccccagagtcgtccccagagtcgtccccctttctaagtgggcaaggtcctccttttatatctcaaggggataccacatgcaccatctctctcttttgtgtggggacttatcctatcttttctccaacttgacttgccttctcttcataaatggacggagatttgtatggttaccgtccgaatgaccttctgatgggacggcccatacctacctccacttccgccggaagcaggtgcgacgtgggaacatggctgtctgctgacgacatgaccagcgtcagaccggtcacaaatcggtcattcttgtccaccacgtgtcagtttagcaatctgcatgttcgcccttcttcatacaatatcttgcttgtaatggttaggatgaagcctggcatatatctgaccgggtccaacgtgccacctccaggagctaacacgccggctccggctagggacgagtgcttggaggctctcatcctgacgggatggggcgaggcgtgcgtcagaccgccagtcgccacctaacccatgatctgatcggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaagg

SEQ ID NO: 57414 - DNA, 1165 bp, Oryza sativa
ccgctgccgagctcgagctcgagctcgcgggcctcgcgccgccgccggcgagacgaaacccggccggggtgagtcgtcgtcggcgttgaggtagtgcgtgtagtttggatgaggaaacggaacggcgtggagcgaggctgcgaaaatggcggagttatcacttatcgctgggtgggcctggcggtgcgccattttctgatgcacgagcatgctgtaggatataggaaaaagtccaactgtcctccctcaacaatagcgtcaattataacctcttaaccgcaaaacgagcaaagaggtttcctcaaccaagatagtttttgacggtggttttgtcctctgtcatgcttactagcatcctaaacagaaaaagaaataaaagaagaaaatgggtctcccaaatcgtggcatttaactatttgccacttttaagatgtgatgatatccatcatcgtcttcttattctttctcctctcggttcggctggacgcaaccactacgatgattttgtgcttgggtcagagaagcatagaggagacaggccgcatgccctcctaccagcatagaggagacaggttgcatgccctcttactaaggccagcgccaaggaagaccgctagagccgagcatcaaaggcagtgtcaaggggaaggacagcgccggaggggatgaggaggatatcctgaagccatccccaactcacaaatcggcggttgcaatgctttcttcctatggatgagaagaggtcgaggtctaggttggagccaatggatgcagggttggtcgtgtctgggcgtggccgaggcggagctaggatctagaatcattgccacatcacccactattgttggtacacctgcaacgtcagtgtttaggggttccacatggtggcggtcatgggcggtgacagactgaccattgaccattcaccaccaccattgaagccttttaaaaggagtatagaagtatgtacatagttgtcttgtttctattatcaataaggtagttagtctagttgggtagtcggtctcatgcaagagtggattggttcatgggaggtttcatgtcgttgtgggtcagttttgtttgggactgttaacacatatgcatgtatgtttttgtgagttttcatttacaagtcttaaccctattgttggtaaagtaggaa

SEQ ID NO: 57415 - DNA, 424 bp, Oryza sativa
catgtttcaaaatagttttttctttcaaaggaagattactgtgatctcattaagaaattcagcatgcgcatatttttctcaaatttttagtttgcatgataattatcagttataaatgttgataattcaaaaccacaaacagaactatatatttatgccgtacggctgccctatcaggtcacttcttgctacttcttgggtttaaaaagaatcaacaaatgcatggagggtctatatccttattattatgtgaatctggaatgtgtttcttatcctacaaattattggatataaagcattttatttgcagtgtacctcaactatgtagccaagttaaacaaagcaggcaactaaagaagtagttcagacagcaatgaccttctcaatctcagagcttcgagtacaggagtatttcagatagcaa

SEQ ID NO: 57416 - DNA, 357 bp, Oryza sativa
agtgtgtttgcttcctctcctttcttgctctgtccgtttccacttcatgctgtgttcgttagaagcggttcccatccggaagaacagtgatcacggaaaacagagtggtccattagcgcgtgattaattaagtatttgctgatttttttaaaaaaatagattaatttgattttttaaagcaactttcgtatagaaacttttttgcaaaaaaagtactgtttagcagtttaaaaagcgtgcgcgcggaaaacgagggagaggggttggtaacatgggattgcaaacacactccaaatctcagtatccatagaatgcactccttggagcacaaggacaacgttgttttcttttcaacga

SEQ ID NO: 57417 - DNA, 392 bp, Oryza sativa
attagtggttaccgatgaaaaaaatcttatctatatcaggtgaacaccattcaccgatgacttattcgtgactggttataattaattaagaaccttcaccgatgagaatttacgagttttgaattttaaatacactaaaaacactaaaatgtatttttaatatcactagggtatattaaccatagtcatacatcacaaacggtattccatactaagaatattttaaatatcactagggtattttaaatgggatatattttttttacctattaaaagtgagtcatctcaaacgaatcacattaacgctcgttgagggtagtagtgttacactgttaccttcttggcgaatgcagcttggttttcttatcctcttctttttcgtttttggatga

SEQ ID NO: 57418 - DNA, 1501 bp, Oryza sativa
ccgcttacggcgcatgaagtggatatgcggttgtggcaatcgaaacggattgtatcgtgcgcgcgttaattacgctcgccaaccgaagcggcgttaccgtatctccaagcgagacaaatctgctcacccagattcgcgcgctgctcaagtgatgtggcggtcttgaatagaccacccattatggacaaccaaagttaccaataccaatatgcatggattgagaccgttgggtattttgcccaactatggagaccggtcccacctgtcaccaggctttaggggtggcgtcacacctgaccgctccccttgggaagggaaattgctctggcataacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcactatgtacgtaggttgggtgagcacagccgggctcacctaaccgcatttattgcgcatcggctaagcgtgtcacgccgcacggagtgcagtgcagtgcactcgattatccggtctgtgaccagtcacagaccggtcaaatcgcaagttaggtggcgacaggcggtctgacgcacgccttgccccatcacgtcaaggtgtgagcttctaagcactcgtccccagctggagctagcgtgttacatcccagagatggcacgttaaccccgatcgatatataccaggcttcatcctaaccattacaggcaaggtgttacacaaagaagggcaaacatgcatgttgttaaactgacacgtggtggacaagaatgaccggtctggcactgatcacgtcagcaacgggcagccacgatcccacgttgcgcctgtctccgccgggagtggaggtaggtgtgggctgtcccatcggagtgtcattcggacagcaaccacaccaatctccgtccataaagagaagaaaagtccagtttagaaagagaagggggcatgtggtatccccttgaagtataaaaggaggaccttgcccataaagaaggggttggttgattcttgccagatttagagcctagagcgggggagaagtgggctcacactttgtagctcattcatacacaaatccacaaaaacacaggagtagggtattacgcttcgcagcggcccgaacctgtatacatcgccatgtctcatgtgtcttgccggcgagtaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaactttttcttgttcagcctaa

SEQ ID NO: 57419 - DNA, 1501 bp, Oryza sativa
ttaagcttgattcgagctctagactagccgagcttgggctcctgtcaagcctaataatatataatttttattatttactttatatactaatagatcaaatatgctgccatttatatgtatccacacgataaaatagtttatattaatatcatatatttatctttattctttttcttctattcacaaatataactaaatagaaattaattacttttatttagagattatattcttaaaatatatgttaactaagcttgatggtcgagctcgaaccgagttcgtctggaagcttaaaggttacacaggcttagctcgagcctaggtaggtgagctcgctcgagctcgtctcgttaacatctctagataatagtaaagtcagactattatcttaggttatgttaaattataatcgcgtactttatcatagatgatggatgtctgaccagtggcctaacggtcgatggttgtgcccaaaattcgcatcaaaagcttggatgctaagtattcactacttactggactcaagttacatgtgatcgatcgttccaaacagaaaggaaatggtttccaacgctgcattgcacctgaggaccaaacaaagtcagggttttgttcgatcggattccctccattcaaatcacttccaaattccgttaccctttgcatttccactctccaaccaaaacgcctccaatagtcatctgtccatcagtgtcactgatcaggcagccaatccacacgatgcaccaccaattaatacgccagccctgcaccattttatgaccaggaattaatgggacctggaaactggaagcaacatgagactgactgttttaagttctaaggccctgaatggatcattcagtccctagactaaaattagtctctagactaaaaactttagtcccctactgtttagatacaggaactaaagacatgtggaccgagacagagaagagagaggctatcactttagttcttataagtacctccaagagaaactaatgaattatagtcccaatatacacttttagtcttttttttttgtcacatctgtttaaattcttagggactaaaagggactaatgaattagtcccatgaaccaaacagagcatgacacaccaggttctcgttcgtgccgttgccgctacagcactgctagctcgcaataacgctgaagttcagttcaagattctgtggtaacttaaacttgttgattttttttctttttgtctggaccatcaggatctttgcatcactatacccagggtcattttcccagtcaaagccactgtaattccacacaaagtctccatgccgtggatattttgcaaagcataacaaaagatcttattacatcactgtccagatatgttatcactgttaccattttgccctccaacattatgcaagcgtatcctttgttaacttattatcccctatgggcctcattaacctactataaaatgcaagaagaagtgaagagcagtgatcacctat

SEQ ID NO: 57420 - DNA, 1501 bp, Oryza sativa
gaaaggtttgcatcccctaggggctgaaaaaaaaaggtaactatagctatacaaatgccgattgtagctcaagcaaacgctttgcccctgctgaaagcccatgtttaatgtttttgccacttccttgattttattgaccagacgatgtactggggactccttggagcaggtacaatagcaggctataagccggctataaccatatatcgagaagaaaaaagaagagagagaagaaatcaggctacagatttgtagccggctgcaacacggactctaagatattatgtgtgtatgagaggtgggaccaggtattaatggtgtaatatatttttatagttaactattgtatgaatgaactattagattgattatagatgtttgggagacagtagtggctatactattgaccttgctcttatgcatcctcattcattcagctcttaaagtggctgaaatctgtatcgccagtcaacaagtgatatggtgtagcaattctgaatttgccaacgactttgtgcgcttagcaggctgttacaacttacagctagtagcaaccaccatttcaggctttcagctggctttgccacgcctctcgctatccatttgttcagaagtcataaacctgtatatcaaagagcctgtccaagatcgtcgagatcggtcagacagcaacgctgtcgcgtttggttctggccttccggtgaatgatcgaattattatgtgccaatttcacaaggaacatttgtttaatggccatgctaatcatgattatattttaaaggttaaacagacgacgatttctctccggatatcactgccacagtgccactggacgccaactttgtctccagctatttgaccaggttatctctgagctccacagtccaaaacatcggaaatgataagatattaataaacatctcaaatgatatagaagtccaggaagacatgattaattttagtttccaaagttgaaaacaaacagatgttgagcacagacttggatcattcgccactacggtacaatttgcgagctttcagatgtcatttgtgccacagtcaaattactaccatttaccaacaacttgatccaaattcaacccgatcgatcattgacagaaatcacccataccttgagattctttaattcgccggccgatacagatgctaaacataaatttggatcattcatcactagcgctacaaatttctggttttcagaaagtcatttatgccactattgaagtactccctccgtttcatttatgaatgaatctatacacatacatatatatctagattcattaacatctatatgaatgtggacaatgctagaaagtcttataatatgaaacggaggaagtatcatttaccaacaactgagtccaaattacaacccggtcgattgaccatttgacagaaatcagccgtactttcggattctttaattcgccagccgactaattggtcacaaagccctaagagtcggttatatgtctgt

SEQ ID NO: 57421 - DNA, 1501 bp, Oryza sativa
ccccctttgcagtatcatggtgatacttcggggcatggcgacatgtgtggaatcatgtcttgtgggtacagttgtacacctctggccagagtaaaactattcgaatagtcgtgcccgcggttatgggcgatcaaccagattcaccgtgattagtctcacccctagtttagcttaataaactggtgtagttcaggtggttggttgggcctgttgcaacgtggtgtagcgttagacagtgattggttaatattgattaattactacagctgttttactgctttcaattactgttttgaaatgcctgctttatgcaaaagaacccctagcttcctttggttatatcctacatcatacctcctcttccgatatgacttgctgagtacagtgggtagtactcagtcttgctctcttttcccccacaccagagttgaagttcttctcagttggagccgtctcagagaggttggtttcgtcgctgtcgtcaaggtttgcctgtggagtggagtcgcccgctgctgaagtcaagcttcccggtttagctcgcttttatctttcccgctgcatttgtaatcttttatatttttgtaagacgtgggtctgtatgtcaataattgtcgtttgtgtaccctggctggtcctggacagggatttaatgcacattcagcttagaaattctggttcgagaatttctgggtgtgacaagttggtatcagagccgaccttgaccgtaggacaagccaactggaaacctaagagccctctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggtagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcgtaaaaatcatcatgctcggttatttatttgagtcttcttttgctttgtttaatttggatttgagcattaattagttcctatcccttgtctactttagatgtcagtcctatccctcgtttgcgagcgccgccccgagcttcagagtcgccgcccttagctttatcgccttcttagtctgtttgcttgctagttttcgtgtttaggtttgttgcttgtgggttagtcggcggtcattatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctattcccttcaga

SEQ ID NO: 57422 - DNA, 1501 bp, Oryza sativa
gtcaacgagtaaaggcagaacaccaaaggccagcaggtttgctacagccacttcagattctagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagtagaactctatctggcaagaattatgtgtttacatggtgtacctaagaagatcgtgtctgatcgaggaagccaattcacttcaaagttctggtagaaattacaagaagaattgggaacccggttgaatttcagcactgcttaccatccacaaacagatggccagaccgagcgagttaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctatcagggaaagattgagaatcgcgcaatctcggcagaaaagctatgcagacaaccgccgaagggagctcgctttcgaaacaggggattatgtgtatctccgtgtcactccgctcaggagagtacatcgcttccaaaccaaaggaaagttggcaccacgctttgtgggaccatacaggatcttggaacgtagaggtgaagttgcttaccagcttgagcttccctccaacatgcttggcatccacaacgtgttccatgtctctcagttaaagaaatgtttgagagttcctgaggaacaggcaagtccggatcacatcgaaattcaggaagatctgacgtatgtagagaagccgactcgtatcctcgaaaccagcgagagaaagaccagaaacaaagtaatcagattctgcaaggttcagtggagtcatcactcagaagaagaggccacttgggaaagagaagatgagttaaaggccacccacccgcacctcttcgccagctcttccgaatctcgaggtcgagattccgtttaaggggggtaggtttgtcacaccctgaagtttccccccttttcttgctttaaaaattggttaaataaattgcccaaagaaattatcttaattaacctagagctaaatccctagttaataaatgcaattaataatcggaaatagcgtggtggaatttttcttgagttccccatgctccaatgcattaacaagattttaagtggaattttcagaccttggaaataattttaaccaattaaaaatcaccaaagtgcaattttaaatcccaggaaaaatcctttcttatttttctttttcttttccttctttttctctattgggccgtcggcccactccctcccgcg

SEQ ID NO: 57423 - DNA, 1501 bp, Oryza sativa
tcttgagaaggcgacatcactgttgaagtagagtactccctccatgaaaaaaacaagagacaaacttaaacatgaatgtgacattataatgaatctagataggtttattgtaccagaaaatattatatccgtgtctaggtttgtttttttacgaagtagataatcactttagcactgttgaacaatatttttacttgcagcatgcgtagccgtacagacgaccagcaaaaactcaattaccagagtcaatgataagcgacaccacgttgcagtgctgtccattttcacactgttccagagcatatgtaaaacgttctagcattggcatcacgccacacaaatctgccaattataacacttgcgtaaggaacttgatgaggctggaaatacttaaggcatggctaaacactctaaacacattgtcatgtgcactcatatttcaaatcagatgtttcaaagaaaatcaacatacatgtggaaggaaagaaaaaacaacttgatctcaagtaaaagaaaaaaatagtttataccaggtagttgcacaaactacagatttcggtgttccagcattagcacagttgcaacctcacactgagcgtcattcagtcaattcctacgcttgtctcgtttcaaaaaattctgacgcctatacttgcatttttgactgtttgcgttgactccctcacttcttcttgcctcctctccaaatcctccgcatccttcttggacttctgttttgttgttggccatggcccatgctctgcactgtgcaactccgtgtgtgaaagggttttctgatgtcggcgaagatgctaattgaagttgatattttacatcccttggtcatgaactcatgatcgagtggtccaaatttgtgatcaaaatcagacaaatttgcttttggataagaatataataattgatctcatcagtgcccactacaaagtctagcctaaattttctgtctcctagcttttccatttggacctgaaaccattaaaaacaaaattggagcaagtagagtacactgcattggtgttgggaaaatgggaaggaacttgcagtgtttcgcaagggtttgaaaaaagagttcacataaagaatacacctactcacctgcgtatggctggcagaggaataaacaaccaattttgatctcgaatagttgggcacagatcatttctgagtccaaacgctccagcgttgaggtttgaccaagatgacaaagattactattatactgatgataaccaatcatacttctcgaggtttgtttcaggttaaacacaatatcgttagtggttacgactgattgagatgtgtgctcagacagtcacaacaccacgttgacctgcgattctgcgagctgaactaaatccatggtctgaattcttaacagcaactcaacctgcttgcagcatcgtgctgtgtataagctagcttcaaaccattcctccttcagttttccttctccaccactcttcccccgtgttcatcttct

SEQ ID NO: 57424 - DNA, 1501 bp, Oryza sativa
tcgccttgctgcaaaagagttgccaggttcagaaaagaagaagaatagaaatataagtggttttgccattggtgcaagcactgccactttgtttttgatgatccttctactgatactttggaggagaaaagggaaatggtttactcgcacattgcaaaagcctgagggtggcattggggtcgttgcatttcgatatattaatttgcaacgggcaactaaagccttttcagagaagttggggggaggaagttttggttctgtatttaaggggtacctaggcaactctaccatagccgtgaaaaggctcgatggagcctatcaaggagagaagcaattcagggctgaagtgaattcaattggaatcatccagcatattaacttagttaaactgattgggttttgttgtgaaggtgataacaggttacttgtgtatgaatacatgccaaaccgctcccttgatgtgtgcttgttcgaggctaatgatatagttttggattggactactaggtaccaagtagctactggagttgcaagaggtcttgcttacttgcataatagttgtcgggattgcatcatacattgtgatatcaagccagagaatatacttctcgatgcatcttatgtgcctaaaattgcagattttggaatggcaaagattttggggagggaatttagccgtgcaatgacaacaatgagaggaactattggatatatggctcctgaatggattagtggaacagttgttacatcaaaagtagatgtttacagctatggaatggttttgtttgagatcatatcaggaaggaggaactcaagtcatgaatgtttcagggatggtgattattcattcttttttcccatgcaagttgcacgcaaacttctcaatggagacatcggaagtcttgtggatgccagtttgaaaggtgacatgaacctagtggaggttgaaagagcttgcaaaattgcatgttggtgcattcaagacaacgaatttgatcgaccaacaatggctgaggtggtacaggcccttgagggtctacttgaactcgacatgcctccattgccaagactactaagtgctatcacaggagactcacattcagtgacaccacaatattttgattcagtgtaaatctatatgctgattcacaattaaaagtagtctaccaggacattataattcatcttgcctttttagaaaattagggataacatctaaggtctttaagagatcatgttaaataaactcgtagttattaagatctctgtgcccaagcaggagatcgtgccagccttccagacaaaatatattttgtgtctatgtaagatctgtaggtattagtgtaccgtatacatttttcatgttgccaattgagatgtttccggacacgcaggcgcaattgccttgtcagttgagagagtatattgttgagcctaacattggcaaatgtgtgacaacctgacaactatgctgctcatattatgcaaagttgcaaacatg

SEQ ID NO: 57425 - DNA, 1501 bp, Oryza sativa
gctgggggaaggtgggtttggttctgtattcaagggatttctccatgactcaagaactatagcagtgaaaaagcttgctggtgcacatcaaggagaaaaacaattcagagcagaagtgagctcgattggactaatccaacatataaatttaataaaactaattggcttctgttgtgacaatgatagtaaactgcttgtttatgaacacatgccaaatcgttcccttgatgttcatctattcccaactgatattaaaattttgaattgggatactaggcatcaaatagctattggagttgctagaggactatcttatttgcatgacagctgccgcgactgcattatacactgtgatgttaaacctcaaaacatacttctcagtgaatcattcactcccaaaattgcagactttggaatggcaaagtttctaggaagagattttagtcgagttttgactacaatgagaggaactataggatatcttgcacctgaatggattagtggagtgcctatcacaccaaaagttgatgtttatagctatgggatggttttgttggaaattgtttcaggaaggaggaattcaaatggaggatgtatcactggtggtgacaaagatgtttatttcccagtgaaagtcgcgcataagcttctggagggagatgtagaaagcttgatagatcccaacttacatggcgacgccaacttaacagaggttgagagagtttgcaaggttgcttgttggtgtattcaagataatgagttcgaccgacctactatgggtgaagtggttcaaattctcgagggaatatttgaacttgacacacctccaatgccaagactactgcaagctattgccggaagctcttgttctattgcagaataatattttcacaatcaaatgattctatttaatcgatagggttatttttacctttcttgtgcataagattgtcagacgtaaatgtaagctacattgtggatctatattgaaatgttaattagtgaaatcaacacagcaggtaccattgcttagcctatagcaatgtttaaacctacgacttccctttcccatattcttttgaagctcatccccctaggcttttcaaccaagcggtctaattactactttcgatttttcaacaattatattcgcatcatttactagatagccataatccctatgatattttttttgtcccacagttctgcatcatctactggatgcatcttgtcaaataaaaactactaaccacccatctggctggagatatcactggattggttgtaactaacaaatgttttctcctctttaaatcttaatgagattggtcggacaacctttggctgacccggcaaaaaaaaatgtcactggattggataatgtcctgtactaaccataaagattggaaagatgtagcaaaaatacatgatattagtagttttttcagtcttacgcaccaggaaattgatcgatcttctctagttgcaaacgaacagtata

SEQ ID NO: 57426 - DNA, 1501 bp, Oryza sativa; identical to SEQ ID NO: 57351

SEQ ID NO: 57427 - DNA, 195 bp, Oryza sativa
atctcaaggactaaactgggcccgaagtaaaaactctagggaccatattagctattcaccaaaaacaaaatcgaaactactttaatatgaaacgtataaaactgagtgagtaccagttacaaacaaatctgtgtttcccctttcgggttttatgattttatcaccgcggccacatgttgtggtctcgttcgtagt

SEQ ID NO: 57428 - DNA, 1501 bp, Oryza sativa
cctactcctgtgtttttggtggatctgtgtaagaacaagttacaaaatatcaaccagccctctcctctcccgggaaaatcccgttctctctctttgtgggcatggtcctccttttatatcttaaggggataccacatgtaccctttcctttccaaactggacttttcttctctttatgtaaatggacggagatttgcacggttgccctccgaacgtccttctgaagggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagatatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgaca

SEQ ID NO: 57429 - DNA, 308 bp, Oryza sativa
agtgcaacgcttgagcgacgcgcgagggccccagtggcaagggcttgccactgtgatgagccctcccccacaaataataaatttaatatcgaagccctcccccacaaataataaatttaatatcgaagtgagcatatggcccacacatcagatattagttaaactgatgagaacagttaatcttgtttagttcccacgtttaatattttcttttcgcgaactaatcacacccttagccaatagccaaatagccaaaaggctgagaaagatatgggttacaatggtgcaacctcgccctattttatagc

SEQ ID NO: 57430 - DNA, 1501 bp, Oryza sativa
cctactcctgtgtttttgtggatttgtgtatgaatgagctacaaagtgtgagcccacttctcccccgctctaggctctaaatctggcaagaatcaaccaaccccttctttatgggcaaggtcctccttttatacttcaaggggataccacatgcccccttctctttctaaactggacttttcttctctttatggacggagattggtgtggttgctgtccgaatgacactccgatgggacagcccacacctacctccactcccggcggagacaggcgcaacgtgggatcgtggctgcccgttgctgacgtgatcagtgccagaccggtcattcttgtccaccacgtgtcagtttaacaacatgcatgtttgcccttctttgtgtaacaccttgcctgtaatggttaggatgaagcctggtatatatcgatcggggttaacgtgccatctctgggatgtaacacgctagctccagctggggacgagtgcttagaagctcacaccttgacgtgatggggcaaggcgtgcgtcagaccgcctgtcgccacctaacttgcgatttgaccggtctgtgactggtcacagaccggataatcgagtgcactgcactgcactccgtgcggcgtgacacgcttagccgatgcgcaataaatgcggttaggtgagcccggctgtgctcacccaacctacgtacatagtgcaaacccctcagggggtcggggcacctcggccctcggggtcggggcaagcgcaccccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaaggggagcggtcaggtgtgacgccacccctaaagcctggtgacaggtgggaccggtctccatagttgggcaaaatacccaacggtctcaatccatgcatattggtattggtaactttggttgtccataatgggtggtctattcaagaccgccacatcacttgagcagcgcgcgaatctgggtgagcagatttgtctcgcttggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgcca

SEQ ID NO: 57431 - DNA, 950 bp, Oryza sativa
acaacaaaaataataacgtgtaagatagctagataatatcagattaagtaaattaatatggtttgtgataatttaaatttaaatagtatgtagaatagtgattcaaacgtaaaaagtaaggtagtatgactttatagaagaagaaaagtaggaaaatagtttgaaccgtagattaatcatctaaaggctaaggccctctttgtttaggcttagacttattggcttagacttttaagttagcttattggcttatatgatttataagccgatggatttaatgtcttaaatttaatggtggagtcatgcatctacctcatataagccaaaaaagcttctctaacctagcttttggcttaatagtgtcagaatgtcttatggcttcagaaaagccaaacaaaaaagccgcttatttgtttaggcttggacttttcggcttataagtttggcttataagtctaaacaaagagggcctaaaaacaattgatgtgatatgacttaattagagggaaaagggagaaaaataatttgtaccataaattaatcgtttaagcactaactaaatgagtatgaaccatatacttatataggatatacattgaaacattatgtgaattatgttggatgataatttaacatgtttgtatttgaaaatctcttaaattataaaaactataaaaatatagcatgtttgcatgatgtttaaatgtgatgattgttagtggatgatgatatggcatattattaattagtgaatgatgatgtggcatcttgttagtggatgatgatgtggcatctttgcatgttaagtttaagaagttagtgggggataacttagtaagataggattcagcccatagctgcacattaattcgacccatcacccatcagtgagcaagtattcagcccaaaatcaagcataattcggtccatatataatctatatttctaga

SEQ ID NO: 57432 - DNA, 985 bp, Oryza sativa
aattcctgcagcccaaaaaaaaaaatcaaatgtcaaatcttgtacttagttgccagttcttttattttgaggcacaactgtattggcacctgtctctactgcatatatcatttgttaccatgccactcttgctattatctgctgcatttcagatgatcatcaatttttttacggtcattaagcaccagcttttcctgtacaactctcatgtattgtgactgataattaagccttggtgttggccgatttgtcaggtggaacgctacaaggaagggtgtggttgggtgactaccgagtcgaggtcaattggcaggaggtgctactgctcggccattgttctctgactctcaatatcgacgctgtgaatttagttagctttctgacaagggaacaacaaacagatagttaaagaacttagaaggctcttcttttggctgaatttagagctgtagacatacataagctcttaccctaatcttttgcatgaactagaaaaccgttcaatgttgagctattttgttgatactgcaaaaatctgatgcaaaaatcagtttggtactaaacaagatgagaattccatgaatgaatatttgatagaactgtgattattaactgacatcgttgagcttcagttcagttttttcctacctgtttgaggattttactgaagcagatgtgggtctggctgggttcaccattccagcaatcacaaaccacatttaagaacctagtttactctttgctgtttcttacagagacctcaaagttgtgatgacttttgggggtgttaggcctgtttgttattattcctatgttgatctcaaatgttttgattttgattttaatcaaatgataattgcaagtattcagaaatgcatttgaagcgatacagtcaatggaaaaaaaattctgtcttcagtaaaacacaagggatgggagacgtgcgttccttgttgctgctgctgattctcgaagtcaccggcga

SEQ ID NO: 57433 - DNA, 354 bp, Oryza sativa
attcctgcagcctctgccaattaaatctatattcattcagcaaaagcagttaaactatgaagcctaaaaagagagtttattactgttgttattttttcttttttcttcgaagacaaaaagagagacattcatggatgttacgctcaactgagatgaaacctgtgatgtctgttttcattgatgcctggcgtgtgcgtgtccatgtgctcactggcattttgattcattcagtgtttgtattgtagagctaaatagaatcggtattttttttattacgtatcttatttattgtgggtttgtttgttttgggatatctaatttgcattaacagttcttctcttcaagcaaagaata

SEQ ID NO: 57434 - DNA, 295 bp, Oryza sativa
tcagaccaattttcagtggcatataaagaattctctctactttttttgccattggttcccaactctccttccttttaatttccttcctcccttaaaactgaatctcactattcgagaagctatggaatcgtcgacccccttaccaatcgtaggtggatgtatcgaactggaataagatctaagattgacatcttgatacaatgatttaccataataataaatagagtcaatggtgacagagtcgtggaagagctgcttcttttttgtggtgggagctagtccgtaccacggcagc

SEQ ID NO: 57435 - DNA, 1501 bp, Oryza sativa
agctactatgaccattcttcaaacccgatttatggtgtgttttaaccattcatatcaattaagcaggtgagaaaacgacacaagaaaacagctgtattaccctttataactgcctcggaaaagcaaggaggggtcaacttgtgtagtttagtaataaatattatggagaaagaataataggggtaatgatgcatcgtaagggtagacatccatcagagggaggctggatggagacaacttgacgtgaactgcagtaggtgaaggaggaatagatctagaatatgtcataggagagaccacgtcggaagtataggggttgggatttgtctatagatttttggttgctacgtagaaatacaatccccatccttatatacatgggataacttgaccttcaagaagctgatctggtctaatctctaacaataaaggaaataaataactcgatctaatctcatcagtaaaatgctgctactgccacgcatggtcagtattcatgaataataatttcggccagtgaaaaaagaactcattaagcttttaccaagccatctattttgtgaccaaaatagaaaaattgagtgcttttatatttcccgcgcatggaatatttattaactgcccgccatagacgatactcttgagtgaagctaagcctagttgccaatctgacaaaccacaagcaccacaaatagctcttatttcctaccctacaatctcagtctgaacctctaacataaatataaccttgaatcaacagcgtctaacacacacataaacaactgttcatgcaaactaaaacctagagttgcaccagatcctgaaggattcagggtaacatcctaatggtcatttccagacgtccatccttatactcatcatcagaaatagaaagcatccaagtaatatacactcctgtggtcgattgacaacaccactgaaacagaaatatgttgatatgtatacaatcttacgaccagataacaaaatgctaagcatctcgcaggctgatagtcgtttcagctggccgcagctgcagctgcagctatagtaaccagcagtagagctgtgctgtgactgtgcaaccgcaacctcggatcagctgctcactataaaagccacatcttgcatacatctacacgcatattagtacagagtatccccaacaccccttcttcaaataatgaaggaagaggtactcttggaccctgagaactgcaagcttagtagaccttattcgggttttttttttccttacgttcctaaagcactaggatttgatcattttgttacatctctcaactttgaatttctataaccggaccctttcttcccctaatatatcgaaaagataacagatctcctgtaatagccgttcaaacaaaatgaaagaaagagacagtagagaacgcaaggaagaagagctcacctgatgccctgattgctccactgcgccaacacctccttctcaagcttgttgccgaacaccattagccacagc

SEQ ID NO: 57436 - DNA, 1501 bp, Oryza sativa
aagggatatccctctaaatcacacacatgaatccccatcatttggcttatccattttattttgtaaacaaaaataatttatgaataaaacttttatatacgtgttcttaacgatataaaagtaaaggttgaaaaataaacttcggtgaaaaaaccccctaaaatcaactactccctccgtcccaaaatataaatatttttagcatagtgtcaaagtcaaatattagtaaccttgactattaatagtaaaaatataaaaaagattaatcatgtaaaattgatgttactagatttatcattaaggcaatgtttggctaataggatagagaaataattttccacccaccaaaagacatatttaaatcctaaccatccattccccctctcccatttaatcctaacccttcattcatttcccaatcccgattccactcctcattttccattatccaaacacaccctaaacaaactatcagaatatgcaactctttttatttaaaacatcttacttttataaacatcgttggtcaaagtagcatatctaccgtgcccacctgagctcgcttcgccgccattggcagcctcccgagctcgctcctcctccgcctccaccgctggccactcgagctcgctttgccgccgccacccacccctgctaggtccgcctccgccgccggccaccgctaggtccgcctccgccgccggccacctgagcgagagatacttccgcctccggtcacctgagcgcgcgcgcgagagagagagagagagcgcgaagggggacttggagggatttggttgaggaatatgtatgacatgtggtcccagggaattttttttattttctttgctgactagattgccatgttggcaccatatgtataagctcaagtctaaactgctaagaacagtgtttagggaggttatttgtccggtataaatacttgagggtataaaatatttggttttatgatttagggggataattcgatcggcggccgtgatagttgagaagtaaatcatacttttttttttctttctgaacgaaaagacgagtctggtaagcaaaccaccagccacacgcggaccggtacgcaaaggtctccgatgctcggtcagcaaaactgctgatccgtaaaatcaccaatgttcacatgcgcgttttcgcccgttgcccctgccgaaccgaactcgcgctagagtacgccacggctgccggtaaaacaggccaagaaacgaaacgaaatctaaacaggccagacaaccacgcagccgcacacgagagaccgagagacagagagcgcgagcacggaatgctccgcagatccaaccgccgttcggtcccccgttccgtgcagctgcacctgcatatagaaaagtagaaaacccaaaactccgtagcgaaatctctcctcctccacctcctcgcctctctctccctctctctcccctctcatcactctctccccacccccctcgtcgcctcgtcccagatccggaca

SEQ ID NO: 57437 - DNA, 1501 bp, Oryza sativa
tggcagcctattgattaattttatttttttgcctgtttgatgctttggaggaaaggcatgaacagagggatattcgggatgacctccgagaaaaggtcggagattcacgcactggtggagctcctcgagtccaagaacccaacgccggagccaaccgacaagctgcaggacaaggtattactacatacatgccactttccaccaatgcgcttatgctactactaatcaattcgagcgttaatttggaagtctgatcacctgatattgatcaggattttctttaccttttgagtttatgatgagcagggattgttgttagaatctaggtggaaataggtgtgtactagtttaagataaacaaatgtagtatgaaattgcctctttggtaatgttactgatagtttggtgttgagacgatggaaggtggatggatgctggaggctcgtctatagcacgatttcgatactggggaagaagaggacaaagttgggactgagagatttcatcagcttaggagatttcttccagatgattgatgtcaaagaggttagtgaaatttaccgagaaatgttgtcaagccaaattggtaacgttggtgctgtgcttgtttgctgtatggcttgttctatgtttatgcctgaatttacaagtttttcatcggtgtatttctcctatgttgtatagagtttgattgagtagaatttgacttcagtactcttcaattcttggacaataccaaaatgatcaaaacttatgttggctaatggctaccgcaacggaagtacatgacaaatgctctgtttcctaaaaagacaaagtacatgcttttgtgctataagcctattaactatgaagtaaatgttattgaaaaagaacagtgaatattgttacatgatttttatactggcaaaccaagtcagttttgatttttgatatatcttgaaataaatggagatttagcatcaccttctctacacccaaaggaaaaggcggtaaatgtgataaaattcagtgcaagggcgttgaagatattatctggccaacttactattgaagcttcgtacaagataactactaaaacagtaaggattctatctgcttctcatcattggttacgtcgtcctagaaatttttggaacctgaccacttaaattctgaagcacattattcttttatccaatttttgttttcagaaggttgatatcacgcttgatagttcgaccatcactcctgatcaggtataattcatgatattttcacttagaaactagcttcatatacataagcagtacttcaatactattggaagggtagagttatgagtcaaaacttttgtaacaaatctttttacaaataaccttgagcagaggcacattgttttccttcacaggatgcatgtgcaactgtgtgtgatgtctattttcttctatggacataagtaaccattttaattacaccatgtaaagcaactgtaattttctctgatgttcactttgactgt

SEQ ID NO: 57438 - DNA, 1501 bp, Oryza sativa
ataattcatgatattttcacttagaaactagcttcatatacataagcagtacttcaatactattggaagggtagagttatgagtcaaaacttttgtaacaaatctttttacaaataaccttgagcagaggcacattgttttccttcacaggatgcatgtgcaactgtgtgtgatgtctattttcttctatggacataagtaaccattttaattacaccatgtaaagcaactgtaattttctctgatgttcactttgactgtcatgtgcagctgatgaatattttccagaagaactatgatatgctccttgctatattcaacccagaaggctggctagagataacgtatccttttcggcttatgtgaaactgttttgttcttcgctgtttttctaattttacaatctctgctacaaatcactagtttccctacgctacattttttctttccagaagtggtgtggatgcttttaacaccaataatttcgggtagcacatgtatagcagcagagtaacccaatttgcatccagattccagagttctcctcaacattttggtcagatacgttgatgaatctctacggataggaagagatgacaaggcaaacatctttgtgctggagagggcagacccctcagaagtttgacaagatttatctgaagcaaaatgcctgcatatacatggacattccggcaaagatgcctttgcacatacccgtcctgtaacacggtggtttttaacagccagtgcagatcgtgtgctcaactttccatttgcgttagattatactactgctatttttttttctttctggagcaaaaggcatttccctttgcgacaaaatcatgcaagctgggaaagctcatgcaagttcagttacactacatagagaattggtacattaagaactggtgtacttttgaattttgaaatacaccattttcaattattcatccttgtaagacataatctaatgagtgtacagcttggcaaatggcaataccctttagacaaagttgttgttgttgtttttttttttaaatgatcgctgggtgatcccttatatcagctctttgttcctgccacgccatgcgtcatgtaataataactgggcggaaagaaattcttgcgttatgtcattttggtggagctttgcacctttcaacaaggacatctctcttcgagtctttgcctcgggtagagactggaaatgccggaaaatattttaagcccttgatgttgcatattctcattttttatacagtcacgtggagcattcaaagtcaaactgaacatcacatggagaaaaagcaacatatcaaactacacaaagtgatataacactgaatttgttatttttgtttttccatgtttgtgaagggatatgtagcacaactcgtttatgtttgtccatttttttttataaaaagtttcataactatttgtactatgtgcaacaaacattttaaaataaggtatgcgataaatatacttccgtaag

SEQ ID NO: 57439 - DNA, 1501 bp, Oryza sativa
tcttacagcctcacaagttacaactcaaacacatcgctacatgcagtaaaccactctgtaatctgaatctaccccatccacctgctctctcacaagccaaatctaccacaacgcacgagcagcacaagtaaaaacgtcgatcaagttaacgaagctaccataagcttcacaatatctgccacattaaaaccatcagagttcgaaagcgttcacctctgacgacggatcgcagttctcccatgcttctcgcaatataggattaaaatccaacagctaaaatctcgcccccataaacccaaccctgggctctagaattcccccaaaacacagcgattcacctctaaaaactggcataaatcaccagaaaaaccgcagacatcaactgtaacggtaaataaagcgctaaaccattcaaacacgcggcggcaccagcccacgaactgctaaaatcgctaaacaaacacgcgcacagaagctacgcctaaatccagcgaaaacctcgagctgcaattccgcacatgcaaaacctttgcgcactcgaagccccattccccatttccccccaaactccacagattccaattcaaaaccacttgaacaaactcaaccccatccagcatttcgacccatcaccatggcatcaatcccccaaacggcacagcattccccgccattccagcgaacaatccaccaccacgcgagcccctctcccatcaccccagaaatccccgaccacctcgagccacaaaaccccaccaaaacccccaccgaaacaggaaaggtagagagagagagagagagagagagaaaatccagcaccaatcgcgaccaaatcgaggcgcggccgcgcgggaggggatcgctcgctcgctcacctgctcgggtgctacgaaacccgcgggatcgatcgatcgatcagcggttgccgccgatggagccgcctcgacgcgcagcagcagcaagcatcgatcaaccagttcaccacctctgcgtgtgttggtgcggcgcggggtgcgagtggatgggtgggcgtagcgcgtgtcgtggcaaggggggcgacgtttatcagcggcgggtggtcgggttcaccgcgagctcacgagaagaagccgcctgcgtgtgtcgctggtaggtggggccacaccggggacggggtcgtggtaagagtcacgggtggtcagcggaaccgaccagtgcaccacataactacagtgtgtacggctcgcctgtgtcagttcgaacttttgagtttttaacggctcaagtctacttccctcaatcactcgtttcttttttattattatttttccagcgagcgacctctcaccacttaatgcgatcttatcctctcgctgtctcgcactctcgcatcgacttctccgtcatccctctcgcctcaactcctccatcgccaccaccccccctccccgtccctcatgcaatccccaatcctagtatcccactctccctcacctatctcctctcctctccaacgcgggag

SEQ ID NO: 57440 - DNA, 561 bp, Oryza sativa
ttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgagctcccggaaaaggagctaggaggggtggtcttttgttgcaataacaacacattcgatgaatgcttcactaaacagttatttggttagtaaaagtcccttttcgcctgtcctaatttcatctaaatgatatgtaaaatccatacgcgtgtgattacttttattcaagaacattgacattgctaatcaacattcttttgaacttctcgtttaattgggaatccattcgtttgcct

SEQ ID NO: 57441 - DNA, 339 bp, Oryza sativa
attctttatagaattatagtctacaaattcaaaactaatcaccaagcagatcatgagcatgtcatttcttctcttaaagtgccttacagatcaatcgttacatgttatcatttctttcgccgggcaaatcatcatatattgtcagaatcgaataacaaaaaataaactgtgatcttaatccaaaatcaagtttaatttccatctacatgtccgcacatttagtctatggcatgcagtatataacccacacgcttctctacgtttcgacacagccaaagcttcaaaacaaaacatctcatcagtcgagtacggagctgtgctcagagcaatggctgactt

SEQ ID NO: 57442 - DNA, 1501 bp, Oryza sativa
ccgttttctgatgcagcggattttgcagttttttttttttttcaaaaccacgagcggcaaaaactggtaacttgaccgcatctcacactcacacacgcatcaatgcctccgtgaaccaaacgagaccccatatgaccagatgagatgaccagaagaattggggaaggaaaagggagaattggggaagacagccaggcctgaggtgtgaacgggggctggaactcgggcttctagaaggccacgtgtgcaactcggattgccacgtccgtacgcgttacggatgacttggatccccgacgagcagctgcccagtgggcccccacccacttcctgaatcctgagttccgcttcgtggggcccatcggttagccgatgacgtcgtcgccgatgcggattggacgctggagaacaaaagggaggagtggtactggctcgagtgctctgcaaagcgcaaacttttctttttctggaacgaatgtgctccgaaaaattttaattggcgtttgcttttcaacttggtcacagtaaaaaagtgaatgtcaaaccttaatttcagtattgatattggattgtttatgcttttcattgtagtttattttttttattggttttaaagtaatagtatagtactacttattattttaagtagcaaagagaatacttttgtttgctaagaaagaaatttgattttgaatttttgatgccttttcatcgtaatacacatctaaaagtcttactcataattttttacctttaataagtgttatagtatataattaactgtagccaaaacagtgggaaaaggttttatattttactttactaaattatttattatactcagaatatttgtcagtacaaactttaagttataaattctttactaaatctgtttgcgctgctaaagaaagtgagaatcattaatttttgaaaaatatggcacaaaaaaggggaggatgctgctggcttttttttttctgcctttcaagagtgctgtcacatcagctcctctatctcaggcttctcagctcgtatggtactcatatcttgtcgttgaagagatggcgatggattgattacagtgcaagcgatattattacgaggaaattccttgtcatccagtcaagttaaggacagattaccaactgtgcagctgcagtgcagtagcagatgcatcaaatgcatctaggctgtgtttagatccaaacttcagtctttttccatcacatcaacctattatacatatacaacttttcagtcatatcatcttcaatttcaaccaaaatacaaacttccccctcaactagattcaaagtttggatccaaacttcagttcttttccatcacatcaatacacacataacttttaagtcatatcatctccaatttcaaccaaaatccaaacttttcgctaaactaaacgcaaccttagttgagggggaagtttggattttggttgaaattaaagatgatatgactgaaaagttgtgtgtatgacagg

SEQ ID NO: 57443 - DNA, 1501 bp, Oryza sativa
aaaaaaaaaacactaactggaccgcatgtttttcttatcacgctacatcatcatcaatcaataactcccctaaccccaccgtttttcttatttttttgaatttttttaggctttctcgttgttttacacgtagctgctaacccctcctgctcctcgcgcgcgtgggggcaaccgcccataagaggtgcgccggttaatcaaaatttggtcgctgtggtggtgtgcatacgtcgttgagaaaatggggattataccatcctcaaaacagggcttcgctgaaatgccatcctataattgggattcgcccaaataccactttcaactgagcccaacccgctgaaatgccatcccaaatcattttcatcaaaaataaaagattttactctacttttcacatgagttgatgaaattacccctcagtcaatttcatccttagaaatcaatcggctgggagagcgagacgcatagggttagggtttcgtccgcggcgccgatctgggtgccgccgcgcaacctccctagcgccgccgcgccgccctgcccttccctccagccaccgctccgtcgtgccctcccctcgcaccgacgcctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcacgccgcggctctcccctggcgccgacgaggtctcccctcacgccgcggctcggccggcgccctcccctcgcgccgacgcttggccggcgcgccctcccctcgcaccacggctcggctggcgccctcccctagcgtcgcggctcggccggcggcctcccctcacgccgtcctacgctcggctgtactgcggcccctctccacgccggtctgtcgccgtcccggatctacttgcaggagtgatgcagatggattccaatgtttatgatatatgaactcagtttgagtgattatgcattttgtggttgggagtgatttgcgaataatctgggaagcatgctcttaatgatgcttaactggtgttgtttgaatgctgttaatgatgcttaatgagtgatgcttacgtggtgttgtttgaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaaggaagagaatgacatttcagcgggttgggctcagttgaaagtggtatttggacgaatcccaattgtaggatgacatttccgcgaagccctgttttgaggatggtataatccccattttctctacgtcgttgggtggaggggctgctcccggtgggagcctgggagg

SEQ ID NO: 57444 - DNA, 1501 bp, Oryza sativa
agtaaaatataaaaccttttcccactgttttggctacagttaattatatactataacacttattaaaggtaaaaaattatgagtaagacttttagatgtgtattacgatgaaaaggcatcaaaaattcaaaatcaaatttctttcttagcaaacaaaagtattctctttgctacttaaaataataagtagtactatactattactttaaaaccaataaaaaaaataaactacaatgaaaagcataaacaatccaatatcaatactgaaattaaggtttgacattcacttttttactgtgaccaagttgaaaagcaaacgccaattaaaatttttcggagcacattcgttccagaaaaagaaaagtttgcgctttgcagagcactcgagccagtaccactcctcccttttgttctccagcgtccaatccgcatcggcgacgacgtcatcggctaaccgatgggccccacgaagcggaactcaggattcaggaagtgggtgggggcccactgggcagctgctcgtcggggatccaagtcatccgtaacgcgtacggacgtggcaatccgagttgcacacgtggccttctagaagcccgagttccagcccccgttcacacctcaggcctggctgtcttccccaattctcccttttccttccccaattcttctggtcatctcatctggtcatatggggtctcgtttggttcacggaggcattgatgcgtgtgtgagtgtgagatgcggtcaagttaccagtttttgccgctcgtggttttgaaaaaaaaaaaaaactgcaaaatccgctgcatcagaaaacggcatttgagtgcatatgaattccaaattttgttctaaatttgaggagaattcgaaatttcgaaccaacggaggagaggagagagagagagagaggcatcgcattctctcgtcgaaatggagggccacccaggcaaagcaaagcaaaaatcaccctccctatcggcctatcgctcgcctcacgccctcaccctcttttgtcggcttccccgtggtgggtcccacctcccaccatccttactatcccccgcgcctcatcggacggtcgaggaagcgagcaccggcgacggccgtccgatcccgatccgacggacagcatcgccgttcaaaccccccatccacgtcaggtcaaaggcgcgaccgcgtacgtgtccctgggccgcgccgcgcgagtcacgcgtgccgtggcgctcccctcccctcccctcccctccccgcgcgccgcacgtgagagggcctctgcaccgtcggatcgcgatcggacggccccggatccgccgtcagtggcacgggcccacggcgtcacgacgcggcagcgctgaccgccgcggcgggggagacggggccgtgacggcgtcaggatcacggcgaggggaaggggagagagagagagagagagagagagagggggggggggtataaaatgcgtggcacctccggctcgggtataattatcgcagcacac

SEQ ID NO: 57445 - DNA, 1501 bp, Oryza sativa
acacaagcactgtaaaaggatggatgtttgcaacgtagtaattttagtgggtgatttgattgcatcatgttaatcctcttttagtccctaaccaaagtatgtatcattacttctttaatcctcaatatccggtggtaggaggaagcaatagctgtacggcgcaacacgactacgcgagaaatcacatagcctctgctgtgcccccatggacctaattgctccatcgatagaaacttctggacgaccttctggacaatcgttgcacgcacgcacacgagcgtttcacgctgcacgcgcgcaagcaggatcgagccgttctgtgaaaccggtgttgccacgtggcacaattcttctttggagtttttgcatgaaattcgtattataagattgtttgacgtgttgctctaaaagtgctacattcactactacgaaaacattttttccgtgcgatcgaaaagggttttcgcgtgcggatctcccgcccatctacaccgaagtgtatgcaaaaatccgattttttcatgccggtgacgcatccgcacgcgaaaatctgatttttgcgtgcgggtggcttatatcactcgcacgcaaaaaaaaaaaaaaaaatccaaaccttaaacctagccaccgccctcctcgtggtcgtcgttgtcgtcgtcgtcgtccgccgttgtcggtgtcgctgccttccgccacgaccggccgccgcgggcggctaccgagccctccgccgctcccggtcatgtcgccaccgcccactaccggatccgggtgggagaggggcgctgcctccatgtccaggcgggcgaggggcgccactgccggggagcgtgcgcgaggccgctttgccgccacccgccgctggtcctggccacagcccgcatgggaggccacgctgccgctgccagccgctgctctcggctgccccgcacccgtcgcccgccgagcccgccgccacccgtgagagacgagtgacgagagagatagaagaaatgaggataaggatgagtaggtgaagaggataatatagaaatttttgaagtggttgagaggaaaatttgaccgaggagggagagtattttcgcgtgcggtgctcttaaagatgtccgcatgcgaatattttcgcatgcagtcttttaagaggtccacatgcaaaaaaaatagtcttatttttgcgtgcggacccttaagaggcccgtattttcgcgtgcggtgctcttaaagatgtccgcatgcgaatattttcgcgtgcagtcttttaagaggtccacatgcaaaaaatagtcttatttttgcgtgcggacccttaaagaggcccgcacgcgaaaatcgattttcatgtgcggtccttataagggtccgtatgcaaaaatgggaggatgatttttttccagacgcggtctgttatggactgtctggaatctaaccaggggctcatataggaaaatcaatttttatagtgattggattggatgatgaggtgacgaagagaagtaaggaa

SEQ ID NO: 57446 - DNA, 713 bp, Oryza sativa
ggaagcgacggcaacggcgtgctcaggcgctcgccctccccctcttcccaccaccctctcctcctcggccgcgcctcctgccaacgtccccacctcgcgcagattgggggaagtggattcggcagggaggcatgcccacatggaggtcgtcgacgcggaggagctcgcggccctcgacggcaacgcctacagtgcggagtttgccggcgcggggagcagcaggcggcgactgccgtcctccccgcctcgcacagccctccgcctgctccgctcttccctcctcgccgaaccgatggcgccggctgtcgtcccctacctcacggacggcagggcaccgggaaggactgatcgtgccgatccgacctctccgacgggaagggaggggccatatggctgggctgcagtcgattcgtgggaacgacggcgaggccggaggtagtgctatcgagcgggtggacggtcgccgcggctaccgcagctcgcgtcatcggcggatccggtgccgttgaccaccctccccccagcctcgctccacctgtcggcgtcgttactcccggcgctcttcctccgtccgcgccctcctcctccactgtcgagtttggttgttggtgccggcctcgccgtccttctgagccggccggcgcgttggttgggcgttgcgggcgagacgatgcgttcgtctgacatgctgcgcactgcctcgctgtccacac

SEQ ID NO: 57447 - DNA, 1501 bp, Oryza sativa
gccgaacgtttgggccgaatcgaggcgcacttttgggctgaattgatgctcatggttaggcgggccgaacagacgcgggagcgttggtctgtgggtgtctgacactgaccagacatttgccagcacacgtgtgcagtgacattgggacagggctgtatgatttccagcgacttattctaaatccctgtcatatcggatatttagacactaatttggagtattaaatatacactaattacaaaatccattctataagcttggactaattcgcgagacgaatcttttgagtctaattacgccatgattttgacaatgtgatgctaccgtaaacttttgataattatggattaattaggcttaaaaaatttatctcgcggattagctcttatttatgaaattagtttttttattagtccatgtttaatactctaaattagcgtccaaacatccgatgtgacatgggctaaaaaattttagccccatctaaacaccccctaatctgcttttgctcagtctgatctgatctgctaagagcaagttcaatagtatagccaactactagctccaattcatctatggccaatctaataactcattcatacaatagttacgtactacactattaatacctagtcctacctgtcatagacacactgcgtcttggggtccgtgctatagctggctacaaatctatagcccgctgctcttttctctcctgatttatcttcttaaaatatgtttgcagctggcttatagcctgctattgtacctgctctaatagcttgttctcagcagacggagaggacctgtgaaatttgttgacgaggccaaagcaagaactactcctttctttacatgaaaaatcaacccaaaatgtgacgatatttcttcgtataataaatttgaacatactccctccgtctcaaaaatatccattcctagcatcctaaggtggaattagggcatgttcagatccatttgaaatggcaaatggcaaataacaaaagttttggtagcaaaagatttaacattgcaaaagtactaattggtgtttatatgcatcttaaaattttgctattttagcactaaagagagagggtgtggtcccggagcactttttggcaaaatttgctaccatggactagcaaatgccaaatgccaaattgccaacttttgctactagtgtttagatctaaaatggcaaaaagtgcttcaaaatgacaaaacttttaccattttggaagatccaaacagacccttagtataggtggagaattattaaaatagaagttggtaggtaggtaaagggtattgaagggataaaacatctcgttttacgtgctgaggagtaggatggtagaaactggttttttgtaagataaaattcaaactctagaagttgatttttttttctagaacggaagaagtactacttagtgcccctttgaatcgcaggaatggaaaaaatggaggaataggaaaaacgtaggattctgacagg

SEQ ID NO: 57448 - DNA, 1501 bp, Oryza sativa
tatcatttgcatgcatagtttgcaggtcgatcctagttcactagatatatttcgttttgagcaatatgacctaggtactggtacctgggctccagctagtgacggagacattttccataaaccaccaccgagtccccatacacttatccatcatatctttacttgctgcaatcgcagatattggtaagtcgagccctcaactctgcatatttgtttagctcccagagattttttcgaggagttgatgaacatgaatccttctcgtcctgtaggaataaaggaatcatgtattgcagtaaaagacagcctatttggttggtgaagcaagaactgcggtttggggtaagttatgtgtcactgtctcttttttctcatataatcaattgtcatacttttgcttgttacgtactccctccatttcatattacaagtcgttttgaccttttcttagtcaaaactctctaggtttgactaagtttatataaaaaattagcaacatctacaatatcaaattagtttcattaaatttaacattgaatatattttgataatatgtttgttttgtattgaaaatgttaatatattttctataaacttggccaaacataaataagtttgactgagacggagggagtagtattcaggcgtcatacaattttgtgctgtttggttccaaactcagttaacattagtaacttataatgtgaaacggagggagtagtattcaggcatcatacaattttgtgctgtttggttccaaactcagttaacattaataacttataatatgaaatggatggagtagtattcaggtgtcatacaagtttgtgctgtttggttccaaactcagttaacattagtaactagtgctgttagacggtgtttggtttggatgaactgtaactgtgatgtactgatgctatagcaacaatattggcttaagatgtcaaatttttcagcatcaagatgggtttatgctggtatttcctatgcaattacaacctagcattatgtatatagtttattgtcttgagaaatttagaaatatccttctgcatttagctttgttatttgctagatgtatgattattgtgcactttatagctttgtgcatcacaattactaatagtttaaaattaacaatcgcatggttgtgttaatcacaaaaatcatgtcgtccactcttttgtggtgcaaaagcgcataattacaaccatgatgaaaataaaagcctatatgtcccaaacaagttttggtaggctagagatgaaacccaacaagagtcactaataaagatgatataaaatttatatcttttgtatgtatattgggtaaaaagatatagagcgtaaagtcaggtattcaatttcagtaagatctcttgtggtgtccaccttttgttcggaagttgtaggttaattgttgacacatatttctcagggtgctgtgttcacctggttaatttttacttatgataaaaggcagttgtaggttaattgtt

SEQ ID NO: 57449 - DNA, 1199 bp, Oryza sativa
aattttgaatcgttggatttagtgcaagatttgttttggtgaggaagaaaacaaatcatagcacacacatatgtgaaagaatttgttcccacgacctccattttaccgaaataacatgtaacggagagatttttgaaagttacatacaagttacactatagttacagtgtaactacatgcaagttacagtgtaattacactacgattgtactgtaattacatctgtcaaattttgggggaaaaatttgtcgacaaatatatagcaaaatcgataaaaaaaattaattgacaataagaaatggaaaagttatactccctccatttttttactcctccgtttcacgttacaagtagtttgacttttttcctattcaagtttggccaatctaatagaaaaatttagcaatatttaaaacgccaaactagtttcataaaatctaacattgaatatattttgatgatacgtttgttgtgtgttggaaatactaatatatttttctataaacttagtcaaacttaattagaaaaaaaagtcaaacgacttaaaatatgaaacggaggaagcaatatattatgccattcgttttgattatttgtcttagtaaaaagatttatataaatgctatttcttccgtttcatattattagactttctagcattgcccacgtgtttgtgtgtatatatatatatatatatatatatatatatatatatatatatatatatatgcaatgctagaaagtcttataacttgaaacggaggtagtatatatttttattatgacttgttttatcattactctaacattaaattatacgtttacatatttatgaaaaaaaattaaataagataaatagtcaagcgttataaaaaaaattagaggtagtacagttttaagaggaaaatcccatttgctttgtatgaaaaaaaaatagtccttactaacaacaaggaattactctatccacttccaaatacatgtcaccaaccactgtttatatttaaactttgataagttaattttttttcaaaaaaatataaatatagaaaaaacaatagttttcaaagtaaatactctctcagttccatgatataaggcacggttaaacttggcacggtctcaaaaactaatctttgtcttatactttatcatatattataagtctgcggtagaaaaattataaccatatgaaagta

SEQ ID NO: 57450 - DNA, 1501 bp, Oryza sativa
ttggaccgtacgaaaaatgcaagaatttggatgatatagataaactcataagagtctttgcatgatattggacctcacgttaaaaatactccaaaacttatatgaatttgggcattccttagaaatttgataagattcaatagtattcaataatcctttggttcaaataatcatatagaaaaaaatattgtttctatacagaataaaagttcctatatttttctatatttttctttcaaataaaagggccctaattagttactccactaaagttgaatgagctgggttcactttaccatgcgtggcaaagccacgcggtttttctagtatagtacttattttgatgcgtcgtagccttgccaacgaatacacacgataggtcccattattttctaataacacgtggattctactttagttttcattagtatattttttaaactactaaacagtatgcttttatgaaaaatttctatagagaagatgctctaaagtatcaaataaattagttttttaagtttataataattaagagttaattaattatgtgataattataatacaattaattatgtgataattataatacctttctcattttcatcttgtacttactcgtgaatccgcgatcccaaagcggggcacggcagccatatctattaggtcacttccaatgagagttccggtgcgacgttagcaatttgaataatgtgctaaggattaatgaagtgagagataaaataaatttcatctgaatgaaattacgactatattgtttccaatataacttgtctttttttaatacacaaaagaattgtgcatatttgtactaagattttgaaagacgtaaaatgtttacaaaattatattcctgagagtgcccacacaaccaccacaccctgaggaaacacaaccacggccaagaacctcaaaaaacggtgcatccaataagattccaacactaaaaacacctccaacgcccagcccaaaaagatatgtttttcacctagaggattctattaaagaggggaaaggaggcacctcgacaacactctcaagagtgttgcggcgctcaaatgcatcatcattgctggtccaaagttgcactggcttttgtctggaacctgtttgcacctctcttatagcttgtctattgcatgtattgtccataaagacaacaaaattgaaatagttcattatggaagatattttgatcatcaattaaacacattcgccctgtttagagaacttagtattttttagcacaaggaaatagtcctttaataaaatatccctaagttgtttagatccaagagtattttgagagctatttggcctttaatacattttcccatggagagagggggagagaaaaaacacttttcagtgagccccacccgaaatagctctcattaatactcttgatggggatagttttttttaaatagccgtgaaatagcttaactgtttaaaacatgtgagctttttcaggactatttaa

SEQ ID NO: 57451 - DNA, 163 bp, Oryza sativa
ccctcctcgccggcggatccgtcctccgctggcggccgcgtgcaccggccgtcgtccaccgtgcggatggcgctgcgggaggacgggccatccgtggccatcgtgggcgcaacgagcgttgtcggccaggacttcctccgcgtgccgtccgcccgcccccagt

SEQ ID NO: 57452 - DNA, 349 bp, Oryza sativa
aatttgtcgacaaatgtataggtagtccctttttttattaatccgagaaataaacaagcacttgaaatggttttcgcagatgggctaattgggccggtggcccggctgattccgacccatccaagcatctcctctcctccgaatctcctccacctctcccacacatctcctctcctcccctcgccgccgtcgacgcagaggcttggctcatcgcggcgccagtgactgatcgatggccgcggcctccatccccgcgagctcccagcccttcaaggtttgctcccgggagcagctccgccgattaatctcttcttgtttgaggagcgaccgagcgagtctaatcaatccg

SEQ ID NO: 57453 - DNA, 243 bp, Oryza sativa
gttattctggcaatacatcctgtctaatgcctaccttggtaattttcacactgtttgtcaggtctgctgtaatgatcaggggccatacttttgctttgctcgcggaaacaacatatggctcatatatgacaacaacagaagacccatggtaattcccgatcaactttgcgtatttatgttttgactcacatttggtcgagcattactcgatatcattatttgtgtttgttttgtccttccagt

SEQ ID NO: 57454 - DNA, 252 bp, Oryza sativa
taggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagt

SEQ ID NO: 57455 - DNA, 1501 bp, Oryza sativa
gaacaatatctagacaatcaagtcgttggatgtttcatagagtggtggatatcttatataatccaagctaacgtcgctatttaacctaatcggccgccttctattaacagatgttagccgattgtaggttagatgacgatattaccgaagattatgtaagatatatgataactcgataaattacataaacaagattagagtgtcataaagatggaagcactaatcccgagaacgcaagccgtcataacaagttttacctcctgttgaagatcgaaaccgatacagctcaacccgaaagcaagaactcgtcgaaataaaacgaaagcaaaaagagtggcgatgtgccgagattgtattgaacgtatgttgtttgattacatggggttcgggtctatttatacccgagaattacaaaatatgtccataccggacacgactcttatctctaacaaactctaagatatcataagtctttgcggcagacttttgcccaaatatatctctaaggaaattacataaaatatcctaattaatagatacaattgccttctcaggactctatccatgcgtggcaatcatcttgaagcatatcaacccaacctgatgttgtacaccaagtcgtattatcgaaatcggctgcattacctaaccaagtctgactcgaacttagccgatccaatcgtagccgatccggactccagccaattcttgctctgttcccgcgacaatcctcatcttagattccgcttcgatctaatctccctttccgatgctgatattatcaaatttggtcgttaacaatctcacaacccactcacatgtatgcacacacatcccaaattcccaattttttaagcttggtcgaacaacctggtgttctataaggtgctaaatttgtgatttcagacaaccacttacaattttcattaaatttgtattatttctaaaaaaagttctttttaaaagattgtgagggcacatccattttgcgattaagggagataaaagtagactattccttctcaaataacagtatttccaaacgtagcacgattagtgtccgaggtgaattgacgaatctacggatacgcgacgtgtcacgtgtgcggcactacagccatctgcaaggagcggatatgctctcggattaatctgttttcgtccataagtgctacagtttgtgatttgtctgatcatgacaaaggtctacacgcatgtacacctgttcacataatgacacgatcaaaatctgttaagtacgtcccacgtacgatacgactacgatgccaacggcatctttgattatttgcatttgcattgacttgatatagtatgtcaccatcacactatcacaattcagtcatacaagtcaggcttggagtactgaacaggctctctctagctctacatgtataaaaaaaaatcagtttcaagcatcatacaatatagtcattcattcagctgccacccgccaagatgtcacctcgggtagcccaacgag

SEQ ID NO: 57456 - DNA, 1501 bp, Oryza sativa
gatcacatagaaaagagttgataaatcgagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagataccccagcgacgtgaggctgaagacggcggcgtcaaggccgccgctctgcaggcgtcggccgcctagatcgaggaaagtgacgcggccgccgtcgcagcggacgcccgcccagcggcagcagtcggtgccggcgcgccatgaccggaacgcggtggcggacgcggtggtcgccgagaacgatcgcttcagctggagcagcgccgccgcctggtccggcaagcatggaagcgagctcgcgatcaaggtttgtagtaggaggaggagtacaagtaacaacggctcgtactctcgttgggctacccgaggtgacatcttggcgggtggcagctgaatgaatgactatattgtatgatgcttgaaactgatttttttttatacatgtagagctagagagagcctgttcagtactccaagcctgacttgtatgactgaattgtgatagtgtgatggtgacatactatatcaagtcaatgcaaatgcaaataatcaaagatgccgttggcatcgtagtcgtatcgtacgtgggacgtacttaacagattttgatcgtgtcattatgtgaacaggtgtacatgcgtgtagacctttgtcatgatcagacaaatcacaaactgtagcacttatggacgaaaacagattaatccgagagcatatccgctccttgcagatggctgtagtgccgcacacgtgacacgtcgcgtatccgtagattcgtcaattcacctcggacactaatcgtgctacgtttggaaatactgttatttgagaaggaatagtctacttttatctcccttaatcgcaaaatggatgtgccctcacaatcttttaaaaagaactttttttagaaataatacaaatttaatgaaaattgtaagtggttgtctgaaatcacaaatttagcaccttatagaacaccaggttgttcgaccaagcttaaaaaattgggaatttgggatgtgtgtgcatacatgtgagtgggttgtgagattgttaacgaccaaatttgataatatcagcatcggaaagggagattagatcgaagcggaatctaagatgaggattgtcgcgggaacagagcaagaattggctggagtccggatcggctacgattggatcggctaagttcgagtcagacttggttaggtaatgcagccgatttcgataatacgacttggtgtacaacatcaggttgggttgatatgcttcaagatgattgccacgcatggatagagtcctgagaaggcaattgtatctattaattaggatattttatgtaatttccttagagatatatttgggcaaaagtctgccgcaaaga

SEQ ID NO: 57457 - DNA, 319 bp, Oryza sativa
tcctccaaatcccgcgctgcgggtcttcgggctcccaacctacacgcgaaacgggcaactcaacaaacggcgaaaaataaagccctattaatggcctctaaacgtgccattagatagatctcgagatttgaggatttttgaaagttgaacggagtccaacggacttatggtcgggaagatattgaatttctaagattattgattttttatctaaaggaaaaaggatttagttaaatcctttttggaaaaagaaaaagaaaagaagggagggagggaacatagacttctctcgggcggctagggcgcggcccaatagatt

SEQ ID NO: 57458 - DNA, 1012 bp, Oryza sativa
  unsure (1)..(1012): unsure at all n locations
gctcgnccgagccgccccaaatctattgggccgcgccctagccgcccgagagaagtctatgtccctccctcccttcttttctttttctttttccaaaaaggatttaactaaatcctttttcctttagataaaaaattcaataatcttagaaattcaatatcttcccgaccataagtccgtttgactccgttcaacttccaaaattcctcaaatctcgagatctatctaatggcacgtttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctcgaacatcttgagcctatatttgaaatttaagtatattgcttgcaaaatattatgcattgataggatcgcacttaatctgttgtcccgtctgcaaggcagattggcggacttacctaacttgttgcatttgatcctcccattgttaattgctataccatgtccccttgtaaccacccagttgcgcctcgatattcgtgcactctgtacgagtatcggcggacgccttcaaacttaaaacctgaaaaacaatttgggtaaaactggagttttacaaaagacttggaaaacccgacacctgggtcggtgcttgtgaactaaatgattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagcatggtctgggacctaacctgttgttggtctgggacccctctcgtcggcatatggtaaacctgtgtcggcttttgaaatgccttgtca

SEQ ID NO: 57459 - DNA, 1501 bp, Oryza sativa
gtttgtttccaaaatggttactgatctttctccctctttcaaaattgtagatggcagtgaacgccagcttcagttcccacggttttggtgagggtcaccacgtcgcccagcttcgtgacctcgcccgtttccttggcttctcgtgtcccgagtacacggggtactccgtggaccgcgttccccctcactgtgagctctctgtgtacctttacccccgtggaggtatacacggagctggccttcgcccacaccacttcactgtggccaggcctactctccagatcgcgtaccaggacctctcctggactgcgcttcgtcgcctggcccacgactacagccaccgtctcggaggctccgccttccggcagtttccacgccttccttctggccactcagacgccaggtacccttgcccgtacagcgagtctcagccagtgctgactcacatggttgagctttcggaggctcaggccacccagcacgacctactccttgaggcttaccgctctcttgctcgccgctacgccgctttggaggcccgtctggccgaggagggtgtcacctcagttgacactatctcttgggactcaggtcgcctctgccacgccagccacctgtcctcccacagctcccgcggctctgctcgcactcccagtggcccgcgctcccccagctcgcgtgcgccgtactcaccagtgtactccccctacccacacccagttagcccttcctacacccccggtcacaccccagttgcttcctcccgccgtggcccacgctttatccgcactgcgcggaagcgtgttgttggttcttccaccgtgttccgtttccactacccagctcctccaccgccagcggcccgtgctgctgccggccctcgacaggttccgccggccccttcgcgccagccgatcgacgtttcttcgactgaggagccgactacaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgccctcctaagtgcttatctaactcttacctcgccctcttctgggagtttagatggctagccgcccccgccgtgcagcccgtgcaccagctcgctttggttttgaagatggtagagtcgaagcagaagcaaatcatgaatcagctaatgagcagtctcaccacagcaaccgttcgcaccgtactgtttcccgcaacgcagaagttgagcaaccccgccgcagcaactgctcgcatcgcacagtttcccgtgatgcagagatgg

SEQ ID NO: 57460 - DNA, 1129 bp, Oryza sativa
gcgccccacgcctgcgccggccgccgccaactcccccagccgctcccttgtgccttcctcgctgccgcggcctcctcgccccaccgcgtccccgcgtccccgacatgtcgtccccactgtcgatgcggccggcagctacggccgtccctccccccggcacgcgacatccctgcccgcgccgacagacgccgccttcccccagccgctccctcgtgccttcctcgccgccacggcctcctcgccccaccgcgcccccgcgtccccgatgccggcaccaccgtccccgcccttcaccggcactaccgtccgatggggaagagaaaaagggagagaaaagatagagaagggagagaaagggaggaggaagaagggttgaagagaaaggatgatacgtgggccccacaatatattgtgtgtgtgaatgacagatgggtcccacatatatttttttaattgtaatgctacttaagcgccacgtgggacaaagactgggtcagcgctgccacgtcagtaaaaccgccctccaaaaccgctggaggagtcaaattgcacttgtttcaatagttcggggagtcgtcatatccggttttttggttgaggggtacgaattagattcggcgcacaattaagggagtcaaagtggactgttcctatacttattccatccattaaggcccactctaaagaggtgagagaggtaatatagacttattagccacgtaggcacgacacaagaaagcgaggacaaaaaatggacttattcccaggacgagcatggtgggcctgtcgccggccccagtgttattggactctgtatgggccgtaggtgcagcccgtgggctgacacggcacggctcggcgtgtcggtcggcccgactgatatcttgccttggtcgtgcccagaccgggccgtgtatagcggcccatttgatcatctgtagcctgaagcccacattgccacggcccaataaatcgcgcgatgacgactcgaccaccggaaaccccctctccgcatcccacagccacaagcggcgccgcaccacttcgtcctcaaccaaaacctccgccgccgccgccgccggagaaggaggaggaggaggagtagggagagtaagcggggagaggaaga

SEQ ID NO: 57461 - DNA, 483 bp, Oryza sativa
aacttgtccggtataaaatcgcccactctgctgcaagataatgtaaaaatttcatctagtggtggtattaactctctcttttgcagctgcttttaaatcgtcccaaggaaatccaattgatgtcaataagcttggggtagtgtcgttgaaatcagaggctggtcaaaatggaaatgtgaaactaatttcgaaggaaggcacaaacaatgtgaatgtggtgcacccagtgagttctgtgtcagaatcaacattgatgccacctccggaaggcgcaaacaacgtgaatatggtgcacccggaaggcgcaaacaacatgaatgtggtgcacccggaaggcgcaaacaacgtgaatatggtgcacccggaaggcgcaaacaacgtgaatgtgaatatggtgcacccagtgggttctctgtcagaatcaacaccgatgcagcctcctgtgatgccacctccaattccgaagcttctttctccaccagc

SEQ ID NO: 57462 - DNA, 843 bp, Oryza sativa
gagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatg

SEQ ID NO: 57463 - DNA, 1501 bp, Oryza sativa
acccgtgcgttgcaacgggtgaaaattggaacatctttaatgtaatggcccaacataaacgatcacaaccttaccgatgcttgctttacctaaaataattggattattcacgcgacaacatacatataatctaaaatactttttcgatctcattcttgcaaccaataataggatcaatcaaatcctacattgcctcgtataatcaagtctacacaaaatagaatcactttgctacatgtgcactcttctctaaataataattaaaaatatgtttgttttttaatataatttctatagatgacgaaacaaaagccgtttaagagatgaaaaaaatgattgatactatccgactcatgcgtctatcaatttaacgttttttctctaatagttttttcagagctgcttgttttttttgtaaacggtgttttttatgtgaggttttttcaaaccatttttttagaaatggcgtgctttttctaacagttttttcctcgcatgtttttttattttttacagacggcagaaaccttttttagcttttctgttctgacttttattctcacgcgtttttttgctttttttttctcatgctttttttaaccgtttttattttctcgcgcattttttctttttagttgttctatgaaaacttttctttttaaatagttagattagattagattagagatagagaagagatatatagggactaaaaacgaatagaaatcggactttttttttgccgtgctttttttcgccctttgtactttttttctcctttgtttttttattttttacgaacctttttttcccactttcttataaatcggacagaccttttttaatatgaattttttaagtagggacggacgaaggaaatgttttaaattttttaatagtagagatagagaagtatacatagctcatatacatacgtataaaaaagaaaaaatatacaatatataaagtttgtatacgtgtatataaattttatatacatacatagtattaagaaataaaaaaaagaaagaaaaagaaagaaaaaaagggaaaagaaacggaaaaaaaagaagaaaaaaaaacacccgtacgggaaataggataatataggaatatgatttttttccaacttttaagggaatcggatctactgtgtttttttcgccactttttttcataagaatcggacattttttttccgccttgccataggaatcggaattttttttgatttttctttttttcgcacattttttcgtccggtttgtttttgttcgcccgattccttttggatcggacaactttggttttttggcccggttctttttcgccctttttttttctggattggacagttttggtttttcttttctttttttcgcacttttttttgcccagtttttttatcggacaaacctggttttttcgctcggtttttttgacggacgatagaagcacctcttattttttaagtagtagtagataatggctatatataatt

SEQ ID NO: 57464 - DNA, 1501 bp, Oryza sativa
ttttggggcggtttttttgtcgccctttttcacagaatcggactttttttttgcccttttttattggacagttacggtttttttcatttggtttttttcgccggttttttgtcgccctttttttcacggaatcgaattatttttttcgccggacagttacggtttttttttgcccagtttttttcctcgctcgtccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttccaaggcggttaatttttttccgtgttgaatagaaataggacttttttttttgctgcgcctcttttttttttgcatttttctgccctttttttaaattttatggtacgataggaataggaatcagatgattttttggggcgcttctttttttttttgccttttttacgtttttttttcgatttttttcctttttttgctttcttttttgtcggacagatttgttttttttccacccggtttttttccgcccaggttttttttatcggacttttttttttctccacgatacatataattcatttttctttggaataggacagttttctttttatttttttaaactctttttaccgcgtcgatgtagtcggattcgtttcggtattttttccttttttttcctttttttttgtcggacatatttgttttttttccgcccgtttttttttcgccaggtttttttatcggacttttctttttttcgctcggtttttttctcccgttttttgacggacgacagaagcacctagagaagtgttttttttcttttctccaatccaatacagatcggatctcttccagggaaatcagattttttttctccagggaatcgaactctttttttttcgctttttttattcattaaacggtttgtctctcggacttttttttccctttttaagggatcgggtgtttttttgccagggacgggtgtttttttcgcccggttttttttttcacttttttttggatcggactttttttttcgtccggtttttttatcggacaaacttggttttttctgcccggttttttttcacccggtttttttgacggacgatggaagcacctcttattttttaagtagtagtagatatatatatatatatataatgattcttttatgcaccttggataaccctttgtttcatgaatctatgaactggctgttgtatgaattggttgatgtctcataggtttaatagggtaaccctttgctccattggataaccatttatttaataaaaccatcaagggttgccccctactaaacca

SEQ ID NO: 57465 - DNA, 1501 bp, Oryza sativa
acccgtgcgttgcaacgggtgaaaattggaacatctttaatgtaatggcccaacataaacgatcacaaccttaccgatgcttgctttacctaaaataattggattattcacgcgacaacatacatataatctaaaatactttttcgatctcattcttgcaaccaataataggatcaatcaaatcctacattgcctcgtataatcaagtctacacaaaatagaatcactttgctacatgtgcactcttctctaaataataattaaaaatatgtttgttttttaatataatttctatagatgacgaaacaaaagccgtttaagagatgaaaaaaatgattgatactatccgactcatgcgtctatcaatttaacgttttttctctaatagttttttcaaagctgcttgttttttttgtaaacggtgttttttatgtgaggttttttcaaaccatttttttaaaaatggcgtgctttttctaacagttttttcctcgcatgtttttttattttttacagacggcagaaaccttttttagcttttctgttctgacttttattctcacgcgtttttttgctttttttttctcatgctttttttaaccgtttttattttctcgcgcattttttctttttagttgttctatgaaaacttttctttttaaatagttagattagattagattagagatagagaagagatatatagggactaaaaacgaatagaaatcggactttttttttgccgtgctttttttcgccctttgtactttttttctcctttgtttttttattttttacgaacctttttttcccactttcttataaatcggacagaccttttttaatatgaattttttaagtagggacggacgaaggaaatgttttaaattttttaatagtagagatagagaagtatacatagctcatatacatacgtataaaaaagaaaaaatatacaatatataaagtttgtatacgtgtatataaattttatatacatacatagtattaagaaataaaaaaaagaaagaaaaagaaagaaaaaaagggaaaagaaacggaaaaaaaagaagaaaaacaaacaaccgtacgggaaataggataatataggaatatgatttttttccaacttttaagggaatcggatctactgtgtttttttcgccactttttttcataagaatcggacattttttttccgccttgccataggaatcggaattttttttgatttttctttttttcgcacattttttcgtccggtttggttttgttcgcccgattccttttggatcggacaactttggttttttggcccggttctttttcgccctttttttttctggattggacagttttggtttttcttttctttttttcgcacttttttttgcccagtttttttatcggacaaacctggttttttcgctcggtttttttgacggacgatagaagcacctcttattttttaagtagtagtagataatggctatatataatt

SEQ ID NO: 57466 - DNA, 501 bp, Oryza sativa
aaaaaacctggcgaaaaaaaaccgggtggaaaaaaaacaaatctgtccgacaaaaaaaaaggaaaaaaaaaggaaaaaataccgaaacgaatccgactacatcgacgcggtaaaaagagtttaaaaaaataaaaagaaaactgtcctattccaaagaaaaatgaattatatatatcgtggtaaaaaaatcgaccgggcgaaaaaagaaaaaaatagtccgatccgaaaaaaacaggagaaaaaaaatgggcgaaaaaaaaatttgtccgataaaagaaaaggaaaaagctgaaaagaatctgactccatcgacgcggtaaaataaggcgaaaaaaaactttccgaataagaaaaaggaataagatgtgacgcggtaaaaaaaaaagaaattacataaagataaacccccaagaggacccccggggaaaaaaatttataaaatacgagataaagttcgaaaaaaacggggagaaaaaaaaatctgtcctatccaaaaaaagc

SEQ ID NO: 57467 - DNA, 1501 bp, Oryza sativa
aaataaacgcgcgagaaaaattatttccatcgtcggtaaaaaaatttaaaaaaacatgcgatgaaaaaactatcagaaaaaacacgccatttctaaaaaatggtttgaaaaaaccgtgccaaaaaaaaacatcgtctattaaaaaaacaaatcagtccgaaaaatctgtcagaaaaaacgctaaattgatggacgcttgagccgggtaggatccatcgattttttgtcatctactacacgtcttttatttcgtcatatattttcctgtattggaaaaggcaaaaaagaacattcgaaaaaaacaagcaaaaaacgcgcgtgagaaaataattgtcagaaaaaacataaaaaaacacacgaaaaaagaaaagcaaaaaaagagaaaaatatggttttcgtcgccagtaaaaaaaagcaaaaagaacatgctaggaaaaaaattgttagaaaaaaatacgccatttttgaaaaatggtttgagaaaatcgcgcaagaaaaaaaatacatcgtttataaaaaaacatgtcgctcattaaaatataaatattgtcattgacatgattatgcatgaaaaagtatattatcgttagaatttttttcacccgttgcaacacacgagcatttttgctagtaacaacaataagattgaattagcattcaccagttgcaacacacagtcatataatactctaggttgcttgttattatattttcctctttcttgctttaaatattttttttcttttacactatttatccaatttgtaatatgattgtaccattatattcgttgtaattaaatctttacaataaaatatcatataattatattctaataaaagaaaaacatgtgtttcaagggactattgagttaggcagcctaggagatgttgataccatcgagccacaatcatagtttctgtttgggttaaagcaaaactgcaaaaccttatcgaataggatttttgctggtttgtttattaccagaattaggctgctgaaacattccttgccaactataaattggaggaccataggaagctttctgtcataagctgagaaaaacaatagacgagtgacgatggcgttcaaagcattcttcattattttagtggtttttgttagcagccttgcatctcctgcagtagcaagagatggacctacgatcaacccaacgatgggtaccaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacg

SEQ ID NO: 57468 - DNA, 1088 bp, Oryza sativa
aaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcaccccaatatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaatagcaaaataaaatcataaagattcacgacataagaattatgttattagatctatcatgaaacaagctaacataagtgcaactcttttcatttaaaataattttagagtaaaatgtacgggcggtccttaaacttgtaggggtatgtcatctaggttcataaattctcaaaatgcatatctaagtcctaaaacttgtcatagtgtgtcatttaggtcccaaatcaccacaaccccttgagaatcctacgtggcggcgatgtggcatgccacacgtacatgacatggcattattttgactgacaaatgggatccattaattttctttttctctttttttttcttcttttctttttctttttcgttttcttcgcattcttcttttttttccttttttaggcacgggctacagagaa

SEQ ID NO: 57469 - DNA, 963 bp, Oryza sativa
attatctattctcgtaggaccaaagtgaaaaagtttactacataaggactaatcgcagaataagtggatttccaagggggttcgagtaagaatccgggtcaaaaacgggggaactgctttaaattcgcgcgagcacgatcgacgcgcacccagccacccacccgcgccccaaatcacgaggaggcgaagccgcccatctcatcgccggagctcgcgaattcgccgccgcgattccgaccaccgccgcgccggcgcccgcgcccgctacggtactccgccgccgtgctgagatcgccgggggagccatgtcgcggtccctgagcatgaggtcgtcgatgagcatgaggtcgcgccgcgacctgcctcctccccagcaggtgagggatccctcctctccccgtgccttgggtattgcgagtgtaacatttgcgcgaggtgcgcgggattcgctgttgcgtgcgcgatgcgctagtttgatctcggtgtttttcgaccttggggcgtagaggggcgagggggtcgattacccgactcttcgtggcgaatttgaggaaactagggttctagtaccgaatcatgtccaattgcgaatctcgccattttattgtgtggaactactagctggaaaaatcaatcgtaatatttctaagaaaaattaagattacttattgtggtttgatgatgataaaaaaaggcatcaatgatttactctccgcagtccgcaccacctggttgtgcgcataatcactagggccttgtccggttacgcccggattcaatccgggccgggaatgacaagtacagtaagaaatttatgatagatacaatgagagaccgggaattattccgggccgggagccaatttactcatgatagagacaataagagaccgggaatcaatccactagtcaagaggtgtggaactaatccggatgttttgttgtccctatcatgagtaaatta

SEQ ID NO: 57470 - DNA, 16502 bp, Oryza sativa
aaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttctctaatctgcaattctgcaagcaggcaaaatgtgttccataaggagctttgcttttgtgctggtattagcattttcagttgcagtcgcggagagcagagattcatttaatgtattgggtaagtcatgaattcattatgagaatgaataatgttactaatattttctccattcttattttcatatcaattggtgtttctgatgataattctaagtagatcaagcgccgcaatggcaagcaatataacactctctacagttctaaaatataaaggaatacatttatgtgttgatctacattaattattccacatcacgttatatgcgttggtctaagattgcacaagcacataatagtaaaattggtatctgtgtgtttgctgatgacgaatgttatgagaattgcatttctgaccagtcttgcttgacacatctgctgcatatcagacatcatgagttacatttattttatctatttttgttttcattttgaaaactcttatcttcacctgtaataaaattgtaattcagatatcacacagtggtcaatatatcttcagcataagaatgattccgttctacaattttgttttcacttgaaaactctatcttcacctgtaataaaattgtaggtcagatatcacacagtggttatatcttcagcataagaatgatttcgttctacaattcaacttattagtttttgactctacggtcaatttgtcatgtatttcagctcataaaagctttccccttgaaaacaagaagacagggttaacttcagccaatggaaagctgtgtcaactatgcgagcagtactcaacggaagcactgttctacctccaacaaaatgaaacccaaactgagattcttagcatcctccaccatgcatgcgcaaacgttggacctctaaaacagcaggtctgaataaatttcaatgcccgccttggaatcagaacatgctaatttcgtcagactaatttttgtatgccaatggtttaccctgttacagtgcatcactctggttgactactacattccccttttcttcttggaggtttcgatggtaacacctgaaaagttctgtgaatcagtgcatctctgcagaaagggaacgatgcttcgcctaccatctcgaggagatacatgcggcatatgccatcatgttcttgttgaagttcttatcatgctaaaggatcctgacatgcaggtaactgccatcatttcagattttcaatggtcacaaccaattctgtattgctggggtcatacttaatcgaattcgtaattttgcagctggagatagtcgagatatttctcaaagcatgcagcaaggcagataattatgtacagcaggtaaattagtcacatttatggaaatacaaaataaatcagcctctactaaagaatcaaacacatttttcatggttgtttatacagaaaatcacttaacatcctgtaagcaaagcatttcaaatgctataatgcttttctcgaatgtgcttgcatataccgatttgagacattaagatgtcgctgatcaagcccagcacctagaaatttatctgtaattagcttagttacctgcaactttgtatcagctgaatggttttcctgatgaaatactgccattttaaccatttgcaaggcccatttctagttctgttcttctcatggcagtcctatttgtaatttttgcagtgcaagaagatggtccttgaatatacccctttgattctggtgaaatctcagaagtttcttgagacgacagacgtctgctctacaattcatgcatgcaaaacggggacacaagcatctgcagaaaccatgcttctgtctgccgcatcgtgaaaacaatgcaaatcaagaaattgctacttatttcccaagagattgaaccggtaatgaattgaagatcagatgcctgtgggaattctttactctattgctgaaacagtattgagtgaggcaaaaaaaaatgttgtatgtagagatttgtgttgtatattttgaacctacactgctctcaagtttgaagcatggagcagctgtaccaccgttcatcgatgatcgagcatacaaagttacaaactgtctgatgtcattgaatttggaagttacatgtgcaattatcgcattgtatcattatcatttgacaaacattcatactattattattcagtgtttctctgttgctctggctggtccaatggtaggtcaaatatatgaaaaaaagagtaaatattgcaagtgatacacggaaaattgtatgttaaaattttggctcaaagataattgaaacatggcatggaaggttcacttggttgataaaaatatttgggtgtccatccaatactagaacagcacttcaggctgtagaatttgctgaaaccaatggcaaatcggatggcaagcctgtaggtgcaagttcaattttttttttcacaggtattgcaagagatgcttttcaggtcagataacttatcaaatggcattgatacttccataggatcacagaagatgttgcagatccacatcttgatttagattttagaccctagtggtatacacataacattgggccacggccacaagtggattttacaagcacattttactgtgatctcatctcattgtagcctctccttcctgagcctctccagctccttcaccatctgccagtgctccatggagagactcttctcaccaaagcttgcagccattatctgtgccatcgttagccatctgcagatccacataagcagaattagtttagcaaaaggtttcatttcataatcctcatgtaaaagtaactggagatggtgtaggatgccagattgcccacactgacaggcatcagcggcacacacctgctaagttcagaacaacccaagctcctatcatcacgcatggcattgaccatttcatcttgaatcatctacaattaaggcgcaaacattatgcaatttaattaagtctgttcatgttcctgacaaacatatcagtttatttcttgatagagttgagcaagggataatcacctggtatgtatcagtttcagttgactgaggaagagacctaactgtggccaaataccatctccaactttcaagttcctcggagcttgcatttaccgcaggaacagatgatgggcggaaaggtactatcaagtcagaaggtaggatatttgattttccctcggagagaattagtagctgcacatcagttgccatttccaacttgtagaactcaaaatcatactcaacctgcaaaaatgtttaaagatgttatagataaattggtcggcaaagataatttgtagcctcatgaagtcatgaggcttattaccttctgtgactccatcaagttcttaagcagcatagtattctcgacacctttggatgtcaatgatccagactgcaagagagtctcatcaaaggtcaggtgagtaccctgaggtaactgtaaaactcctgtaaccaatctgcagcaaaatttaggtggggttatgttaaaagtgattgttgaatgatgaaaacatcaggagtaacaaattcttcataagacaaacaaacaatatgtaccttcctgattggttgtcctttctaggctgaagtgtggctgtgttgagatactcaattgacagaggaataacttgtgaatatggtagtagcctctggaacaaattatttagctggtttccaaatatagaaacactctctctgttaaagccagtgaaattcaaggagagcctaccaacggtaaccacatccaccttattacgaagctgcatggagattgagaaccaataacttagtaaactaatatgaactgtttttagcagttacaatgcaaagaaaacaacttgatgtagtatagatcagctgtgttagtgatatgacgtactctggatagaagatgcaacagtaaacattgagctgccagttcatctttccctaataccagagtaagatgtgagagcaaagattgccgaattccccttagcaggattggtgatggctgcatgataaaaaaaattgggattagttattttaaatcaacgctaaaactgttaaaccaacttctgcattcaagattcagtgctatgtacctcaaccgcaggaggccttggtagaaaatcatgagcagataagtttctccataccaagcagtgaagacggggaacctgtacaaatatttacaagcattagaagtcagaaaaaaatacaaatatgaatacactttcttttcattgttagatatgaaattgatcactatgtagtatgtacttttgatgcatgtaccttactgggaggcagctgagcggttacatcttccataaggtcaaacattatatcatccgaattatcgttaggagcagcaagttcagggtcaaatgtatatacacctatgaactcagaaacatcgttcagtttcacctgactttcaggcatatcatacacctgcaaagaatagttcaatccgtaaaccatagaaaaaaaagattgaatagaatgcatttcatgcagaaagcttaggagctctaccttcactaggcaggaaaaggagcttccaggaatatgatgatctcccccattcatctctgggacatgatgttcttcattcattgacatttctactgaactatttgagattttacaccatcatccttctgaggaaaagtaaggcagtttaaatcagattcccagtcagctaactgtatggattagatttagcatgaaaccaagcaatttggagaagcatatatgccataaatctactaagacatttaagttatcctactttattagcatgcagaattaatctacaaccaagcaaggcagttgcgagactgtgtaaatgttaggagactactaggaaagaaaaatcaatcttccttcttaccgtcttcttgctggatgaagaagtctctccactaccactttctgaaacctgcatcagtcaactcattagacgacaatactacttgttaggcagcaaagtgtcaaaagaaaccattgcaacaaacttagcaaaagcttacatccatggcgtcattatctgcacccctcttccttttctccctttgttcagatgtgaagcagcttgctattctgcgcaagtcagggccaggggacgactcgcgtgtccaagaattttgtccaggcacctgaaataaaccaatggcattgtccaggttgaattccaacataagctgcttatcagcaatgagtaagactaggattaatagcaaatgagcagcaggtgctcttggaagcggcaacatacaggcacacagtggaaaagatggcgctcccagagatgtgaatcacaagggtgtggcattgagaacggcgaggaatcggagaatttgtttgtcctccaagtggagccatcctacacaaataatggttcaaaataagcataacaagcactaaaatgcagctttacattaacttatgtactaaattccaataccttgaaagcaccaacatagaactcgttcccgagcatgtcctgaaccatcccccggaaccgaacaagggtattcggcttgatcaatccaagatttgattcatccaacaccggaacctggaaaggaaaatattcccacattccgtcattccctgaacttcctaagattcatttacacccacaatacaaaatatcctctttctctcttttttttgggacaagctcaacataaacatatgtgacattctaagtatctgaattgaaatgtttgcaagaacagcaaaaagcagttatctttcacccaacttagatctgagagcatagtacttcctaaccacatctactgatgattccaaatttaccctaagaaaacctttaatctccccgtctcatattcattatagacattcaaagatcactaactttgacgatattagggtttcagcgatctaccaaataacatcattttcagaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactggcggcggcgcttcccgccgttttctccccctcttcccgccaatgcgcgcctctcctggtacttggaccttggtgcgtctattgggcctaatgggccgtcctagcattcggcacgggagtgcggcccgtctgcgggtgcgcgctgctgccgggccgagatgcctccggcccatatgaggcctgcttattggttagcgatccaaatctggaaaaagtccactttgactcccttaaatgtaaaacgaatctaatttgtacccctcaaccagaaaaccggttagaacgactcccccaattactaaaaccggtacaaattgactccctcggtggttttgtaggacggttttgctgacgtggcgctgatgtggcgataccaacccggtcttcattccacgtggcgctgacgtggcgatactaatccggtcttattccgcgtggcgcctacgtggcattagaattaaaaaatatctgtgggacccatctatcattcacatataaaatatatcgtgggacccaccgacatgtgggacccactgacatgtggggcccaccgacatcctttctccttcccttcttcttcctcctccctccctcctctcttttctctcccccttttctcttccccattcggacgcatcagtggcggcagcggccgggtggattggcgacggatctgggcggcatggccgcggcccctgcgcccccccccctcttctgggcgtcggtttcctcgccttgtgtgataactaatactcccactagctgctactactacatcactagcttagctaatgacgtcgccaagcaaccaacaacactaaattaaccaactaaatacaagctaattaagctagtgtcgtcgtcatgttgcctagctagctagctagctaattactactccggtgagtggatggcgccatgctgccatggcggcgcagcagcggcagcacatgtccatgtcagcgtcgtcgtcgctggtgacgagcctgagcaactcacgcgaggggagccccgaccgcggtagtggccttccagagggtgtcggcgacggcgatgtccgcggtggagtgcaccgggacgatggcgacgccgtcgttgctggaagggagattcgggcggggcgggagctcgcggcggcggtcgagcctgaacgcgttcgacatcatctccttctctccggcaactccagcgccggcggcggaggtggagctgtaccgccgcggcagccgcacccggcatccgaacttcccaccgccgccgtcgcctcgctgcaggatacgcgacaacagcgaccgcggtgactggcagctctcgatgccgccgcagcgccgctctgccctgccttcgcgccggccttctccacccaccgccgcccacggcttcacgcactcccttgccgccctccgctccgccatccgttgcctcggcaagctctccgcgctgctcgccgacgggaagagaaagagagagataagggagagagagggggaggaagaaaggttggaaaggctcgccgacaggaagagaaagagagagataagggagatagagggggaggaagaaaggttggaaagagaatgatatcgggaccccacatgtcagtggatcctattataatttttgtgtgtgaataataaatgggtcctacatatatatatttttaaatctaatcttacatcagcgccacatgggacgaagaccaagtcaacactgccacgtcagcgccatgtcagcaaaaccgccctccaaaacaaccgagagagtcaatttgtaccggttttagtaattgggggagtcgttctaaccggttttttggttgaggggtacgaatcagattcgttgtacatttaagggagtcaaagtggactttttcctccaaatctcgcgcacgcgttgaccgttagatctaatcgtgtggttcagatcaagttgtggaacgtgactgagtgaagtatattttacacataggcccttcaattaatttcataatattgctagagagcgcgggccgatggttgagccgtccaagagcggcggcggcgcggcgctccggcgagcggcggccggagtcgctctcccggttggcgttgtgtatgtgatagaaggccaggaacccgcgccattgctcttctcaacaggagcaggtgagatctctgacctgtcaacggcaaggtcgtcttcctcgtcatggaccttctctccctcccatggcgtcgcccacctccgaggtctgtacactccataaaccaacctctcctcctcccataacgcagcgttgccggatctacgccctccagagtctgaacccctccgaatcctctccgttgcgtgtctctggggtaaagtaggctatggaggagcaacttgctttctatttacttcggatgctaagattgttcatctcaaattgctaatacatttcgcataaagaaattgctaatacatgcctccagatgccttttttttctcaagtcatcctactgagttggcgactagtaggtgttaattgctgctagttttcctactgaacatacctaacaatactgttatgggtgaatttttgtaggctcagattttcttactgaagaaataacagaagcaatcgatggaataactcaacaacatctcaggtgtgctccgaacctcactgccaaagcaaaattctattgttttcactagtaagcaagtgttacctataaatcacacatgccaactcgttgattcagaacatcactagtatgtaatgtaaactctgtatatcagtatatgatgtgtgcatcctactggcttgtgtaactctaaagtaaataaatataacaccattatcacccatacttacagtgattcaaatattatcttgcgacaacactgacatggccctgattacaataatgcactgcaagtgaccttgatacagaaaaaagtttatttcaatacatgatacagagggctctctgtcttactgtagcctgttttctaatgggtattccccatgatactacaacagcaatggccaacccaaggccgaatcccaatccagaaaagaggaacaacacaatatctacggatttcttcttggaagggatcacattcagaattgtcatgttgatgcaacctttagatagcggaggaccacacaaatcattattccccagaaatgagctgttggtgaatgtcaagaaatgaagtgattcaggtatttttcccttaagcttgttgtaggataggtttagcatttcgaggaagtctaaggatgctaattcttgtggaatgactcctgaaagctgatttgaagatagatccaaagcttccagctgcttcagcccaccaagttgagatggaattggcccagtgaggaagttatgtgacatatttatcccatgagttaaaacaagttccccaacaatttctgggatgctaccattgaatgcattattggagaaatcaatgaatacaagggttcttagtatttgagcaagtgtggtgtcatgacctttgtatgtgagtgaggctttatatctatatactagtcctacacttggcacagcatgatccatgaccaatgatgtatttgtgtctatatgtagcatcgactccaacttcttaaaccacttgtctttgggcaacggaccagagaagttatttgaggatatgtcaataattattgcatttggaaatgcacatgtgctttcttcatcggtgagagattgaacgacatgtccaaatagcttattggatttcagtacaagcacttggagtctacgaagtttactcatccagcatgggaaaatgtcatttatttgattgttcccagcatcaaggatctccaaattttgacaagcaagtagggatctgggtagctgtccttcaatcctattgccactaaaatatagtgcatgaaatgagcagccttcctttatagtatctgggatctccccatcgagttgatttgcatttagatttaatatttgtattccattaacgttctcgatcaaacaagatggtattgagccactaaagttgttgttagagagatcaaggtattgtaattcagttgcagtacagaaagatggtgggatttctccggagaagttgtttccaggggcattgaaaagtgtgacatgactaagatgggcagtgaaattaaaaggaatcgatgagaacatgttgtttgagtaatctagcaatcttgcagaaccttgaggtataggtatagtcccctcaaacatgttgttgctaagatcaagccaatcaatttgtaaaggaataaaagggttagatccaacactagtaaatttattatgtgctaaaatcaaactagcaacgccagaatcattccaagactcccatgcccacgatggtatagccccatggatttggttttttgaaaggtcgagccaaaggagttcatcttgactcctcaagaaatcagggaatttagtgatgttgcaacccgataaagctaatatttgtagtttagggatgtgtgttgatgaagaatcgacttttccatccaccaccacaagattattatcagatatatccaagtaacggaggtgttgtagtccccataatgatgcaagtttcattgtaccgacaagattgtttgaattaaggaagagtgtgctcagattggtgaagtttgagatattttgtggtagttttcctgaaaagttgcattcatacaacactaattttctcaatttcgttaacttacctaaaaaagaagggatagatccagttagaccacacctagagaattgaaggattgttaaagaggtaaggtttgtgatccatgatggtatggttcctactattgttgttccagaaatctccaacgaattcaatgatttaagccacccgattgatgagggcagctcccctgaaaactgacttgcaccgacgccaaggttcttcaaatatttgagatttccaatggaacttggtatttcaccgtagaaactagtctcagtgacaaatatattttccaaattactagcaactgagaaatttggtaacgaatcagatagttctagattattgtaaagatcaactgttactaatttcttgtgttggaagattaatggagatacctgtccttgaagaaaattgtgtcccagttgtagaacacgcaaagaggagaaggtggcgaagtttggaatgggaccagacaaatcattaaaccgtaggtcaataacagcaagcgagtgcatggcagaaaaggatccacaaataggaccagagagcccacagtttggtaagctaagaacccgaaggttaggagtggacgaggatagagcatcgcaccatgtcatcccgttgtcggacaagtccacagcgccgaggtagagctccctcaattttttatgatttgcgattaaagtttcaaagtttggctctttgagcacgctagattcaactgaatcaaaggacaacacagaatgaccttgtgtgaattcttctacttcaaatcgagtagataggtcgagagatactagatttgttaggcgactgatgctagcggtaggtacctggcccacgaaatcggagctggagaggttgagataggtgagcatggtgagccgctcaaaccctgtctgcgggagttaggatccattgaagctgttgcaagcgaggttgagggaggttagatggaagatcgcaggatcaagaccgccgctctccaatctacgccctcccaggtccagagacgtcacacgcccatccccattcctgcagtggatgccctcccaatggcaacagtctgtgccggccttccatgacccaaaggtggaactggagtttttggtgatggagaaagaacgtttcaaccggagcagcgccgatgcctggtccggcaagcatggaacaaccgccggcggcagggctccggtgtggttggcgtacgtagctgctgatgaagaagggacaataatgagctgggtgtgtaagaggatcagcatcaacggcaacaccaatggcttgtaacgggtcattgtggagtagcaactagcaagtacagcagtttgattgggtttactgctagtctgctatacgtaagagggtgtatcgatcggtgtatggacggaggattctaccgcataccctcgcacattcttatacacgataactcgccaactcggattcgtacgttgctagctggattaacagaagatcaactcggccagccagtcgttgcttcggtgttctctactattagtagaatagtctaagccgttgatttataaggctatatcagtactttgctacttatatgattagggataattttgatgtttatttatggatctgactatccatttattgggtgatttctagaaaaaaaaatcatccaaattttttccaactttagatttacatccaacggacaaaaaaacaaatacatatttatttacacaacatttttatcaaaattacagtacacttatatgtcatatcgactgaatttgcaaatgtaattttagttatataggactgtaattttatatttaaaaaataacaaatacatatttacttacacatcttttttatcaaaattacaatccacttacatatcatatcaacttaatttacatatgtaattttagttatatagggctgtaattttattttttatattttttaagtaatcgttgaatttatcgttgatggtgctgcttctatcgtttcttcgcgttgtagctccacgcgcccagctcttgcggtagcgccaagtagtcaaaggcgattgcacctctatatgctactccatccgtctctaaatatttgacgctattgatttttctaaatatgtttgatcattcgttttattgattcttttcctatcatttgatttattgttaaatatacttttatgtatacatatagtttagtttttgaataagatgaatggtcaaacatatttaaaaaagtcaacagcatcaaatatttagagacggagggagtaaattatttttattcatctcatcagtcatgcaatacacagctacgtacaaaattcaggtttcgcatacacctacaacaatcgacacagaatagagcaatcaaatatcaatacttgatctgcatccattcaaaaaaaaaaaaacttgatctgcatgggggaggaaatggatggacaggaggttatcttgtactccctccgtcccataatatagtaacatagaaccggatgggacacagtacaacgaatccggacatctatgaaatatcccatccggtcctaggttgctatattataggacggagggagtataataatatgctgcttcagtgcctctcacagccagaaccgctgcaaccacaacagccatggttgcgccatctccacgccttcacagggttggaaatttcggacattttggatcccttcgataagatattattttggtcaatttttttttaaaaaaaattcataaattttgataatatttattcaaatttaaataaattttgttcaaaattttgaaaatttcagaccgaaattttggtattttagtgatgtccgatcaaatcggctaaacccaaaagtttaaccctgtaccttcagtcactgatctgttgtcagttgtcaccatcgccccggacctcagcctcctcgggcaggctcctcgccctcaatcatggatcagccgccggcaaccgcaatagggaccgcgccaccattgccttccaataccggcagacgggatgcaccggctgaggagcatgtctccccgagctccgacgagccaccgaacgacgaaaataaggacgagcgatgtgtaaacgtataagaggacaacaaagacgcagattagcaaatggaggaggcacgaggtgggaggcggcaggtgttggcgaaggatgtccaggagcagatcagccgccgccgcctgcgacggctgcggtagccgcctccgcccccttgcttctgtagcgccgtctcgactgatatgcatatttacaaatttatccctcaacttctacttttcaatggacattttgccctctcacgtttctactcctgttaataagatggcagtataaatacatctagtctcttggataaaaaaaaatcaacggtttagattgatttttactataagtaaagagcaccgaagcatgactttgtggcgaaaatgatttagccagaagttactgtatacgcatagcgacttggtaattatttatttggttttgaattacttatacttttataaaatattattggattcctcgtcagtatatatgccgaggctacatatgaaacaacttctgcttgctgccccctgggcagaggaagatgtatccgttcacgttttgtgcttctaatatattaagttcttagaaaaaaacttcgacggtttatactccctccatactcgtaaaggaagtcgttttggacagcgacacggtctccaaaacagaactttaactttttatttctataaaaatatttattaaaaagtaatatatgtatatttttatgaaagtattttcaagacaaatctattcatataatttttatattttcaaactcaataacttgagagttattcatgatttatattctcaaggtttgatttaaacattgttctaaacgacttcttttattagtatagagggagtatatgtcttggtgtttcttaaatcttgcaaagcggcagatggaaaagtactaccagtagtctacatgcattgattggaagatggttaagctaaaaatgatctgatacttagggctcctttgatttgtaaaaaaagtgtagaaaatttgaaggattttaatcctatggaaaaattttctatgaaaccctttaaaacaaaggactgaatcctatactatcctttaaaatttctatggaatgggtaatcctatagagattttggaggaaagttagcaagaggtccaacctcttggaaaaattcctttgagtctatctctcttatccgattcctgcgtttttcctgtggtccaatcaaacggtcattcctgtgtttttcctgtattttccaatcctctgttttaaaatatatattcctgtcagaatcctgcgtttttttctattcctctgtttttccattcctgcgattcaaagggtcctaatggtggaggagagattaatgatgttgtttaatgggtggggactggggggaatcggaggggactttcgcctaattctgtaaagatttgtcaatccaatggttgaaattattgtgcctgtttgtcgtagatatagatagattcggtccatcgctacatacagacatgcgcaacgttctatgcacggcatgcatgggtacaatgctaattctctgcagatggagtagtaacgagtataacagggaggatgtcgtattcgtttcaaaatatttttctttttattggattgagtaaaacatatatatctttaccatgaattcttaaaaatatatactccctccgtactcgtaaaagaagtcgtttatgacaatgtttaaatcaaaccttgagaatataaatcatgaataactctcaagttattgagtttgaaaatataaaaattatatgaatagatttgtcttgaaaatactttcataaaaatatacatatattactttttaataaatatttttatagaaataaaaagttaaagttctgttttggagaccgtgtcgctgtccaaaacgacttcctttacgagtatggagggagtataaaccgtcgaagtttttttctaagaacttaatatattagaagcacaaaacgtgaacggatacatcttcctctgcccagggggcagcaagcagaagttgtttcatatgtagcctcggcatatatactgacgaggaatccaataatattttataaaagtataagtaattcaaaaccaaataaataattaccaagtcgctatgcgtatacagtaacttctggctaaatcattttcgccacaaagtcatgcttcggtgctctttacttatagtaaaaatcaatctaaacccgtgatttttttttattcaagagactagatgtatttatactgccatcttattaacagg

SEQ ID NO: 57471 - DNA, 11529 bp, Oryza sativa
ctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagtgagcctagtgcttaggagggcagatcgctggccgcaaagcgagtgggccggtggcgtacatgaagttatagtagccatggtcggcccaccgcttgccctcgtcacggagcggcgcaccgtcacggagcggcgcaccctcaatgctagagtagttgatgtttgtggggttattgcattcgaagtccggcaacaaccgaagccgcacatagcacgccttgcgcggatcgcccatgtagaagtcggagactttggtctcatcgagctccacgaggaagtagccattatcgttggcgacggcccgacggcacctcaccatgacgcgattgttggcgtcgtggcaaatgacggacacttccgccttaggcagcggcttcacgccttcgaggctgtgtgttcctttgcgcgcagctctggcagtacaccataccctccaccttcaccagcagcttgtcgctgtgggccggcggggtttactgctgctgcggcggcggtggcggtgatggtgatggtgtggtgtagccatagtttgcagtggcgccggcggccaggagggacacgaacatgaggatcgcgagaggatggaaggcagccattgctctgagctagctcgctgtgctcgactgatgagatgttttgttttgaagctttggctgtgtcgaaacgtagagacgtgtgggttatatactgcatgccatggactaaacatgcggacatgtagatggaaattaagcttgattttgattaagatcacagtttattttttgttattcgattctgacaatatataatgattagcccggcgaaagaaatgataacatgtaacgattgatctgtaaggcacttttaagagaagaaatcacatactcatgatctgcttggtgattagttaagaatttgtagactataaagaatattcaggatgaagatatatatgcagatttgtcagaacgtgctgcccgtatatgtccctaacggcactgcaatatggtagggcagcctgctcgcgctaaaaaatctacgaaaatagctatttttgcgtgcaggagtttgagagaaagtgagagagtagtatgtggaggagaggaggtgaaagataggagagatgataaggatgacttgaaaaaaaaaattaagtgctaagagagaaagatgaggtaactcaaacttctgggcgggcctttaatatggccgtctgcgaaaatatattttcccgtgcagccccttaagaaattcgtatagaaaaataatcttattttcctgtgcagcagattaatagggtcgtctgcgaaaatacaagtcaattttcacagacacggatacttatggtccgtctgcaatatattgaggtgctcatccatgaaaatcatttttatagtgattatttatgtcagtagctacattattctccatagagaggcgtgtgggttatatagtgcatgccatggactaacgtgcagacatgtaaatggaaattaagcttgattttggattaagatcacattttatttcttgttattcgattctgacaatgtatgatgattagcccagcgaaagaaatgataacatgtaacgattgatctgtaaggcacttttaagagaagaaatcacatgctcatgatctgcttggtgattagttaagaatttgtagactataattctataaagaatattcaggatgaagatatatatgcagatttgtcagaacgtgctgctcgtgtctgtccctaacggcgcttcaatatcttgttgggcagatgatttccctaatggcctagccgcatgtgaaaataattgctggccgtatgtaaaaacctattatgtagtagtggcagtatgtggagaagaagaggtgagagagaggagagaaggtgaggatggcttgaaaaaaaattgaaatgctaggagggaaaagaggagataacttaaactactggacggacctttaagatgatcgtctgcgaaaatatatttttactactggacggacctttaagatggccgtctgtgaaaatatatttttcctgtgcggcctcttaagatgtccatctataaaaataaccttattttttcgtgcggctgcttaatagaatcatctataaagatatgagtcgatttttgcaaacacggatacttagtccacctgctatctattcaggtggtcatccatgaaaatcatttttaagtagtgattatttatgttggtagctacattactctccatacagataggttttgctattttactcgtgacagatttttgggcttctgtttttttatattttgtttataggattttgcatcaagattcgtgtttatgtaattctaacttccaattacactcatttatttagtacgtttcatgtagtattaaagtaccacgacgtattttttctttgggcctgaaactgacgaaaagaaaacgggtatatttttctcattgtttgcagaaaggagccatataggcgctatgtcggctaaaattgggaacaataccaccgaggaactttgtttgcacttattttgaaagttggaagatgcattgtggatgtgtttagttgaaagttggaagttggcctgtctctggttttttatcgagggatgattttctaattcggtgataaaatgagggatctccgctgtactttttccacatcaaaattacaaattttctatgggcctcagacatctggcccaacaagggtccgactcattcttcaattttcgaaaatacgtaacctctggtatcggactaagcaaattacgtacgtactcaaaattaaaatttaaggtatagttaaatttagcaaggttttccaaatagcaagtgatttttaatttgtcctatatattacgatgcttgtaacaacaaagcctaattatagaaaattacattcaaatctcagttcaacggtattatttttatcaaataaaatttaatttatattagatttattggtcgtgagatataccagggttgaattaatatttatgcataccttgtatttttttggaaagagggtacaaatggttgactgaaaaccacaacaagttttcttaatcgaaaattacatcaactttgatttgcagcaaactaatataatcataaaaaaaattacaacacaatcacacaagggcaacagcaattaaaaaatagaaacacagaagaaccatgtatccaccgtccaattagaactccatgcctcccaaattgatgaagcttcataggaagcctagtgcttaggcgggcagatcgccggccggaaagcgagcgggccggtggcgtacatgacgttatagtagtcatggtcggcccaccgcttgccctcgtcacggagcggcgcaccctcaatgctagagtagttgatgtttgtggggttgttacattcgaagtcctgcgaggcccgaagccgcacatagcacgccttgcgcggatcgcccatgtagaagtcggagactttggtctcatcgagctccgcgagaaagtagccgttatcgttggcgactgcccgatgacacctcaccatgacacgattcttggcgtcgtggcagatgacagacacatccgccttaggcagtggcttcgcgccttcgaggctgtgtgtgtttctttgagcgcagctctggcagtacaccataccctccaccttcaccagcagctttttgctgtgggccggcggggtgtactgctgcggcggcggtggtgatggtgtggtgtagccatagtttgcggtggcgccggcggccaggagggacacaaacacgataaccgcgagaggatggaaggcagccattgctgtgagctagcttgctgtgttccgtactcgactgagatgttctgttttgtagctttggctgtgtccaaacgtagagatgcgtgtggattatatactgtatgccatggactaaacgtgggtacatgtagatggaaattaactgtcttgattttggatgaagatcacattttatttttttttgttatcgattctaagaaatatataatgattagcccgcgtagaaatgctaacatgtaatcattgatctgtaaggcactttgaatagaagaaatcgtatgctcatgatctgccaggtgattagttaaaaattcgtaggcgataaagaatattcaggaggaagatatgcagatttgtcggaacgtgcagcccttaacggcactgaaataccaggttctccacccaggcagatgatttttgccgatagagctacagtatttatgtcagtactctgaaaaggagtatggcatgtcatttcctactcccaccgtcccatctagaacgggacgtgacatattatagacaatgaatgtggatatatgcatgtccagattcgtagtacatactaggatatgtcatatctaatactaagttggttttttatgggatggagggactatgtaaaatataggcaaattttgctacaggacattgcgactttatggttttagctgtaggacaccgcgcaaagtaacttttgagagaagacactatgtaaatgtagttatttgccaccaaacaccacatccattaaattagtatttttgtgctgacgagcctagaaggggcctactttgttaaacatcgtgaccgaattgcccctcttcctcttcctcctcctcctctcctctttcttccttacctctcttcatctctctccctactttctctcttctctcttctccggcgaagcatacgacccacaagcggcggcgtgaccaccagagccgcagcggcacagggaaccactcctcacggcgccacccaagcgtgaactgcaggtacgccgcgagcagcagccatgccattgcgcgcaccaccctgacgacggcctccaacggtatgttcccggcggcgaggaacaccgcgatgtcgctgagctcaacgtggaggtatgagaatgagccaccggcagaggggatctccgtggcgagcagaggactgggggcaccagatccagcgcccccgctgagctcggaccaaggagagagggggcatgcaacgacggtgggggagggggagcagcggagagggggcaacggaggacgagcggtgccgccagtcgtgagagtggatgggagggggaggaggagctcgtggtggggggtgggagaggaaagtgtgattagggttagggttttaggcaccaacggttttgatggatttagaatcgatccgagccgtccatcaaaatgagtggcttagatcgatcctgtgtcgggccggcctccatctcgggccatagcactgttgggccacacgctctttatgggccggacgcgcaatagcaggccgatagggtccaatggggcctttttttctttttttagaacctttttatttgtaagcaacatattttttttatgggctcatatcacgaaaaactaaaccctaatcatctaatatttttatatttgctataattttagtttacccgttggccgttgcaacgcacgggcatcttttctaataaaatttaatttatattagatttatggttcatcagatattactagggttgaattaatatgtatgcacaccttgtttttttttggaaagagggtacaaatgattgactgaaaaccacaacaagttttcttaatcgaaaattatatcaaatttgatttgcagcaagctaataaaaacataaaaaatttacaacacaatcacacaagagcaacagcaattaaaacagaaacacaaaagaaccacgtatccaccgtccaattataattccatgcctcctgaattgatgaaatgcgcaactgtgcaagtgtaagtgttacaaatgcaggcatttttatagggtgcctagtgcttaggagggcagattgccggccggaaagcgagcaggccggcagcgtacatgacgttatagtagtcatggtcggcccaccgcttgccctcgtcacgtagcggtgctccctggatgctagagttgttgatgtttgtggggttattgcattcgaagtccagtgaggtccgaagccgcacatagcacgccttgcgtggatcgcccatgtagaagtcggagactttggtctcatcgagctccgcgcggaagtagccgttttcgtcggtgactgtccgacggcacctcaccatgacgcgattcttggcatcgtggcagatgacggacacctccgccttaggcagcggcttcgcgccttcgaagctgtgtgttcctttgcacgcagctctagtagtacaccatactctccaccctcaccagcagcttgtcgctgtgggccggcggggtatacctgtggcggcagcgggggcggcgatggcgatggtgtggtgtaaccatagtttgcggtggcgccggcggccaggagggacacgaacacgaggatcgcgagaggatggaaggcagccattgctctgagctagcttgctgtgctccgtactcgactgagatgttctgttttgaagcttttgctgtgtccaaacgaattaaattttaaaatatactgtttatccaatttttttcaggaatattcgggataaatttttttttttacaaatataccatcaatctcgcgcaatcgttttacgaaaatgacgtggacatgacgtcaccagcggtatcgcgtgacgaaagcgcgagaccgtgcggtatcacgcggcagtggcgcgagaccgcgcggtctcgcggaagcaaagagcgagtccgctcggtatcgcttgttcaagcagcaacaccggcatggcagtcccggccgtcaatggttaattacctaattaactattaactaataataattagtaattaattatcctgattagtgattaattaattgctaatcaggataattaatcaacaggcatgtcagtgcggtatcgctatttcaatcagcgagaccctttggttccacgagaccgtgcggtctcgcgcagttgttgcgcgagactgtgcgctctcgcgctttcatcgcgcgataccgtccgtgatattacgtccgtgtcattttcgcgtaacgattacgcgagatcgacggtatatttctgtaaaaaagtttgcatctcaactattctttaaaaaaaatgaggaacaatatatttttaaatttaattcatgtccaaacgtagagaggcgtgtgggttatatactgcatggcatggactaaacgtgcggacatgttaaattaagcttgattttggattaagatcacagtttatttttgttattcgattctgacaatatataatataatgattagcccggcggaagaaatgataacatgtaacgattgatctgtaaggcacttttaagagaagaaatcacatgctcatgatctgcttggtgattaattaagaatttgtagactataaagaatattcaggatgaagatatatatatctatatatatctatatatatatatatatatgcagatttgtcagaacgtgctgcccgtgtatgtccctaacggcactgcaataccatgttgagcagatgatttttttgcctatagggctaccactactaagaaagagatttttgcacatgggccaaaagagattttcgcgtacggttggacagcccgctcgcactaaaagatctacgaaaatagctatttttttgtctgggagtttgagagaaagtgagagagtagtatatggaggagaggaggtgagagagagatgataaggatgacatgaaaaaaaaattgaagtgctaggagggaaaagaggaggtaactcaaacttctgggcgaacatttaagatggctgcctgcgaaaatatattttcctgtgcacctgcttaatagggtcgtctgcgaaaatgtaagtcgattttcgtagacatggatacttattgtccgtctgcaatatattgaggtgctcatccagaaaaattatttttatagtgattatttatgtcagtagctacattattctccatacatataggttttgctatttttcgatatgttgttcatatgattttgcatcaagattcgtgtttacgtagttctaacttgcaattacacttatttatgcagtacgtttcatgtagttttaaagtaccatgacgtcttttttcttagggcctggaactaacagaaagaaaacgagtgtatttttctcattgtttgtagaaaggagttgcataggcgctatgtcagctaaaattggaaacaacaccaccgagaaacttcgtttgcacttgttttgaaagttggaggatgcgtgggacgattttgtaattcggtgataagatgagggacctccactgtactttttccacatcgaaattacagattttgtatgggcctcagacatctggcccaacaagggtccgactctttcgccaattttcgaaattacgtacgtactcaaaattcaaattacgactcattcgctaagggtatctgactaagcaaattacgtaagtactcaaaattcaaaatttaaggtatagttaaaattggttttccaaaatatttagtgctttttactttgtcctatatattacgatgcttgtaccacaaaagccataattataaaaaaattacatccaaatctcagttcaacggtattatttttatcacgtaaaatttaatttatattagatttatggttcgtgagttattactagggttgaatcaaaatgtatgcacaccttgtatttttttcgaaagagggtacaaatgattaactgaaaatcacatcaagttttcttaatcaaaaattacatcaagtttgagttgcagaaaactaataaaatcataaaaaaattacaacacaatcacacaagagcaacagcaattaaaacagaaacacaaaagaaccacgtatccaccatcaaactagtttctcccaaattgatgaaacacgcaagtgtgcaagtgcaagtgtcataaatgtaggcacattcatagggagcctagtgcttaggagggcagatcgccggccggaaagcgagcgggccggtggcgtacataatgttatagtagccatggtcggcccaccgcttgccctcgtcacggagcggcgcaccctcgatgctagagtagttgatgtttgtggggttattgcattcgatgtccggcgacgcccgaagccgcacatagcacgccttgcgtggatcgcccatgtagaagtcggtgactttggtctcatcgagctccgcaaggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcacttttaagagaagaaatgacatgctcatgatctgcttggtgattagttttgaatttgtagactataattctataaagaatattcaggatgaagatatatatgcagatttgtcagaacgtgctgctcgtgtctgtccctaacgacactgcaataccatgttgggcagatgattttttgccaatagggctaccactaggacaaaagtgatttttctcatggctcaagagaaattttcgcgtacggtaggacaacccacacgtactaaaatgtctacgaaaatagctatttttgtgtacgggagtttgagagagtgagagagtagtatgtggagaagaggaggtgagagagagaagagaagatgaggatggcttgaaaaaaaatagaagtgctatgagggaaaagaggagataatttaaactactgggcggacgtttaagatggccgtctgcgaaaatatatttttcccgtttggcctcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagtacgaatcttttgagcctaattacg

SEQ ID NO: 57472 - DNA, 1162 bp, Oryza sativa
tatgtcctaaccaattttattctaggttattatatatggggacgaaaagagtacttagtacttcacgtggatggagaatagtgcgtttggatgttgcaacctgtttattcctagtattgggtgttcgtgttgtagacgcttggcgtgactgtttatttcccgagttattatattgtattttttctgctttatccataaaatacgaatatatagctctatttttttagggagtattttgggggagggagtatctcccggtgaccgtgaagaaaaccaaattggtcgactcttctgtcgctgttactaatcattagaggtgacagttcaggtgttactttagatttcagcggagccaccgtttcgcttattttagcgaaacgacatatttataaacggaaagtaatttgtaaataaaacttttatatatgtgttctcagcgatctaaaaataaagactgaaaaataaacttcgatgaaaaaaaccttaaaatcagctttaaatttaaagttaaaaattcaaattttgaatgataagcataagcataaacgaagatagtccatcacccagattccattgccggagctaagcacacgtgggaaaaggcgtcgtcctccaaacaagcaaaaaaaaaagaaagtggtccacgtggactgaagccattggccaggtgccctcatcgatcaatcgcaaaatgcctcaggcctaagaaatctctaatcctggtcctaaacttcacgagcaagtcactcggcatcccggaagattccagtaggcgcggacacaccaacgcaaccgtcgccaacgccgccgcctccgcccggctcgggtcggaaactcggaacccggcgcgtccgatcgaagcttccgacctcctcgcccgcgccgacccggccacgtcaccaccacccggtgcaataagaccctggtcggcgagcgagttcgaggcaaacggcgcccccattcgaaaatcaaaatctcttcctcgcctctctctctgctctctgctctcctcgccttcctctctcgccagttgctccgcgtcctcgctcgagtgcgcggcgatccatccgggagggagaggtgcgtgcgctctgatcgctcgggaaaccgtcgtcctgctcgatcgcgctggttgatcgcgattcgccgcagcggcattccg

SEQ ID NO: 57473 - DNA, 542 bp, Oryza sativa
tatttattgacgacataatatatctagccacatttaaagtttggaaaaaagctagcataacaacattgactcaatatgcatctacatgcatggctacaaaacattttagaatgggattattgtcaacatgttcgcacgcatagccgcacatactaggaccccaaccagcaaaatcgttgagcttgcctcggatgtagaaggtggagcatgacctcggcatcgtagagcacgacgagctcgtacgccttcttgaccagaccattcttgtgcttggaaaaggtcacctgtctgttgatcttgttctcgatccgcttcagctccaccctccccgtcacaatgcctacctcatccacaacctcctcaccctcacgctactcctctacaacctagaaacctttctcctgcagctaacatctagctcaatcgattgatctcacgaaacgaagctatggaatgtacctagacagagaaaaaaaaaggtgaggaggaggaagggaagaggagagtagagttttaaataggaaggggggatcggtgcctgt

SEQ ID NO: 57474 - DNA, 507 bp, Oryza sativa
atgtatagacaaggatcggatgggatgtttttatttcttatatgtatgggcttcatataaggatgtattgaggattctatggatgtaaggaatgatgttgggattgatggagggatgtatgttttgtatggttctcaggatatagcactgcctgtaatttctgtcatttgatgtttgcctgtgttgtgtgcaaagttttgctgaagttttagcagggctggcacgtcagcgccatgctaaatggcgctgacatgtccaaactcagcgccagtgcacctggcgctgaggtcccagcccagccatccagaaggcttgctgggctgggccacggccgaaacggccaagtcccacctcagcgccagatggactggcgctgagtttcccacagtcagcgccattatggctggcgctgaggtcctagcccgcaagccatccagaaggcttgatgggctgggccaaggccgaaacgcccaagttccacatcagcgccaggttgcctggcgctga

SEQ ID NO: 57475 - DNA, 20364 bp, Oryza sativa
aggatcattcaccgagacctgaaatcaaacaacatcctacttggggaggacatggaaccaaaaattgcagattttggattggcaaggctactagaagaaggtcatactaatactcggacaactagaattgttggaacattgtaagctcatgtgcataataaaaccttcactcatagagatattgaatgtgcaagcctaatgcttatcctctgcagcggttatatggcacctgagtacgcaatacacggaaatgtgtcaaccaagatcgatgttttaagttttggtgtgttggtccttgaaattgtaacagggagaaggaacctcaattctgacgatcatgatcgcgggaatctccttagtgatgtaagtgctcaataaggttgagcttgctcctgtacatatatacttttagtgcatttacatactgcaatattcatgatatcatacccgaaagtactctatatcaagttttagataacaaactaatttcaaatcgtctaacaggtctggaattgctggacaaaagggacggttacacaactaattgaccaatcacttgaagagcaattccgaagacaagcactgcgatgcattcatatcgggctgctgtgtgtccagtcagatcctgatgacaggcctcacatgtcatctgtcattttcatgttgagtagggaaaacatgaatcttcagccaccggcacaacctgcattcttctttgatggagactcaaactcatgttctcaaccctttgagcaacccgtgtataatcggcctaatgcaatctatgaagaggatatctccgtgaataggatgacagttactgacatataccccagataacccttccccctccccattcctaatcccccctttcccagtggcgcaattgtcaccattgtttgtcaacttcattgaaccatctgcgtatggtttgatctgcaccttagaaggcacatttaaatattctagttgttgtcattacattatattcttatatggccagttatcttatgttctttgcacactctgaactaatgttcctaaacatggcatatcatcaaacaccttgtctgcagtctgcagtaggtagagttctagatttgtagcatataaatgaacaactaaccatcgaaacaggtaatttggacacattaacaatataatgtatagcagtgtaaggccttgtttgggagagggagcaattattagaaatcgttgtttttccaacttttggcttagttaattttctaaagtatgtagtcgctggttctcatagtttgagcacagaatatggactatttaggcagctaagtgtatttgcattcccaaattttccattgcactctaggagtttgatggagtttattgtacattttattctgcattgtgtagaaaggaattttattcaacaagagcgaacggaatacacttaaaattcttaaccagaatctaaatacaatatcatccttattttctcagcacagtaatacggggctattcttcaatcccactttcattattgagcttctggtaagctaccttcggtcttcagtaaaatatgttcattgaagaagtcttgcttggtgggagtacgcagtttccaattcctatgaatgattgaacaaacgctaataagataacaattaacaacacgaaataaaagtatgcataagcgtgtgaactcactcggtgcctggttgacgatggaagcagcaccaccaaagtcacacgagccacttgccctgccggcagtctggtaatagtcattgaatgcataggtcgcatgcgccaccttggtgttaggatcaaagcaccgtccaccaggctggatggcactgcagtctgcgcagctactgcatgcatagtctagtgctgcctgtaaccgcatgtccccgacctctgcgttcgccacgcaccaactcgggttcgggtcacagatgcctaaatcccaacaaacaattcatatatagaacatgtaaaacataataagatggatatcacaatatgaattgaatgcacaattgcaaaagcttattgatcttaaaagatggccattgaatggaaactaacttggtgatggcttgtagacgatgtaagcagcaccggcaaagttgcacgcgctacttgccttgccattacgctggtagtagtcattgaatgcataagatgcatgtgcaaccatggtgtttggctcatagcacacttttccctgttggatagcactgcagtccgcgccgttactacacgcccagtccagtgctccctgtagccgtgcattcccaatagctgcatttgccacacaccagctctcctttgtgggacatgtaccaccaccatgaaagtcaacatcgtacaccttcgtcccatccggatagaacaggccgaagttgctctctatagatggcccacccttcttgttctcgttgaacaaagcgaatatgtacgcagaaacatcctccatattggaggccccgaacaagactcgcttggcaaggccattgttgtatgcttgagcgttagctttagttgccaccgagtccccatcagcattggcttctgtgacccctgagcggattctaccaccagaggggtggcctgattctgaaactctgatgggcacccgtcctcctgcttgggctaacgaggccctctcgttactaccagaaaccttgtttattgcatagtaaactgcatctagctcggcatcaaagagactgtaatatgtgacgccgctcaccggatcgaacacaccagcattgggacggaacgtggcgtactcgagggagattccggtagaaggatccgcatatgcaaagaatgggtagagatttaccataaagtacgagtcagtctgctgcaagaagtcgatcatggggctcatcaccgactgcgcgatgtcatcccggaaagcgcctgcggacggcgggaatgacacctcgactgagctgaacgtgatcggggtggacacccttatggcatcggcgaggcccagcctcgccagcgccgcgtgcacgttcctcatggccggcaccagctgctgggtcaggtgaggcgcctgatcgaacacctcgttccccacggccacgccgttgatcagcgtggccgggtagtagggcaccacgctgctctccacccacctctgtgcgtagctcggatcccagccggcggagcccagatcggtgttgggtagcgccaccatcaccttgatgccggtgttcgccagcgccctcagcaccgccgggtcggcgtcgaagatcctcaccatcgtgatgccgttcgccctgagaaggctcaccacggattgcgggtccatcagattgtccgcgtccctcccgtagcacacgcccaactcgcccgcatctgctgtgtgcaaattaagaacaaacaaacgacgtcgttgtgattgttaattacgaaagtgagattaattacctttcagccttaatttgtagtttgtacatctctgatcgagttaattacctgcatgggagagaaagagcaacggtaatgcggtggctaagagaacgcggaggaggtgatgagtgagcgccatctctagtcctgtttggcgccgtggcagactgaggatagtcgaattccactgtgtgactgtgtgagcagtaaatttataacgagcagtatatatggccgtcgtttaggagctagcgcgatacaaggaaaataatagtacctcccttccaaattagttgtcgctttaactttttacttgtaatactattcatcttatttaaaaaactagtgcaaatataaaaaatataagtcttacttaaaaagtactattgagcaagtcataaacaaaataaataataatttcatactttttttaataaaacgaatgatcaaaatgttacaaacaaaaactcacaacgataagtattttgggacgaaggtagtacaattttgatatacatgtgttgccacattttcacgtaaaataagttgaatttgtcattgttcgatcaatcatctatgttcgtgtatcccggcatatgctttgatatgccgccttcattgatttttctcggttgactatcttgtgccgcactgccgcctacgaccctgcgtctagcctgtctggttgcacgtgcaccacttgagattttcttcttgatgataagaatgccagagtactgggttttttttggtgaatatattaatgtatggttgtgagtttggttgcattttattaataacttcatcagtttcaatatataagtatatctaggatttcagttttgttcaataatataagcatttgtaccactatttacactacattttatcacataaattattttccattcaatatttttccccatcttaatcccaaccatcctcccacacctaagtctctaaccctctcttttttgttgagaggcaccaaaatcttttctcctcaattttaatctctgtgaaataatttagaaatacttatattttagactagaaagagtatagcatctagcgtatcatagtattagcattccaggtcacggatcccaatgcctgaaaatctaaagtcttgtgtgtaatgggcctcttttcatccaaggggatatttctagccgaacaaatattgattatggcccatcgaacagaaaatcccatgtataaggtgagtaatcttagagatatgttggcctgcattgagcggaataagttcacttaaggtcccttaacttgtcaacgaatgccgaatcggcggaggccggtgagaggggatggggtggggagggaggagcgtcaccggccaggcctcttcgcgcactggccaccgctgctgagcccgcgggtgtcacggtccgctagtgagcgcacgcaaagggggacgagcaatggtgggtgcgtgatggaaaggcggcagaggtagaggtagcggcgcttgttggtggcagtatcccggaagccgacctcgccttcctcaacctccacggtcacccgtcgccaccaccaccttcctccgccgtcacccacactgattcccgcctcccctcggcctccccgcaatcctcttagcacctcccgttggtctcccccccgcccctaacgccatcgtcatctgatttccgtcaccgggaaaggacgagcgcccggtgccacggtcctccactactccaccagcctcgtcggtgtgccgctcgctagcctcctccacatatgttgtcgtggatgcttgacttgccaattgggacaaggactggtgcggtgaacgtggttgtggctggcggggaaggaacacggcggtggctctcggccgctcctacgcccacaagctcgccgaggttgaacgcttccccgaatgcctccaccgacgctcagatcctttccgccggccgccactcctccccaatgccgccgaccgtcgctcttccccaacgcttgagactggcgcggatcttcttccaccctctctatctcttccctcaaattctccccactgctaccaccgacagcattccttggaaccacccgtgctccaaccccagcgccgctacagccaatgccacttcccagcgcccctattggggaaggattgcgaccttgcaccattcaacccctattggctccggaggaggtagggcctctaggggcctgccgccaacgccctgcggagcccatctccacagggagggccctgatcgaacgcctaggaagctgaccgagcctgaagagggcagtcggctccgagaagttcggagccaaccaaagggcctcggggatctcggagcccagtcaaggcccccggagccccagagccggttcaagggcctcggaggtccaggagccagctcaagtgttccggggctcttgccatggctccgggcccggagcctagggaggacaccgggaatgagtatggggtgccataaaagcgcactactcatctcccatccaccaccgatgttacggcacgactagcgatgtgaaggccgatgctagctattacccgagtaaaggctagcatcatgctagcgccataccgctccccttgatgggcaccgccaactctcggcctggtgaatggaccctcggaccattcgtcggcccacctctcagccacctcggggtagctacggagataggggtagggttgtaatttcctttacatacaacctagtataaatatgtaaatgttaccctcggaaggggggatagaagctagacagacacttattgcacacttgtgagttctgttccaacagccccctcctcttccgcccatagccagtggagccatgccccctcatgtcacccataggctatagctgccagagccgcgccctcgaagccaccctcccccctccccctacctaaccaggctgagatagagaaggagaaggggatgatatagagaaaaggggatgaggtggaggaagttggggcccactgacacgtgggtcccactatttttagtatgtattatttgactgacatgtgggcccatatattttattttatctttaaaattgttaaatttcacttcatatatgccatgtcatacgaagactaagtcaaattagccatgtaggcgtcacgtcaactaaaatcgccatctaaaccatcatgggacctatattacaccggttttaatagttaagagacccgctgtatttggttttttggttgaaggatgaaaatcgaattcattgacaaattaagtaacctcaaatgtacttattccttcattccgatgctccatgtaatgcacgtgggcttgtacaaaaattgtgcaaacttttcatgattcttacattgtccgtacagtagcacaatcctcctttcagagtgggagccactaatcagcagcgcaagaagttccatatcctggaccgatcgaagctctctctatgacaggttctacactgacgcggtcgactcgtcggacgcgacgccgggtttagcgccgccgttcctggcgaagaacgccggcttggagggcacctggagggagaccgtctcgctgtcgagcatcatcaccaccgacgacatcaccggccgatccgcggggttttcctgcacgcacaggagcgctacgtggacgcacttccgcacgtcgctcgccgagacgtacctgctcatggccgggtctaccatctcatccacggttccggccatccaacgctcccatatctgcatcatttttgtagtgcagcatcacacatagatcagccaaactgcactgtaatctgcagagtgcaggttatcagatgttcagagatatgaactactatgttgtatgttcaccgtgttcaggagatcttcagattggtgagagttgttgtagaagtcgttgttcttccttcccgtcacgatctccagcaccatgacgccgaagctgaacgcgtctgacttgacggagtagttgccacgcatcatgtactcaggtgccatgtacccactgcaacagcaaagataatttgaagtcatgattagtcactacttaattactggatgactgaacaactactacagtttatgttgttactaactatgtgtcgacgacacggttcgtgacagcctgggtctgatcttgaccgaaaattctcgcgaggccaaagtttgagatcttggggttcatgttcgcgtctagcaagatgttgctcgccttcagatcacggtggactaccttgagctgagagtcttcgtggaggtattgcaggcctcgagcgacgccgtttatgatcctgtacctcttttcccagtcaagcttctcgcgtttctcagtgtctgacaatgatcaaagagaaggtgttaattaatagatcaatgcgatgatatgacatcaatctttgcagagaaaacagaggagagaattggtaatgtagactcaattagtagtagtattgttaccaaagaggatcaggtcaaggctccggttaggaacgaactcgtagacaagcagcctctcgtgttgatccaggcagacgcctacaaagcttacgaggttcttgtgcctcagcttggcgaccagagcaagctcattcttcagctcttgaactccctgtgttgagctctttgacagcctcttcactgcgatttcgttgccgtctggaagaacaccctgtgaaaagattcaaaatatgctaattaaattagttttggtttgtaattcagagacttgttttttttttccctttttcagtaccttgtacaccgctccaaatccaccttcaccaagcttgttgctctctgcaaaatccccagttgcagctcgcagagtagaaatgtccatgagcatggagtctacgctgtcaacgtcatctgcttcagcgtaatagttggcatctgcataaacgtcagcatcacaacaattggataagttttttttttttgcattgtcagctgaaatgattaaaatggagaattttgtaggacgtacttgtctgctttgcttttgttattactggacgcttcctcctccagacacagaagcaaacgacaaggtttacggctgctattatagggagcagtattataagaaccaggcgcggaaccttgtactttgtctctgcgaattgaccaattcacaaatttccaaggttatcatgttaaaacatgtcgaattgtatggacagattccgtactactgtactgtactactccccttatttcatgctgcaagtcgtttaattttttcttagtcaaattcctttaaatttaacaaaatatataaaaaaaatatattaatattttcaatatagaacaaacatattactaaaatatattcaatgttaatgttgctaaatttttctacaaacgtgatcaaacctaaataatcattttagataatagaaatgacttacaacctacaagtactcagaaaaaaattaaatgacttaaaatatagctttttcttggaaataatttttgccgggttttcttggaaataataaacgtgtagttgactaattgtgcaataatgtcagtaatgccgcccgaaagtaatacacacttcgactcacctcgtcccggcgtggccgctgaaggcgtcgcgttgaccggcggcgccggagacggcgccgatgtcgccggtagccgcaccatcgtcgtgccattgaggaaaggcttggtctcgatccggaagctgcacctgacggagagggtcctccctccgatgtcgtccttgtacgaccaaagctcctgcgccacgatcttggcgaggcagctccggcacctcgccggcgacaggtccggcgtgcactgcgccaggctgtacaccttggggagcgccgcgtcgaagtcggcctcgccggccgcgtaccgccgcgtcgagttgtacgccgcgtagtcggcggtggcgttgacgagcgccgccacgaggcggttgtaccgcccctgctccgacgtgaccttgttctcgttgttcaccgtgtacgcgtcgatcctcgccgggtcttcgccgccggcgccgccggagaggaagttgatggcggagtagctgaccatgcaccggtcgtagtaggtggcggcctccctggagttgccgcacgcgttgggcaggtcggcgaaggcctgggtgaggcagccgaggcaggagctggcgctgacgtcgccgcggcagagcgcggcggcggtgacctgctccgggacggcgccaacgtccacggcggtggcgtagaggtccggcgacgacgaggcgttaccggggagcgtggcggcgatgagctggaggttggcgaagaacctgctcttgggcgtgaaggtgccgaagtcctgcccgcacaccggccatggctcgccggcagcgcggggcgcgagcagcgcgacggcgacggcgacggacaggatgagacggcgatccatcggggtatttccggcgtgcgcaaagaggagctcaatccatgttcgttcccacggggatggactatagtagtgagtaatctccgtccaacacggcagagagacagagacgaccatacaagtcgtccctgattcttgaaccaactttgtcgcttaacaatggatacgattgcatccagctagtcgagatatagaaaatccatgtctccttgcacacactagtacaaccaagataccggtttagcagtgaatttgaatatagcgtagggagtatctctgctcaaagtttttgaattgagcaaattttatagtttttaagaggtgccatgagatacccaaacttttaagtacaaatttagtatctagtcgtaccagagataccaaattttgggtcttccgaatggacgcgtgagttctagctgcctaactggtgcagccgcgcatgccccctatctcgcctctcctcagcgctaacaacgctgattagtgttgatgtcattaattagcgatactgataattgttagtattagttttttatttaactctgatttggaaaacttttaaccagatttgaaactttcaacccagatttgaaaactttcaattcagataaaaaaatttcgacccagatttgaaaactttcaattcagatttaaaaactttcaacttagatttgaaaactttcaagtcaagattttttaaaaacttttaactcagataatgaaaaaattcaagtcaagatttgaacaccttcaatttatttttttcaaaaaaaacaacttagattttgaaactttcaaatctagatttgaaaaaattcaagtcaagatttgaaaactttcaactcggatttaaaaacttttaactaaagatttgaaaattttcaattcaaatttaaaaccttttgtctaaaaattcaaaacatttaactcaaatttgaaaactttcatatctaaattaaaaaaaattcaactcaattttttacctttaataatttttaactcaaattcaaaattttcaactaaaattgaagatgaaagatttcaacttctaaaattaaaaaatcacgaaaaaggaaaaaataaaaaaaaagcggacgttagattttttatgggaaaaatatacggatgtggacactgtccgcacgcatacgcgccagcgctaggccttataggcctgaaacgcgcgccgccaacgcgcaagcgcgaattagctatcgcgccaaattttatattagaaaacgagatttgctccggtccaacaaaaagtatctcgagatgccggtacctcactgtaccaaattatttccgatcgttggatctaactggacaggatggatattgttagatccaacgatcagaaacgatttggtatcacgaggtatcggtacctcgagatactttctgttagaccggagcaaatcttttagaaaacatagtgtctcccgatactttcataaaaactgtataatcactcttttgaatttgtttgaaattagcaattaattgttgaaatcagggaaaacgtattcaaatttcaaggtgaacacgcttcattcgggccaccaactgaccaacctcctctatcatcgattcatcgtagcggaaagaagtgacagtagtgcgcaggcggctatggaaaaggaggcgatggagtcgcaaaagccaaagaccaaagactagtcgatgacttcaccggccttgggattcacaggcttccagttgcaacttgcatggcagcgataatcacgcccaatgtgcaatgcaattcgcaataatccaagtattgcaacttgtaatcaagtggcaatgttgcatcgcatcagtagcgaattaattatccacaaatttgcaaactttgcaagtttgtaggcgactggccaagtggccaggcatgctaattggactcgtcaaggtattcggctcaccagtggtcatccaagaccgtgacatgaatgggcatatggccatgaaaaagaaaagaaaaatcaagctccaaacttaccactagcaaattagcaatatggagctatatggagtctgtttagcatagctctaactctaactttaacttttctgaaattgaagcccagtcaaacagtttcacctccattcaaaaataagagtggagtcagctgaagcgcttttacaaaacgaactagacgggtgaagccggcttcatcctgtttcacaactccacttcagaatcaatttttagagttacatttagttgttgtagccctatcgaacaagtccatagaggataaaaatggattgcttccatttattcagttttaagaaaggattttaaacatatgctcaaagctcgtgttttacattcgtttgagaattccagggcaacatatatataattattttacagttgactaaaaataattcgaattttcagtacaaaattatagtagaaaaaagtatatgataaataataaaacaagcaaaaaactacacttcacaatttatttgaaatcccatgatgacttttatgatccaaactagctagaaaaaaatgaatgtttatactaaaaattctttcagaactatttgccgggcgaatcacatgttaatgactagatttagctaaaccagatcaatcacagttatagccgtgttgcccacaggatggaggagaggaagctgattctctacccaaaaagaatgcaggttctgctggtggttgaagcttcatattttccttggtcaacatgaaaataatagatgacatgtgtggcctgtcatcggggtctggctggacacaaagtagtccaatgtggatgcatcgtaatgcttggctttcagagtacccattgagcgactggtaaatcatttttgtagcagtcccttttgtccagcaattccaaacctgttaggcatgttgacaaacttaagagattattactttcacgtaaaaatcatcaatatagcagtgttcacaatacactaaaagtagaaccatattggtgtgagctaaggttattaagcacttacatcactaacgagatcatgatcgtcagaatgccagttccttctcctcgtgataatttcgaggaccagcacaccaaagctaaaaatgtcgatcttggttgacacatttccatctattgcgtactctggtgccatataaccactgcagagggtaagcattacacttggaaacgtacatccaattaatatgtgctattaatgaaggtattattatacttatgagcttacaatgttccaacaactctagttgtcttagaatgagtatgaccttcgcctagcagccttgctaatccaaagtccgcaatctttggttccatatcatctccaactagaatgttgtttgattttagatcccggtgaatgatcctcaagcttgaatcctcgtgaagatacaatattcctttggcaattcccagaatgatgttgtactgttgatcccagtttagggcattccctctactgggatctattgggacaaatcttcaacttaatcataattacccacattcaatagaattcagaaagtggcaaagtgcaaattctggtcttagttatgtgatttgtttgctggaaatgctacagaacatatttagtgatactgaggatatttacttattgagtatatatgtttgtcatttgtgaacagatgaatgagaaggcaaaattaccaaatagaaagttgtccaggctcctgttcttgaggtattcgtaaacaagcagagtctgctcctgatgcaagcaaaatccctgtagcctaacaaggttcttgtgctgaagctcagccaacaacttgatctcattgtatagctggtccaatccatgaccagttcctaaaagtttcttcactgctacttcttgtccatctgagagcactccctgaacatattgtttttcacagggagcaagcaatataatccatcttttggaaagtaatgcacaatccatttgaaaattttctctttgtatttttgcgtgctaacttaccttgtatacagcaccaaaaccaccctcgccaagcttattattcggcgagaaattctcggttgcctcttgcagtgcagaaagatcaaaaatcatgcattgtgctctcgttattttcttcaatgctgttgccatatgacaagaattatgtgagggaacagtacatttttcagctactgaacggagattatatatgctactcacggtggacagcgtctgtaaccttggtcctcctcctgaagcgaacaaatgcgaaaactgaaagtatcaacaataccacaaccgacgaagcgacgccagcagcgattcctgctgtactaattttcttccctgcacacaccaaaacatggatttcaatttgcaaaaccttgatttcattgttaagtaggaaaaatgaagaacagcaggtcatacctgacccaggctctggagaaagaacaggagcttcggctgttggtggtggcgccgagacctgcagcatcgcccggcctcggtagaatggctgcacactatacatcagtctgcaccacaccgaattgacacgaacccagctaaggcttttgccgaggtacgcttgttttgcatagaagaggaggtccttaaggcaatcgttgcactgcgcgggcgtcaggtccggcacgcactgcgcgaacccgtagatgttggggtcgaactcctcctcacccgtcacgaaatacttcttggtggtcgagttccccgtcgtcgaggtcacggcgtggtcgaccatggcggcgaggatcttcgtgacggcggcgttgaaccagccaaccgccggcacatcgacgctcgccgaggcttgctcgggataccaactgttcgtcacgagctattagtttatctgatttttgcgagaaaagaatggaaggatggattgtgcgtacatcatctgtgagacctgccactgatccggactgaggaaatccatgaacctatagcgggagaagcgagctacgcaagcgtcctcgtacatggcgacgccgctgtttccaggacaatctttcttcccgtcgacgaacgctgccgcgacgcacgcgctgcaagcggaggcgttcacgtcgccgcggcatagcgccatcgcaaagaccttgtcgggatccgcgccgacggtggcgacagcgaagccggccggagccacggagacattgggggagagcgccgcggcgaggacgttcaggttcgcctcgaaagtgctgttggccacgtacgtgttgccgactccttcgtcgcagtcagcgatcccagccggcgtggccgacggcggcaagaggacgaggacaacggcgacgatgccatagccgacgtgcatcgccgcagcagagaggggagatgctcacacaaaagatgtggacttgcgccaggcaacggatctgctctgctcgcccactcggtgcgacgcatcattaggcacgttgtgctgagtttgagcgcgcaattggagtcaaaaatggctgccgcatgcacaatttcttgatttttttttccagcgttcaacatttgccagtgttctaagtcgaacataatgcgtggaataaagcaacagcttgtatcgccagcggcacgttcttgtcacactctttgactactgagacatgatcctctactcccagtatattaaaagaaagatatctgctccggtccaataaacaatggatctcctcgtatacctttttcttccaaattcgatgcaaatagttgtgaaaaaatctgaaaaaaattgacaatgtagagtataatgatacctactagtccaccaaaattcatgttcaaattcgatctacaaatcgagaaacaaaaaagacaaatttagatataaacagtacgctactattcatacgctgaatttgtcttttttatatctcgacgtgtgagttgagtttggtcttaagattttgtgaagttttatatatgtgttgtatgaatgttgtcaaatttttccagaatttttcataaccgtttagatggtttttgagcaaacgagggaacatcccctcgagggattagaatagtttcccctgacaatgtctatcctgtccaatctaacgatttggtaccgtgagataccgatacttcaagatactttttactggaccgaagcaaatctctaatagaaattaatctagtaacttattttccagatggagggaatactttcatctcatcctcttatgcatgtactgcatggaaaatcaagttgacagaccaagtctgcttggggagtttaagattttaagaaacagctggtaagaagctagctagtgagaatctggagaagcaagaaaacatatctagagaagctaggaaacatagcttctgacttctattttattttctgaattctacaactacggattctcagaatctgggtgaaaatataaactgtttgagggagtttctagcagctggagattctacgagaagctgcagttgccagaagctcccctaaataggcatgttctaaactaggattggcttagctatttcctcgattttcattagcattttttcatctgctgcgaaaactttcttttatagaagttgctttgaaaaaaaatcaaataaattagtttgcttaaattttaataatcaatatttagtttggctaaaggattggcttggctatttcctcgtttccaatgccattcctctagacccgatgatctcccccgacccttttctcctagacataaacctttattgaacgagcaattttacggtctttgagaaggtaccatgaagtaccactttttctattgtaaatttggtacctcttagtacctaggtactatgaggtatcaaaggtactatgagatattaaattttacactaaatttttgatacctgatggtacctcttcaagaaccgtagaattgtttctgttgacgactctgaatccgatttcataataggctgtgtttagttctcctccaactacccctaacttccaactttccattacatcacatcacatccaaaactttctaacacacataaagcttccaacttttcccaaacttttaactttttttagtaactaaacacagcgatagtttctctggaattcaaaaagtaattaatgtgattgatggttttgtcgtcgccgcctttcagacctcaccccgcgcgcgcgtgcgcacttacgggctacgtacggcggccgatggtgccaactgaacggtgcaaatggaaaacacaccatctccaagcaccaagctagccatcgtaatgcgaataccttcatggtttacgcacaaaccggtccaacccgtcaaccaaaccatcccgatcccctttttgcggctgtacagttgtacgtggggaggccatatgtgtggatcctgtgcataatcaccccgttgaatccacccccttcgtttctcgaaagaaatttgaaaatatactttattttttcatatattgcatttatatacctggctgtgactaatttacaagaatagacccaatccacggaacggttgcgcgggagcgaggacgagcagccggtcccgcaggccggggatgcggtaccacgccggtcccgcgggcgtggtgagcgcggcaacgctcccgcatgccagatgtgtgggaccggcgctcccacatgccgcccccatctcggtttcccgaattggatccgatatcctctgcacgaaaaacggagcagactattaacatataattaattaagtattagttattttttttttcaaaaatgaattaatatgatttttttaaacaactttcgtatagaaactttttataaaaaatacaccgtttaggagtttgaaaagcgtgcgcgcggatgagttggaaaaattaggggaagaacacatctctaagaacacgcgacctgttcggttccgcgcgttggaaccgcgcgacagcgtcggtcccgcgccgccattctgcggcaccgccgcgttcactcatcctaccatgggctccatggctcccgtgcatcggctccgcggtaccgactcggtcccgcaggccagttgtgcgggaccggctcggtcgcgcatctcggttccgcgcgaccggctcgggttccgctcccgcatccccagtctgcggttcgtcctcgctcccgcgcatccgttcagcggattgggtatatttttgtaaattaatcgcagccaggtatataaatgcaaaatatgaaaaaataaagtatattttcaaatttctttcttcgtttctctccctcttccttcacggctgcgcgtgacgtgcggcgtatagtacgagtctccgccgttagaggccgtgattcccattccccgcacgcgccgccacgcgacgagtccactcgtggcccgcgcgcgtccctgtcaccccctgtgcgctcgacgagccgcatccataacccgtcggttcaatctgatggaggccggcgtcccgcgcacttgcgttttcccgcaaacgcgatcgctctgttcgtttgctccagtatggctgcgttgctgctcctatgctctgcttctctctcgtgtacagaggagcaaagcggtaaacggtctaatccgtgaagtcagtggtacgtctacggccgtcgactccaataagcaccgaatagtgagtaaacaacaatcttagctgcgagaaacagccaacgacttgaatggtcggacgaccaaaagtttactctcattaacaaaaccgagctcgatacaagtacaagtgtacagaccacccgttcatccgttccaccgtgcagtcacgatggcggctagccgtgtcgccctgtccgtgccagtcgccgccgccgtcgcgctgctgctgctcgcgctcccccgcgccgcggtgtcgtacccgtgggggttgtgcaacgacacggccggcgaattcccggcgaggaggagcagctaccttgccagtatcaacctcatcgccgccaccctccccggcaacgcctcggcctcgccggacctgttcgccaccgccgagggcgtcggcgcgccgccggaccaggtctccgccctcgcgctctgccgcggcgacgccaacgcctccacctgcctcgcctgcctcacccaggccttcctcgacctccccaacgcctgcgcctaccacaaggtcgccgccatcttctacgactcctgcctgctcgcctactccaacgccaccatcgccgccggcgacttctcctccgagaagatcccgatttacgggttctacagcaacgcgaacgccacgacggagcaggcacggttcaaccgcctcgtggcagcgctggtgaacgccaccgccgactacgcggcgcgcaactccacgcggcggcggtacgcgtccggggaggccgacttcaacgcggagttccccaaggtgtacagctgggcgcagtgcactccggacctgacgccggcgagctgccggagttgcctcgcgcagatcatagggacatatattgggttttttgagaacagggtcggaggattcgtccgcgcggtctggtgcagcttccagtacagtaccacgccctttctcgacggaccgatgcttgtaaggttacaaggaacgtcaggtgcctcgccggcgccgtcgccggcggccgtggtgcccgcagttaaccagacgccgccggcggcgacgccgacgcttgaaggaggtgagtcaaagcgccttggccttaaatggtacttactccattttatattacaagttgctttcactttttttctagaaaaacttagtaatgtctacaactctaaattagtttgattaaatctaacatgaatatattttgatgatatgtttgttttgtgttaaaaatattattattttttccgtataaacttaatcaaactttaaaaatttcaatagaaaaaatcaaaataacttataaaattaaacggagagagtagattataattgagttacttttcttgaaaaatttagattaaggccctgtttgtttcagtttaagattattgtaatctaaattattgagtcagatattataagctggattataataagcagacatagaataagttgatagctgtttatttctctggattattagctggttgttaggtggtagccatctaataatctaaaaaaagcacctttaaagtagattactagattatagattgtaataatctatcataataagttatctgtttaataattcaaattataataatcttaagctgaaacaaacattgcctaaatataattttgtgacactacttagcctgacattttacttctaaaaaaaaataatccagggaggaagtacagcgtccctggattggttcttataattctgctgcctacaatagcagcaataaacgttgtggttggcctctgtttctggaggaggaggaggcgaccagtaacagaagcaaagcgaacatgtatgttctgcaaaattctccagtttactatacacttcaagcgaccttagatgaacaatagcttatccatttttttttttgtctttggtagatgccaattactccactgaagcagaggacattgagaatttagattcgatgctcatcgacatctccattttgcgatctgcaactgggg

SEQ ID NO: 57476 - DNA, 9503 bp, Oryza sativa
tttgtagttgtttttgacatatttgatagtagtagtatataccttttgaacatgattcaaaaccatttacacacatgccggacttggtgtgcttaattcagtgtctctgaaatctgaatgatgctactctcatggacactttgcagttttgagtgtctgaataacgtcttcatgcatttgcactatagcttattattctgaaaacagaaggaaaaaaaaccatgtattgatacgtgcagaacatgatggcccaatctaattaattcaaattagctatgcatgttgaggagctgtaacaattaaggaacagtactgagtagggctatcagtacgtacaatttggccatagatttttcccccatctgaagggcatcaggacagtggaggagacattgcaaggacatttccaagaagacaatgatcaattatattaattttagacagctcacttgacaaatatacatgtatgtccccttacttaattaaccccggtcttaagagctaattaatccatcgacattagtttaactcacactaacctccgtcgatggcgccggtaagtccactctaattaagagtctatcaaatacattctttgaaagcaaaacaaaacaaatgaactccttgcatcaacgggctagctatcacgtgattctatatttttaaaccatttttaactctcacctgattaattagcttgtgagtaacttgattgtactactagctagtcccaacaagtgggtttaacggtaaaattaaactaggtagctaattggccgagatagatgtagtagcaagaacatgtattgctattgattggaattgatgattattgtcatagctaggtgtaacttggtttagttaagctagcacagtagtcgtatcttgcatgctttacaaggcacttcaaaggattggaccaagccagctagcagcattggcaaatggcaaatcataatatcaacgagaagctagcatgaaccgtcagagtgaatgagcactgcattcaatgtagcgtcgtcattttgtcagcaagtaatggtgttcctgcatgtgcaactactttgcaaatcgatccacattgcttcagataaagtgtgtatatagttaagcaccttcattaatctgtaaggtatggatcatgagagcacagctaaggtgtcgatttcaaagaaaagaaaagcatctcggcttatgatacatatcattgaaagattaaggtactccagcatcttcaagaaccaataaattacatctcataacgttccacctatgtaattcagtgacggtgaaaaaaaaaagaggcaaaactggcagttttattcaggcatgtagcaagctagctatattcaggaaaaaatcaggcagctgaagaatgaactgaatgtttgctgaatttacagacgtttcggatattgaaattcagtttactcattcagaaaaagtatatggcactgtacacgcttgaggttgtaagatgtagcagcaccaataaataactttgcttgttctaacaatctgtctcgagagtgcacctgaatttaggaatctgtcgctggtaattgcatcataatcgtgattcatgagcctcggttctgaatctgaaaatggttttaattatatatctgttcctgtaatccagtcttgtcaagtccacttttaatacctagtttaaatacttttaagacggcatgattataacataaagcagaattcaggcttaattaacctaactaacgaacaaaacgacgttcttttcatttcaaacaaccccatctaataaaactgtttcagtgagacagaaaatgatgtgagcgatcgatgcataagtcctaacgcccataaggacatgatgaaccaagccgtgctgatcgattgatgcatatatgctctgttcaggagagcacgagattttaagaagttgcatgagtagccagctgtggtaaaaattttaaaaaaaagaagctaactttttaaacctctaacttctaattttttttaattataaaagtattaccaaactgtttaaaaagctcgagattttttagaagaaattttagatgtcagaagctcaaagaaaaaattgtgaattttctttgctcgtcaactgaataatttcgctgcgtgaccggtgacggtttgcgacagtggcctgtgttttcgcatggcacaccattcaatttttcagagaccgaaaggagcaattcaacgacaaaaccacgtggaaataaagaaaccaatggatcgatcgatcgatcggccacactctctctccgttgcagactatgccaaatacagtgatggaataccagttctattatctttttaaaaaactgagaaataagcactgcttttcaccttttaaagaggctaccacacttttctaccgttaatttaggataaaattaagctttgtcataggcgtagaggcgattggtcttgtatattcccagcagtgtgtgcaggtgctattggcgcatgattgtaagctcggaggtgagcttgctgagttttttttacaggtttttttagtttctttctaattgtagtttttagggttttagtcttgtgttttcttctgctatatattgtaacatcgcacaaaattatgagtaataaatctcgacattcttctaaaatcgaggtacgaggcactgcgaacaattttttttttaaaaaaatcccctacataatactttcaccggttaaaaatatttgatgcatgggatataattcaatcaaaatatttaaaaaattgttcatcaactgtacattaaaataaattgtgaaatctaataggtttaaaacactattccttatcaagacaaatatgctcatgccgcattgtttttaggttttaaacaaaccatttgagaaattaccgatggtcatttttttaaaattttaattaaatcttgtcctaaatgaatgttaaataattttgactggaggaagtatggtagttgatggaactgtagtactacctccatattttaatgtatgatgccgttgactttttgtccaacgtttgaccatttgtcatatttaaaaaatttatgtaattatcatttattttattgtgacttgattcgtcatcaaatgttctttaagtatgacataaatatttttatatttgcacaaaaattttaaataaaacgaatggtcaaacgttggttgaaaagtcaacaacgtcatacattaaaatatggagggagtatatactagtaccctttataactcaatggagagaaaaatttgaaatgaaaaaagaataaataagatgttatgggtaatctaaaaaaaatattgtgaatgtgagttcctccgttcttaaaatagtgtagttttaacctaaaaaagtatcataaaagagtgaggttttagagtggcccactagagctctttaataccatttcatatttttcttctttttagtcattaaactaatagtagtaccttttattctctttttttttctccgaaggacgtagtaattttttaacctcatgcttaatactatgtttttactaactaaaactatactattttagaaagatggagggagtagttttgcttagaaatgtctgaagaggttgactacggccaatactgtataaggctacggccaaccatgtgtgaatcatacgttaacagtgcgatcagctgtcgctgtacatacgtaagtgtaggtagtttctggtgctagattgtcgtgtaatgagaagggacatatatgctaatgactgtcctgagagtgtgattagtcggtccagccagtgttaatgacgttaattaataatttaatttgaaatggacggcagcgtcctgaaaatgaggcttgttacatgcgtcactgtttgtgccccctatctgatgtgtcactttatttttaagaacttgatcgacaaaatttctctgaattaatcgactcaaaagtaacagatgaactgaagagttcgtaattcagacattcagtagctgctgtactgactagttcagcttcccttccctggtcagcataaaaatatgagacgtatatagtatctatttttctctctttttattaaaaaaaaattaaagagacacatacctatcacatattttatttaagaatttccaaaaacaccaagaattttttttttgaacggaaagaaaaaaacaccaagaatatttagtttcagaaaattgctggcatccattaattggtgtgtttctgcaatgcgtcggcgcaagttatgagggagaatgttggagaacagtggaatttatatgcagctgtctgagcaacggcatcaactgtgtgtcagtatcggttagcagttcaattccccccccccccccccccttttttcacattaattcgttacaagaattgtaccttgtgccagcttaggagtgctgttgattagtttcagtaaacagttctgatcttgacctcctttattttgggagaataatagttctggactgttggtgatgcatcatctttcatggctgttgatgcacaagttgcaaattgctaatttctagttttgatattttgaaatataagtgaattttcagttttctcttatcattttacgaacgcgcaaaaggattgcacgtcaatgtattagaagggaaaagatgttttgttgcacaacgcaatcagccagacatgcctatgccggaggaagggagaaaagacccaaatagaaaaggaaaaggaaactactgaaaaaaagcttttacgcggtatgatatgggagctaaagttctcaagtttaaatcatgcttgacgcataattaaataaaaataattatatcctatttctattccacgtttgagacttagggaccctctcatgagggggagtggaatataccaagtgattgcccgcttttcgtcattagtttaagttctttattgaactagtcaagtgcatttaacacaatatgatcattgatcattctacgagtcaggatttagcaggtgacatccatcttgatgcagtcaattacaattactgattgcttggtaaatgatttgatagtggacactaactaagaagaatggaaatgatactgagatccagtgatttcatttcacgtaagatccagtgatgcgatcgggatacgttgaaacttgaaagatcttgcctgtaccagtagccaccaagtggaggaaataaaatgagtgatccaaaagggaatcaaagatgaaaatatgagtgatcaagaaacagaatctttaaccggtgccatctatcacgtgtagcattagtagtaggtaaaaggatatattattagaggcaggagagagatatctgaaaaatagtcctccttttacactattcaactctggaatgttaagaaccgaacagttgtcacaaaaattgatgataattattcccaaaaaaaatgatgataattgcgagccctctaaaaatacactggttagtttacatgcttttataaaaataccttttttattggataaatctgaagaaatacttttatttcacagtgtcaataccatacacatgatattcccgaaaacaaaaatattcccgaaaatatcatacacatgaaacagccacattgctaaatcagaccagaaaggatgtacaggaaagggagcactcaggaacagtgcccacagtgggaagaacaaaaaccaaaaaaaggtaaaaattgacctaagctagccacacatattggaatgtaatttggaaacatgccttatccttgtcagtttttcttcactggtaggattgctatgtatcattacactttgtccttgtcatcctcttgcacactcatcatgccctccaattcagagctcacaacgacagtgacccgggttcttgtgtcgggttccagttgtcggtgagcaaacatccccctagcaaacgctcatacggatttttcgtccgcgaacagggtcactgacatgtgggcccttcaccgttctgatacactcggtgaagcatggctgtttagtctgaccaagaatgtgatggaagttttgtagtcttcatgaggtggggatgcaggatctggcaatttgtcatgtacagttgtgataatgagaagtttcatggtgttgatgatggtatatggctggcatgatgatgacctggtgacagttcttctttggtaacactgccaagaacaggtctccatgtctagatcttcagatccactgaaatctgcagttaatggcctagttagcaacaaactgatatcaatggaatggacagtaaactagcagttgatcagtgttaatatgctatactagtcgctgccgacaagagacagacaggattaaataaaaactctcagcatgtgagatttcaagcttacacacattctgaagttattgcagcagtgcaaccgtgtggcttgtcaacttctgcagcagggaggatgactcctattataagttcacatctagctcgaggaaaaatataatcagaagaacagatctggtttcatccaagtggtaagctttttagtagtaccagcaaaagtacactgcaatgagtttacaatgtgcagaagatgaactcctatgcaagaactggaaaccggtacaggacattctactgcgaatcttcagagggtcagaaatacacatggccaaggtggtaaatgggctggtaaatttctgcagctaaaaaacagagaagaaataaaatacttcctccagtgaaaaattacagctctccatcactaacattttctcattttatagtttattttcgtttgtccatagcaaatttagtttacattcttctgtcagccaaagtcttcagtgaatcacggcttcatgtcgctgtacatccttgttcaacatttataagcagagggtttggttgaagagctacagaattgcccatgccaccataatttgtgaatgcatccaaagctttccatatcggaaccatcattttgactggtggatacaccttctgcaaattaagggactccgtcagtcaacggattcctcgtagtgcacttgaaaccaactgaaagcaggaaaaatttaccttaaaaacacgcacgagtttgtcttcgctgtgtagaagcaacactaagctccagtaacatgtaataggggtcacatgctcattcaacactggctttaggagcttgccaacgggcacaaattgacgatgaactcttccactataaaaggtagctttgatgaagagaagataaaagaaaataaatctacgtgctgcagcatatataaaatctaagaaacatgggaagtgtctctgcaatgcctgtattcctgaaaaactttgcatgttcagtacattttctctcaaaaaagagagaagtatttgtagttatttaaattttgaagacttcacttccactaccatgatacccctatctatttgcaattgccaaagtccccttggggtgtcactaaaatttgaataagtaagagtggaacttattgcacccctgtaaaaatccaaattggatcttcatacctccaaaagtgttgttctagctgaacaccaaaggttggcatgatcaacaatgactctgcacaggattaaaatggtatcaatgaggagcacacaattgcacttccatataagcattcctaatcaggatcctgagtaacaagggtatacatctttatccttccttcaggtaaaaaaataactaaacaatcagtgcaaaatgcacaaaatagataatacagacactgcccacctacctttcttcacaggcttatattttaagcattttgcaacggcaaaagcaaatgaaatactccaaaaagaattgatgcatagactctcctgaaacatttgagcacagaaagtcagaaactcattaaagtcacaagcgtatggtgacacctttcttctctttctgaatcttaagtacccaaacaaaatcaacatcatgtgagtatcactgacaaggcatgtatgataagcttgtttttgaagaacctcacatatctattcacatcatgaaaaatgttggcattcagcaatcagcaaataaattttttgggagaatgcagtaggtcactgaaatagtgaagactcagctaccacttgggattatcatccgagagaacaacgacctttaacagcaaggcatgcagtacattcgcaaagaggaaaatttcgccgacataagagaacagcaccctgaatttgctcctcttgatgtagatttcatggatatcgaatcctccctcgcagtgatgtttatacgtgtacacgccactcgacatctctactgctcgattcttcatggtttcaggctttcagaacatcaaaacactcgaagtcccaaccaatggcgttcatttcagaagctttcaatccttgaacgaacctaacaagaacaacacatccgcccaaatgtctagtgaatcccatgatctcctaactgctgatatagagaaaaaaaacgcatcactgcaaattaattgcgcaaatttaatacggggagacacgaaaaaaagaagtctgtatttctacatagcattatcaagtatggtgatgaaacaacatccatgcccacatcaatgcaccccaaccacccaaaatgtacagcaaaggatcgacgtgagcgcgcgtacctgcgaatgaaacgcgagacgggtttggaggagtaaacgcagacccgccgccggcgacggcggcggcggaggaggaggaggacggctgaacgggtaacctaaccacctgcagctgcaggctgggatttctccgtgaattctaacgcgatgcatcgtagccgtccgtttgtagaagtaataaattgagtaaattacagtttggccaatttttattacaatgccaaagtttcactgtgaagtttgaaccaccattccaactaatgtttttattttataaactagataatttaccattgttgtactttaggccaccttacttttttttcgaacgcgtaaaagaattacacgtcaatatattagaagaaaaggagatttgttacacaacgcaatcgagcaggcaggcctatgctagagaggagggaaaaagaaaagggaaaaagaactagtagtgcaaaaagactactccaacatacaagagggagggggcggagcacactacactcctagcaaatccccaaagcagcaatgcccgcagaagaccacagacggccttccgagtgaatgggctcaataagcacagagaccgaggatagtgccgagtcaaaaaccctggagttccactccttccacagttgccaagagactaggaggaccaaggagtcgaagcctaagcgaagatgctcgggtaagcaagccctagaagatggccaccaatcctgaagcgaattgccatggagaggggagagggcagtccatccatgtggcgacaatgcacggtgtcatgtctaccgagtgaacacacgatcgagataagtcacttgactcttttttcaaatacatcaatgatctagattatgtcggtttcttgcatattgataaagttttgaagctttatgtagac

SEQ ID NO: 57477 - DNA, 18151 bp, Oryza sativa
ggcttggatatctttggaatttcattgataggatgaaaatctcttgccgcatgaagcctgacggagtttccgttagccaaagtggcatcaggtacagcatattccaaggaatctgtgtgcttcctatcaggttttgctggaatggaaaattgtgctggctcagttttgctgttccccctacttttcaataaatcaggttcaccttcttttcgcagaccagttgaattttgtatattctctttacaagcagatgctgaagagtggcctaataaattatttggtgaaacctctaaatccgattcacccagaagatttttcgcacgctgaagtgcatcactagaaatagccattgttctgccgccagcagtgctgaacctgatagcttgctcactagaatcagagaacgttgttttagaaaatgcaaaatgctgatgtggatccataagtacttggttttcagctgggccagagcttatagggcagccaccagaaattccactgactgatgctacaccaaactggtgctctgaattttccctctcaacagttatctttgtacctagcttatcacccacatgtcctaaaagttgtgttgaaagggtattctcctccaaacccaacaaagttgcagctcgagaaacaccaactgaagatatatgtacagtccttgcatagcttgtcttgagaggtgaagtaaagatcggaatatatttgtccacattgctaagttgtttgtgattttctgaaaaataatacctcaaatcagaaatttctaaagaaaaaaaatacttatatgttgaaaagtgcataacaaacatcattttcaaatttgctaatactatttgataaactagccatattactacatcataacactacaacaccttattagaattcgcatgctgatcatactcatacatcatgcatttggaaatctgtactcatgtgaatattcatttactaacaatgacataaaagaagttgatacagcttcctcaaaacaactagatacataattctgattgaagagtgcacaacatcggttgctcattgctagttttctcctccagtgaagtgggcttaattttcaaccaaaaggcatagaaatagtactacaaatttcataacaataaccgcccatccatgatttaattattccacaaagaaaccacaggagcacagactagccacctcaacaatcgaacacacattcatgctaaaaatttatgaaataacagcaatctgtgatgatctagcagacactaatcaactcataactaaagctactctacttatccaaacaactgagaaaccccagatttcacaggatcaaagaagatgaattttctatcaagatgataatgcatctttaaatagaaatctgtacagatacaccctacttttactcattttcatggatatgaagtacagagatggcggagaaatgcaaagattggtggaaagatgtgaggtgaaacaagtggtggatctatttctcaaaaaaaaaaaacctcagaatatttccattggcattatacacacctttcttcatattgccttcttcctccagaaccgcccttgccttctgcacggagctgtgactaatcaagactgacttcccagatccagttcgaaacattggtggttcgtttccacggtctatgtattcttagaaaaaaggtgcatgttaatggaacagaaaacaaatatacctggtttgcttttattttttctgaacaaaaatttgaattaactgtgcaaagacacgctaaagcgcaacccagcaattaaaaatttaccttctttcatagagctcccttgctccatgagggtgatcgccttatgacttgagtttctattttggggtgcaaacttctgcattccagcatggagcattggagcaatggcttctccagtgtcattatttactgatatgcacatatgaaatcaatattaaactgagagttagctgtgaaaagctattcataccaactttttttgtgaaggagctatgaattgagaacatttatttaccattttttactggttcctcgccctctaagacaacgtgggctttctttctagaattttcacttgctgtgatagaccttcctgatccagttttgaacattggagtggcacagccatcatctgagtgagcttcatctaacagatgaagaactttttgttaacatgctacatgcctcctttatccttggtagactaataaaaacacatttcaatggcaaaaccacagtaagcaacatgttgagtgaaacctaccttccagttcttttgtaatgttccttggctccagaagtgcacttgctctcttaattgagcctttacttactgaaatggacctccctaacccagtttgaaataatggcaagtgaccatcagcctccaaaaaatttcctgttggatgacagtgattagtatggcaaatatctaaaacgcatcaacagtaaatatttttattgttccaaatttgactagatagtaacacaggtttaaatgaaatgaaaaaaaagccttttacaggaaacttcagaaaaccatgtaccttgcattgaaacacccccctcaggtgtaacagatctatcattcatagtcaggccaccactcatcagaacagacgttggtgtttcagtttgaaaagtagtggtggagacattagtatctccatgtcctgaacccaatagaaaaataagcaaagctgatgaccttgtgcattatgcagtaaaaaaatacaagcctgcacacaaagtttcttaccacttcttttggcacattcttgatctaatactgtccttgccttttgaattgaggtctggctcaccacaacaggcctccctaaccccgtttggaacactaggaattcacggtcagaattcaatttccttcacacagagaagaaatcactaataacaacagctacatttacataactccaatcttaccaatattttcagcacctccatccttcaccacagagctagatctttcactgatcaagactggtcttcgcgaaccagtttggaaaatcagagattggtcaggcctaccaaaatcttccgtgttttctactatgggaggaaagttcattacaaccagaaggcgcacatttctcaataattaggtagaagtatttaactcaaaattaacaagcaggacaatctaatcttatcctcacctgtattattttgctccaggacagccttagctttctggatagatgctacactgaccgatacagctttacctgaaccagtttggaacaatggaaaattttccttgtcatacacatctgccacatctcctgaaagatcagccgttcaaaaagtaaaggcatgattagaattttgtgtaaaattttgctagatgaaattatagaatattctgtcaacagaataaccttgttttggatttgtttgtccctccaaaacagtcattgcattatcagtggagctcctgctgactgggtctggcctaaccaatccagtatggaacatagactgtacagcaatgacagaagaattctcggcatttcctgaataatagattacgaagattcattatcatgatagattgtcgagtgctacacagctcaaactatcctaaattaattagagccaaatatatgtcaccatgcccaaagaaatgaaacattctgcgtaattacacagaaagtaagcagatgacaaacttcctaccttctaaaacagctctagccttctgaattgagcccttgctcagtgaaaccattttacccgatccggtttggaacatcggagacaaactatctttatgtacaccacctgaatttcataagatgcaaaggcgaattataccattgaacctcgagaatgtgtaactaatcagaactttgtacttctacctacagttgaatcatccaacctgatctccaagaagagagattgaaacaaaacttacctttaaatgaaacattactttctcccaatccgcactccaaattagaaccatcaccaaatggttgccctgcaatacatacaagtatcagcctggtatgcaagtcttggagaaagagaacagaaagacattgaattccatgctatcaacaaagcaagaaatgcaaaacttcagaaaagataggcagcaacttttaagaaaaagaaaagtgtgtgggtatcttcatctagtagtagcccgaggaaatcatcacagcaactaaagaggaaagggcatgaccagaagattggaaataattcaaatttattgctccatttttctcttgtttgtttgtaattcagtggactgcaatgacttgttgtcttcgtttcttctaatatatctaagatgtgcggatattatgtgtccccaaaagacaaaaggagggccacaagaccaataaaattgttgtgagaatgtaacactttgaaaaaagcaaaccgcaaaacctcttacttctctcattacttatctcctccgcgacctccccaaccaatgccttggccctctctacagccctctcgctgacggcaactgatccccccaacccagtgcagaacaccgcacctttccctgaatcctcgatcgcttcggccattccatcagcagcaaccagcttatccaaagctgcgatttccacatccacagcaaacaaacatgacacttagtacaatgcagtggcataacaagttcgtaaatgggaggcaagcacgcgcgtgcccgcacacggacgagtggagatgagatgggtggacgaggcggcagtgcggcaccttggttgaagaggtcagccatcgacgggacgctgcatccatcggcggcgccggggcctagggtttcgaggcgaaaggggatcagtaataatgcgggggctcattccacgaacgaatagtacctcgaagagagagagagagagggagagaccgaaccttcgggaatcgcatcgccggatcgcgcctctcccagctccgtcgcagccggctgcggatcgggacgaggaagcggcgcctcactggccgccgccgccgccggtggcggcggcccgtcggaggcgggtacccagacgaggctcccgtcgggcttcccccacacctgccacctcctctgcatcccggcggcacagccagaaatcgctcgcggcggcggcggcggtgagaggatgaggaagagacgagcaaaaaaaagaaaaaaaatggagaggaaaaaattcaaaacgggaggaggcgaggagggaaaggaaagcgcggagcggaaatggcgaagcggctgtcggtgggtgggctgggcccgggtagattcgagacgggccggcccattagcgggggtgggtgacagcccatcaacatccatttggctggacgccgccgccgccgaggaggattgctagggcggcacggcacggcacgacgcgtcgcgtctgttgcgtcagcgtgaacagatcagccaacccgccgactcgtctcctatcaccacctgtaccgaactgccgccacgtagatcagcggccatggtatacacatcaacgctcaacgcaacaaccaggtcaaacgctatatcaacagtccaatttgcaccctccgtattattaggcataactaaaatttaaaattttaaaacctatttttgtgtttatttgattatttatttatcgtagtttattttttatcatttgatttttaagtcatcagtacacacaatatataaatgttgtacacataagttcttttcttgataatgtgttcgctaccagggatgggaactttgcatagtgcgtacggaaaacggggcggcctattagcacgtaattaattaagtatttgctattttttttaaaaaaatagattaatttgattttttaagcaactttcgtatataaactttttgcaaaaaaacacaccatttagcagtttgaaaaacgtgcatataaaaacgagagagatgagatgagaaaaatggcatccgaacacaccctatagtcttataatcaactgtagacgaacgaaacgtaatgattttccctgttacacggaaaatatacaacaccacagatacctattatacgcgcacacagtcacaaaagtatacccttttacacacactcatttttcttttttaaaaaaagaacatactcccttcgttctaaatataagagcttatctagattcataatactgtaaaatgttcaattttagatttaactgcgatgcattcgaagttggaatttttcaaggatgaatcgacagaccatctgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtcgggttgcgcttgccccggccccgagggccgaggcaccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaacggttaggtggcgactggcggtctgacgcacgcctcgccccgtcccgtcaagacgagtgcctctaggcacacgtctccaaccgaagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagtaacgggcagccacgatctcacgttgcgcccgtctccgccgggagtggaggtaggtgtgggctgtcccatcgaagtgtgattcggacggcaaccataccagtctctgttcataaagagaagaaaagtccagtttggaaaggaaagggtgcatgtggtatccccttgaagtataaaaggaggaccttgcccacagagtagagggttgattcttttccagattaagagcttagaacaggggagaagggggcggacactttgtagctcattcatacacaaattcacaaaaacacaggagtagggtattacgcttcgcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcatctggcgcgccaggtagggggctcagcgtgtgctttctgagctctcgcactcttccgtgtgcgccaagtttcccttgttctgcctaatggccgagcaagcaaaggcgcacgacctctctccgagtgtgagcggcgacgacggggagccaaatccacgccgtcgagctcgtactcccccacctcctccgcgccgaagccctaagcagggggaggcgcttgagagggtcgacaaatccgcggcgtcaccagtcgcgggtgatgcaggagaacgccgagatggggagcgtcgcctcctcgtctacggcgacggcagcacgcctcagggtgcgcttcaggctgctggcgcgctcctacgacacccgcctgtcgtccacgacccggagtctccagcccaacgatggctggaggacgtggccaacttggtcatgacggcacagcagcgcctgggtgctggtggacggtccgctaccaccaaaacctccggcgccgctaccaccggctccgtgtcgtcaaggcggagggcgcggcgagcggcggcggctgcacgtcattcggctgccactccctcatcgacaccgtcgactcgggaggatcagcatggggagccggatgcccgcctcaacatcgagcgccggcgtaatagccgacgtactccccgtgcaacggagggcgcctcctcgtccagagtgtcacctcgacatggacgtgaggatcagccctccgtgcccccggctggtggtgtcggctgtagatcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaggatctgtgccagcagttcactatgaactttcaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactccttcggttccggagtggcagcttcggccgcccccggatccgccgctcagactgggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgaacgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccatcgccaccgtcgatggaggagcgtgtgctcacgtctctcgccggagcttcaaggctatgaagcgagagcttctggccatggcccctactcatgaggcgacgcgtcgggcgcggtggtcggaggtggtcctcacctttgatcagaccgaccacccaccgtgtgttgcccggggagggcagattgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactatgcctacctccagatgaagatgccgggccccggtggccccatctctgtccgtggcgaccttaaagtcgcgctcgcttgtatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagatttgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtttgtcgatgacttggttgtaaaaacgcgcaaccaagaaactttactttcagatctagcggaaacctttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaggcgttcggggccgttcacttggacggaggaagctgaaaatgccctcgcccagttgaaggcgtatctcagctctcctccggttctagtcgccccggagccaaatgaatccctgctactttacttagcagcgaccccccaagtagttagtgcagcgttggttgtggaacgcgatgaggacaatcctcattctgcgcacccccattctgtgctaacttggcccgggagcaagcagggaggagaggcccccgagtcaaacggtggcctaaggcccctgacgaccggagacggccctctgcccgcttgtcagacggtgctgggtgcccccgaccctcaggaaggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgctcctgtcgtcctccgaccccgaggtcatcggcacagaagacgagtgccccccgagaggccacttggacgaagaacgccccgggggtacggcccctagcagagaggatcggccccaccgaagggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcatgccgcccactgggtgatgcaattcgacggttctctatctcttcagggcgccggtgcaggggtcacgttgacctctctgaacggggacgtcctcagatatttggtccgtctcgactttcgagcgactaacaatatggcagagtacgagggactccttgccggactcagggtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatgatagccgacgaactctcacggctcgcgtcctcgcgagcccagaccccaccgggcgcctttgaagaaaggctgacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcggtgcagagcgtgtcagttccacgccaagcaaatccatcagccggcccaggccctgcagatcataccactgtcatggccatttgctgtctgggggcttgatatcctgggaccgttcagacgggccccgggcgggtttgaatatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctggacgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgcgctggattgagcaagctctcaccaatgtgggagggtccgtatcgagtgatcggtgtcccccggccgggctcggtacggctggccacgggcgacggcacggagctgccaaacccgtggaacattgaacaccttcgtcgcttctacccctgaaaggggggggtcgggtgtcaggttttggctcgggccaaccccgcacccccctcgggtgtgcggggttagccgggggctaccacacatgcacatatattcctttcagcatttcaataaaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatgcatagcaaaataaagttaacatagaaaatttttcatcatttttgattgcagattaagttgatctatacacaaaagaggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgatcggccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgaggcgggcggctaagccgctttcgcccgcggccgccccgccgataggcgccctcgcgtctagctccttctcccgtgcctcgaggccagcagcccgctgctccagcgcggctctctcggcgcggacgcattcaagattgcggcgcgcctgctcctcctgcgccgcctcgcgaagggataggctgtccgccagccgtttggtcgtagcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccgtcaagcccctctccacggcgccggcatgttcttccagcgccatggcacgggcctcaagggcctcctcgcgccgccgggacgccgcttcggcttccgttgcccgccgctctcgggcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatatggcggcggtgagccttacggcccacctccaccatggcgtccaccgagcgccgcccctcctcgacgcgcgcccatgcggcctcgagctccgctcgttccgctcgcaaggcctccacctgggcgctaaatccatctagcaccgcggtgtttgcggcggccaaggcctgcataatgggctcggcgctcaccggggcgacggaagaggaggagaaaagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccaagtgacgctgtcgcctcagcctggcgagcccgggcggcctcctcccgggcagcttcttcggcttggcgggcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggattggccggacttggggtggcgggaggaatgcgacgggacatctctgaagcagaaggaaaagccagaagacgaacaaagtgagcaagaaaaaacttctttttggagaaagatggttgcaatgagagtgagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccgaccgctggtacgcaccgccccgccccctcggggaggagatgggggaggtgttcctcccagcttcctcttcccttgggcgtcggcagggcggctgctccccgggcccccgacgcgaggcccagaagcacgaccccctcctggggcagattgtttcccccggcggctctcgcccgcgccgtcgtggcccttaggggctctctcctctgaggccccgacccccaacataatggatagaatggagacgcggtcgggatcaatgcagagggggaggatctcctgaggaaggcaagacgcctccgcggagctaaggttcagcaccctttggactacgatcttgaagtcctcaggagcccaatcccatctggctccctggtgggtccgcgtgtagtcttcaggcccagtgtactcccaggcgctccgggcgcgccgttggagcggcgcaatccggcgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaaggcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagagccaccggaacagctgaagagaggggcgcaccccaatgaacatctcgcacaggtgcgcgaagatggccagtgtcatcaccgcattgggggtgaggtgcgccatctggagatcgtagaactccagaacatccatgaaaaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagcacactgccgtcgagcagagcagagccccgtgccatggtggtggaggaagagatgattgggaacgagcgtgtgtggcgaaagtagggcgtagcagagaaagagttagagcttaggcagcgaaggcaagaggaacaatggcgaaaggaagggagcaaatccttttctcgatgcttttatacccttgccatcgctgggcctggctcctcgtttctcgcgcccactacttcgctccctcgtatctcgctatctcgctccctcgtatcccgcgcccacgcttccactaatcccattcgcccgtttacggcgcgtgaagtggatatgcggttgtggcaatcgaaacggattgtatcgtgcgcgcgttaattacgctcgccgaccgaagcggcgttaccgtatatccgagcgagacaaatctgctcacccagattcgcgcgctgctcaagtgatgtggcagtcttaaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggagattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtc

SEQ ID NO: 57478 - DNA, 32579 bp, Oryza sativa
cggttcaaagtagtgcaattcagtctagtaaatttgaagggcaccttggatgatggtgaatttgaggcatttgattatgtggtgttcttttatataaaaaaaaagttgggatggctagaaagagctagccatccgatggtattaagatacgagaagccacatatttttccaatccttctttaatccaggtggaatatgagcaggtcgagaggtcaaacctaggtctgctgggcgaaagcaatcaacccataccaaccgagctaggcacggttctcatggtgttcttttatctcgatgaaagatgggacatgtgaaaattttccgtaaaccgacatcacaacggcatctgattggttgagctacaaccgataagtcatagaaaaataaacgaagcaataaaaataatttatgagtaaaacttttatatttgtattattcatgatataagagccaatattggaaaataaactacgatgaaaagccctaaaatctctggttcttcaacagtttcatgtgcaactacattgcttggctcatgtttgacacttcctcacttaatcatatgcctttggtttaatcaacacgatatccattacaggtttataacgaccagtcaagtcccatgttacaggaattacaacagtcgaatgcaacaaatcctcatcccaagtcggagcttacaacttacaagtcacactcaatcaacactgctaatttgccttacaacagctagtaaaattttcaggtatacacggcacaagctacagattctacagaaccattgctctggcctctgggctagaagattgcagagtaagggcctgtttggtacagctccaacttctaaatataactccagaagttgagtttggagtggagttgtggagctgcctaaacccagctccacaactctagtacattttgtgagagagctccacccaactccactcccagttttggtggagctgaaactgtttggctgagctccagctccaggaggggtggagctggagctggagctgtgccaaacagggcctaaatcaactgaaatccacggctgattttaccctgtcttgaattcctgatgcgcttctccttcctccattcccatggtttgtcagggttcggcaaagaccataaaccaatttgactcgcttttgcctgattctcccactgaaaatttatgtctgtcagtaactcgtgtttatgcttgaaaaaaatgttcagagcatggtcttcagtcaagtaaacttgagctgtcaggtgttccatacttagtactggacaatgcattgcttaccctggcaagctccggtcgttgatcataggcaatgtagtgccatgcaagccctttcttcagcatgtgttccttttgaaaaataaagaataagcttaatatatttcgtattcaaaatgtcactaataactctctaaaatcagtgctagaaagcatgtgtcttcttcagcacaggaaattcagaaattttcttgcaggatttagatcaaagcttgtgtctgtagctctgacttatgctcttatcaaaaactctaagcatttcatgatcctgaatacatacatttcgttgtacatggaagaacctcaatgaaacagttgtaaacttgtgatcacaagactagagggcccaaacatttcagtatgctagacctttcggacagaactccagggcccaagcagaccgcaatgtgatttcttacctgcacgaataccccattgcaatcgacatctccaactaatcgactgtaccggtcattgccatacacagaaatcttcagtctctttccctgcaccagcattgttagctcctcctttgcttctctgccataaggcattgaggtctctggtgcatcgatgcctctgcatttcatacatttcattacattatatcagcccagttggaaagaagtacctcactcgaacaagaatccagaagccagataaaccttagcctaatccggtatttcttcatgagaacctgtccacctcttgagtcagtaacttgcctgcactgaaaagtttcagaagtgtcacaggcagaaaccatgtgaagaaaactgaatattgtgctgaattctaagcaaaacaacctaaaccctgcatcaagtatgatcttctgcaattcatcagccctctgataattcttggtcatcagtgcttcggcacggtcagccgctgttctctgaacttcctggggcacattcaaagaccccgggtgatcagctgtgacaacgtgaacagtaatcgtgtcgccgtcagttacagccttagaatccacctgaagaaactagcacacatttttcagacattcaactaccacagcattgctaaaggatatgccaattgcaaagagagtgaggcctcacggggagcgtgtgcagctcatacttaacaccttgaggtttgggcgtcaacgacattatccaattaaatccatggcttgataccttcttctgcaacagcaaagtaaaacgaccaagaaatcgaatttaggacaccaagacattggagtttcttcaccagctgaatctacaacggttccactatcaatcttagacagtataaacaggtcaacaaaaagaaaaatcgacagatttcttcagatatatgtagatctgtaatttcagtgctaatttggaagggaactcagctaatcagtggatttaaacgcgtcaggaactcagcgctcatttctcaatacctgcgggaacagcccgtggcaggcatttccgacgaggacagcagcggctacaaagcagaacagcaccggcgacgtaccgcgccgctccttagctcctcctcctcctcctcctccgccgccgccgccgtgggcatgggcacccctctcgtggcgatgcctgtgagcggcgtacatgccaccaccaagcacccgagcccgtggtgcaccacgccgttccggtccgcagatctggccctggaggaggaggaggccagccagccacccggcgcccaggcggcaagctcttcccgctcgccgccggcgcaggcgagcggaagccgtcgcgaggccgaggcggcgccggcgcggcgggggtcgcgcgtccgtggcgtgcgaaccgagctgggtcggcctgggaccgttactggtggtactgtggcctttcgaatgtgtatcatgggctcatgggctgtatcctttcttgggcctactttttggagattttgttgggcccttaggttctaatgaactcagcacctccgttcataggcttgggcttctatctccctgtctgagctgtctccaattcaggtctgtttatgacaaagtcattggatgtttgttcccttcgttaacagatatactccctccgtattttaatgtatgacgccgttgacttttcgatcagcgtttgaccattcgttttattcaaattttttatgcaaatatgaaaaatatttatgtcatatttaaagaacatttgatgacgaatcaagtcacaataaaataaatgataattacatatttttttgaataagacgaatagtcaaacgttggacaaaaagtcaacggtgtcatacattaaaatatgaaggtagtaattgattatttagcaaaaattaaggttgtaataaaaaagctgagatattatctgttgtacttctagcacatcgaacgagaattaatgataaccgatgaaatgtctgttatagtttctttattctcgagaccccaaaatcccttatatttatagagaaatgaaatggtcaaaatatttgtatgtgtggatggagctagtattctctggctaggggtggatctacagtataagtgtcggtgtcagacaccgacggttttcagcaaaacctatagcaaaactgtttatccatatattataacaccatgatttaagcataattagcatactatggcaccgatagacacgttatgacaccaacgaatcgattttctgtatccgccactgctcccggcaaaaaaaaaaggtacaatatgctgctttaagatttgtgctctttcagagaagggggatagatgattacttatattcagctttatgaagttcctgaacaacattgaattcacttggacatcctctaccagtttcagttttacaacaatgcaattctcaaatacaatacaacacacaaatcacgatatgcacttaatcaattatagtacacacaccaatcaacgccctcttcttccttgacaacccctctgccgatgtactagtgtacacactacacgatctacacttctactgtggtgtaaagcatatattgctccgggctacaagtctgaaagagctaatattataaatcaatcatctgttgttcatggttcatgttcatgctgtaccattgcgcttgtccctcctccattcccatggcttctgtggccttgacgccgcccacaagcccttcctgccagattgcgcctgtttctcccactgatagattgaaaaatcaaaggctctcatttagaaatatgatacagaacaacctgaatgttcatggtgcttttcactcaagtgatctgtgtagctgtatggtttcaatgtaccttggccagctctggtcgttggtcataggcagtatagtgccatgcacatcctttcttcaacatttgctcctgttcagaaagcaagaggcaaattatgtaccttgtgtaagtatggaagaaagataggcttcaggaaaagataaactttttcagtacgtgtcatgtgatgaaatattttcacagttccttgcagaacgcggaagcaaaagttttaaaagaacgaattaactttccttcatattccagttaaacacctgaactttcatgatcctaagtaacactccattaaacaaaactgcagtataacaactgcaagcgaaatggcacatggcgcaaactatcgcagtagtactttctaagcttctcccattggtgcacaatgtgccattgcaattcaacaagaacaaaagtgttctaacgatgaaattgatttcactgcatgattacctgcacaaacaccccatcgcagtagatatctccgacgcatctaccataccggtcctcatcatacacatagaccttcaggctctttccctgcaccattttcagaagcgcctcttttgcctccttgccgtacggcatggcgctctccggcgcatcaatccccctgcattttcatttcatttcatacgaccacctcaaacttgagaagaagaaaaacggcagaatcatttgctcattgatcgagtgatcaagagatagtagcacacagaccttagcctgatcctgtacttctttgcgagcacttcctcgcctctcgcattaggaacttgcctgcattgaaaacttcagaattgtcacacagcctgaaccattaaccatctctgaaaatttaacaaaaaactgattgatcgatgtgaagtgcaagctgatgacctatatcctgcatcagctatcatcttctgcaacccgtcggccttctgataatccctggccgcgcgcgcccttgtccgttccgccgccgctttctgaatttcacggggaacattgccggactcccgaggatcggccgtgtcaatgtacacggtgatcgtgtcgccgtcggccacggcctttgcatcgacctaagaaactagcaggtgcacttgtcagtccaagagcctttcttggcatgaaaaattcagatgatatttgttttttttgcgaggaaaattcagagattagaaagtaataatcagtctcaccgggagagtgtgcagctcaaacttgcaaccttgaggttttgggacgtgtgcagtgtgaggcgcaggggtacttgctgctgcatttggaattggaaggccatagaaaaccaagaatccctggacaagcataaacaggcatgcatcgattgttcagactttcagaattcaagcgcctagaatatgagtatgatgacattggaagtttgaatctttgagatatacctcgacgtctgctttctgatgattcttcagcgtggtgacgacgagccgcgcggcttcctccggcgtcctcggcgtcggcctggctttcttccatgtcactatcagcttcttgtacctacagcaccaggaaattttatcacagtagtactagactactagtgtccagggcttacaaaatcatgcgattatcacgcgatttatcgcgtctaataatcttttcagtttttaaaaccacggtaaacacggtaaacacacggttaccgctaaaccatgaggtgacgataatcctgatcccaaacgatttagtaaaccctgctagtatcatggcagcggtttgaggaaatcctaccgtgcctactggctaatgacaattactgcaagcatttatgactgatttaatttaccgaattctccactgcctgattaagcttcactcaattattgcggttcagtttagtaaagttatctctcgatacccctcgacgtactgaaccacaattccgtcaccaaaatcagcgaatgatatattttgtttcttcttgcttgaaaaagaaaggaaattctcttttccaaaagaaagaaatgaactttgttttttcaaaaaaaaaagaagagttattttcctcttgaacacgtcgctttcaaaattttcacacgcccaatccctcgcgattacgacaaagctcatcggctctgatccatttccagctcgaaacaaggaggaagaaaacataagtaggaggaattgaattacgcaccaattagcctgcgctttcttggaggagactacatgccggctcagcccatccggaaccttaaaaattcaaaacaaaccaaattaaaccccccaagaaaaaaaaatcccatcaccttacgacgccgacgcatcgcaaaatcgaatttcatcagcttcagcctcacgccctcacctgcgaggtggcctcgaactgctggatgtcccggccgagcgccgcgacggcggggtgcgcgccgtgcggctggtactccggcgacggcgagcagaggccgcacaggaacctgtatatgctgttccccatgcccccgacctcgccgccgaaacaatcctctcaccggagaatcgactgtgggtttccgtgcgcgaatccgcttcgggatttgaaaacttttccggtggttttgtatggatctgcgcgaaagaggcagtgtgaaagcggttttagccgtttcggaatcggagctctcttcacgagggaggaaaagctgttaagctgtcgagtcgaagcgagatttgccacgtggagggcggtgattggatccgggcggtgccctggctggacggtccggattcactgtggagcgaatcctgtggctatctatgtgtgcttttgtgttgtgtcaatgtcttgatgctgatgtcgagttaggaattactgaattaggattatgttctaactaatctgtccaggcgtcgacaggaggtttgttcccggcgaattcaggattctttgccttcaattcagggaggaaaaacgaattcaaaatgctttgcttttcttttttttggtgagatttcagaaagtcgtcgtcgttgatgctaggtggcatgcgaacaaagcagttgcgaatggcgatttggacgactgcacacgagccacctcagacgtcagttagcagcagctaagggagcagattatttgatggtgaggattctcgtgatttttaacggtcgcagcgcgtcagttcattccgttactccacggctgcactcaagatgctcaattctcagttcgagcgtgcaaggccttgctggaacctgacggtcgtgcatccgttcacgataaggattctattcacgcgagtgaatgtccgtttgtttattgtatataatctattttttaattttttttaacaaaatagattaatatgtaatatatcacttcacgaccaaattgtaacaaaatagttaacaaattaaactttagctatgtaatatattcaatcaaatttattatttttattataatttgtagaagttgaatttaaatttatatatttgtgaattcctgacaaccttgcattggcaaggattttggatttagcatctgaaagaagaaactgctggaaggcttcacgaagtggctaacacaaagcatggaatttatttatttgttgagagataaaactggaaatattgccgtgactgatctgcctacggactcaggattacttgctcacgattatcaagctgtacaaacttaatctttcctttgccatcatgatgccaggaaaccggacaaggctctcctggtacagcacgagtcgcattgaatcgtcgtcgcccggccagcaatggaggccatcttccggagactgtcggagtccgggtcgtagatgtgggcctcctgcgcagtggtcgcgagaaggagcttcctcctcctcctcttcttcttctctgccatggagagatcgccgtcgtcgtcaaggtacctgagcgcggcgacgagccacggcggaaggaatcgtcggcggcgagagccgagaaggagaggacgccgtgggggcttgtcgaggtagtctgtcctgaaactccagtggaggcacccgtcccgtccgccaacaccgggtgcatgcacatcgctgtcgatgctggcgtcgtcgtcggtgaaaccgaggaacgcgtcatcatggttgccgatggcggccggggccctccagcctcgggcatcgccaacggtgagcacaatggcgtgcaggtgcagtttgcccacctctacgcctaaccgcaccaccttgaactctttggccgtcacgtggaagcccatggcggcggcacagtgaggtcggtgcgaccgcgccagatgcagaatctcacctgtggtggggctgcatacggagtagctagccttcgaatggcctagcgacgagccgacgagagcgaggacacaacagggcttggaggctggagccgatcaccctcagactgtcagacagtcgaagcaattgccaatcgccatgtgcgtaggtgtgcggcggaagcaccggagatcggcgcaggcggcgggcgaattcgcgagaaaatgggagttgagcccccggggggtgtcacgggagactatagttggccataaggcccgaggcccgacggcccggcgcaaggcacgaggttttggcccgacctaagcacggcacaacccaatcgctgtcaggcccgtgccggcacggcccggctgttgggtcatgtctggacctatgcctcagcacggtgggctagcctggcaagtcacgaagtttagagaagtgaaatagacttattttcaaccataggtaagacagggcacaaagaatagagagaacaaatagacatattatatggcacggcccaaagagtagggacgcaaaatagacttattttagctatatatatgtcacagccgaaagagatggagggtaaatagacttatttcaaaaaaaaacacgatgggctgctcgtgccttcgtgccggcctggtggagcacgtgggccagcactgcatgagccgacgtgtaggtcgggtcgtgccggcccgacaaatcttggcccgggcacgacaggacctagggcgggctaggatgggccctatgaaagtaggatcaccgactctatgccaagttctcaaaagtgttttcttatatagaaatcaccagaaaagccccgatcgagcacttgagaaagactaaagcttgaaaggggcttcacttctgggacttcttggctaagaggatgcttgctataagaagtataagtaggcggataacgtttcatttcttccatagaatctcaatatggcgaaaatgaagcaaggcaattaaagctacgagccgggcggcccatttggccatctatacgggagaccgttggtccagctatattagtagggagtgctgtttgggccaaattgaggtggagtctcactttggcacgacccaaagccgcccggggttgcttgttggatcaaatcacgtggctctagggccacgagctcacaaacaacaagctatttgtgggatggaaaaagtctacttcgactcccttaaaagtcggtcaaatctaattcatgccccttaactagaaaaccggataaaatgactccccgaactaatgaaaccagtgtaatttgactcccttagtggttttggaggatgatttcactgacatgacgctgttgattgggtctttgtctcatgcggcattgacgtggcgcttatatggcattaaaattaaaaatactagatgacaccccgcgcgttgctgcgggacattcatgtacacattgctatatatttcaatatatatatatatatatatatatatatatatatatatatatatatatatatatatatatatatatatatatatatatagcagttgtaaatcttagtaaaaaaataactaagtaaatagaaaggaaaaagaaagactcaagtagggttggtcagatgtccagtgcactgccactcaggtagcaagacccacagcgctgaatcttaggcacaatatcttgtaatgtaatggaaaatgatgctagtgatcattgtttttttaccgaatacacgcatatttccatgcctggtcttacattctttaataatcaaattcctctgacattgtaaagataaactaaacagaaaaaaaaaaagaaagcggaggaacttaatttttgcaatccattcgatttctatagacatgtttcatagacagttatttggaagcatgaatatcaaatcaaacaattaaagaataagatttttccaaaaagaagtaaggatagactaactgtgctgatacgtcgagaacacactccgctggagacttgtatatgtcatgaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagtgatgtaccgtggtttgaatagaatgagtctacaatctataaagcttgcattcagtccatagaaccaccacacctgcgaccaattaggcaaaagtcataaagaaaaaagattgatcaatctctccattagagcaagtttaatagtatagccaactacaggctccaattcatctatagccaatctaatagctcattcatacaatagttacatactacactattaatatctggttccacctatcatacacacacttcgtcttggaatccgtgctacagctggctacaaatatatagcctgctgcccttctctctcctcatttatctgcttaagatatgtttgcagttggcttatagcctgctattgtacctgctcttactgcagcagcagctccgtcagttcctgaaggcaagacatgttcgctgaggtttcgcaataaagcggtgtgtatgcatccgccgcgggctgcttcagctcccatcgtggtgtttagcaaaaggagatgtaacagatggaaagttaattagcgtgaaaaagatgagcgatttactcagcgtacaaatagctattgtcgtcgattcgtatgccgtgttagatggcagccgttcctctaatacggagatgacgcagcagactattggaagggttccgcatgacctggtgaccactcgtctgcaggggaaggttgaaggactccatgcctcattgcctggtgggctgagaagaatttccaatgctcctaatcgagtgaatgggccacataaaggagcatattggagatgatcagatggttgagaataactccctcgaatgatctaacggttgatttttagtggatgacatggcttcatagaatttgagctttatagcactaaatgatctttagtgggtaccaattatatataggaagaaaggatatttgtgggacccatttatcattcacacaaaaaagatataatgggcaagaggaacaagtccggggaaggggatattcgccggcgccggtaggtctagccatttcccaacattgccctattggtgggtccgcttggggctaaatacacgaacaaattgtgaatatttctgcgaggggatcggtgatgctgcgcgcgcaccgcgctggtctgggtgtgctgcggcggcgcaaccccgttctgggttgcatcctcgtcggcagcggggcgtagggatacggatcttgcgtctgcgtgcctacttgtcggcgtcgacgaggacttggaggaagccggaggaggggtggatgaagctcaacttcgacgggtcttccaagcactcgaccgggatcgcgagcatcagcaccgtgctcaggcgagggctcgagctggcggtgcagaacgggtggcgcctcatttgggcggagggcgactccaaggtgatggtcgacgtggtgcgcgaccgtgccgacatgcagtcggagaaggacctgagactgtgcagggagatcgccacgctgctcccgcaactcgacgacatggccgtgttccacgtgtgccgcggcgggaacaaggtggccgagctcggccacagggtccccacctgggtcgccggggcgtcgtacgttgccctggccgccgtctccatcgtcgttgtgccgctcccgtacccgcagctccagcattgccacgcgcgctgtgccgttgttcgccattggccgaaggggaagagaaagagagagataaggagagaggaaggggaagaagggttggagagagaggatgaccatgtggccccacatgtcagtgggtcccattgtatatttttgtgtgaatgataaatgggtcccacaaatatatttttaattttaatgctatataagcgtcacgtcaataccatgtgggataaagacccaatcaacaccgtcatgtcagcgccacatcagcgaaaccgtactccaaaaccactaaggagtgaaattacactggtttcattagttcagggagttattctatatttctatctggttttttggttaatgggcatgaattagattcggtcgacttttaagagagtcaaagtgaccttttccttgtgggtttgccttgtcgcgcgtgtatgactggtagaatcatcagtagcatgcctttgtgacggcgcctagaaaaactattttagaaatagatcctttttcagctcgggcctcattggcgccgaggtcattaggcttgacagtcgacaccaattacgttggcagcgagactcataccgctgtggcaccataggctcgatgccaatgaggttggttgtttatgtagcactgattctcatcgtatccatgacttatctaccatagagatcgagggtgtagatgacagtatcattagcgtggagacgctaaaacatcggagtcgatgatcgtggcatagagaaaaaaaaaggagcattggcgaaatcaattttcgtaaagactcatttaaaaaaaacattgttaaacaaaagaacaaataaaatgtagtaaaaatcacagtgcaagtgcaacccactcatccgatacaccaccatgtccccaccttggctggaactggaagcctggaaggcgtggtccgccgcgttagaaatccaatccaccactcactccattagtttaaaaaaaaaagccgcgttagaaatccaatctaccactcactccattagtttaaaaaaaaaaagtcgcgttagaaatccaatccaccactcactccattagtttcaaaaaaaaaaaacagagagagagagaagaaaaaccctaaatctcggcaatggaaggcgacgaagagccaccggcggcggcggcgatggcggccgtgctgacggacgatttcctgctccgatccatcctgaagtgtctgtgtccgagggatgtggtccgcgcggcccttgccaacaagagctggcggcgcgcggcggccctcgccgtcccccgcacaccgccgctcgtcggctacctcctgcacccggagaaaatccggtcggcccagatcccccccgtcttcgtccccagcgacgcctcgttcccgcgcctctccctccccttggctcccgacgacctctccggtgtgtccgtgcacgatgtccaccacggcctggtccttctactaccctgcgagcttcccgacattctcctgctccgcatactggtgctcgatccggcatccggacgccgggctctgctccctcctccgccgcgcgacgctctgcccgacgaccagtggcgccaaacccggcgcatcatcggcgccgcggtgctctcgcgcgcgcatcccagtaggctgcacttccaggcggtctgcgtcaccatcgacgacgaccgccctcgcgcctgggtcgccttcgtcaacggcgaggattgcctctggtgcatccttccacgctccaagcatgttagggttcttcgttttgatctcagcatgtgctgtgccgcccacgatcagggacagatctgctggatcgcctccaactccaaccaagtgctcgcactggaaccttcatctttggagtttcagttcataacttcttctccagctgctgtgccggttgatgtatttgcatattttctgtcttggccacctgcatttcttagcctgctcgaggttgttttctcacggttccaacctatttaataatttagatttgtccatgcaacaattgtgtttgctaaactaatttattgttgctaaacttattttaggagaatgatgatgcgctaactgacagcttgatgagtcttattaaaatagtcttctacaatatatgctacgtgagaggattgttttctaaggagttcttctctgatatgccttttctaccgacaggttgaaatcttatttgaatctatacctattcttttgtcacacttgtagcaatgaactgataagtttgtttcttatgacagggatgcagataaaaaagcttacgccgatggatgacgagtcccaaaggcttgttgattggctagaaaaaggtgaaaagtacccgacatagcatgagctccttaaatactttgcttgtccagcatatggttatgcgtgaaaaaacaatttcttatctgtccatttgattaacttttggtatcaaacttaggtgtttatgatgctctgaaaaagaagttcctcaaaactatcatcttctctatctatgatgagaagggccctctgttggaggagtattgccgtaagtttctgctagagtggggctttggcttactaatagcatatcaagctgacatggctaatactatcacacatttacatttcttttgcagtatcattcacatacttcagcgaaattacaatcgacttacggctgacgggatccactcaaagtatatggacaatgaggtccgatgcagctgagagctttgttaatcaaatttggtgagcctcttatacttctactagaacttcatggttcggacaacacgacatgtacagcagtgaaacaggtcctgaatggggcaacatgtgaatgaaatgaaccagattttgaatagggcaaaatgtgaacaaagtgacatgcataacttgaggtgctagagatgaacatcctttttgcagtagaactgaactttcttgatctttcattccatactcaggattataatacaacctagcccagcttcgactggtatttcaatatgcaatcaaaaccaactaactggttgatcagcaaagtaaagccttgtttacatattaaaaatgcatgtgggagtattgtttacataattggttaaggatattcttctagattactatttcacctcaaaaaattcttctagattagtatgaccaaaaggcgcgtgcgagaaaattgtcatgaataaggagacccttctgtatttccagtgacctatgtggctatttcaaagtgaaatgtattatgcctttttgttcaactgaattgagtgaaccatgggtgttttctccagtagtaatattaacctgaaaaatattttatatctatcactgctgaataatttagttcatacactagtagcttccactgaaaagtactctacccatatgctagtacctgcatcctctctattctagttatagttatatatattgatccatcctgaaattctgagctgctacactgatgtactatctctatgcactgacagaaaattgttccatacaactttgttactggaaactaacacaaccttcttttccccctattgtcagcctctggactatgaacctcctttttttgagagttatgatgatatgagaaaacgttgtccgctcccactacatactactttatcagattactcacaaggtaattgtatgagtcattttaaactagttctgaacattggtctctatagccctgagtaaatgtctttttgtgctcattattcagatttgatcagtttacatgatgtaaaatcagtgctctccaacaatccctttcattccaacaaggtgataatttatctctatttatattcttatgttcaatgcatgcacctttcaatttcttttcgcctgaacaacctctgccgtctcattttaattaggtttttgcaatggacccaaaaagcaaaatccaacaagggcaccttttttgcattactaagaaagatgtccacttctattttgattctggtgctagccaccacatgtgtgatgatgataaactcttcaaaaatctccatgaggttcctactgaacatcaggatactgtttatgatgctagtggcgacccagtgtgcctgcacatgtccggtgaagtgatatatgatcaaatcaaattgagtccagtattctaccactctactctcaaatttaaagttatatctcttggtgaactggatgattctaacaccctcatgtatgttggagataaaaggattaaaatctttgatgtaaataaaggtgaaatgatcggcgagggatatctccacgaaaagagaaatgaatatatagttcgaagcatcatatgcagaaaagaagaacaacaagctataaccagatcgatgttgtcctcaacggcaattgatgaggttagttctaggcttctagcccttctatccatacctggtaacttcctctcataatttgtctttacttgcagaaaaatttgtgggtagttgattctctatgctgcaatcacatgactggtataaagggacttctatctgatacaagacacgaggtacagtcatttgttacccccagaggtgcatttttaagctcaaaaattggaaatgtgaagactagtacagtaacactgtttaatgtgttgtactgtaagggactgaggtatgttcattacaattgaatcgtatgttgaaaatgttctcatccaataacgtatgggttgcaactgtttactaatccaatttaatgctttcttctatgcaaaaacagacagaatctcatatccgaaggtcaattagaccgtgacggctattcatgtacaaggcttgctcacaaatgcaagattcagtggagagggactcaagaagtgttggtctagctcatcaggacgagaatgcactgtattacgtggattattttcactatgtcagcgacccatctttgaagcatacgaggaatgatggagaatgcatacagaagttgaagcgtccgcggcaagatggatcctctccatctagtaggaaaaggactgcgtaaactggatagatgtgttcattttgtcttttgtaaacatgagaagaataccacccaacatacgaagatttgatgtgctctgttgtttcaacatttttaaacctcgttcttacagatgatggttgcatgctagtaatacccaggaaaatgctttttccatttgatttacattggctcgcgttagtatagccctcaaaaaaatctaaggataaagtttctttatagatctgcattaaggtttttatatgtattgctactggactgtcgagatggtccggattttaccgtgaccgaaaacaagggagcttcctttgaggcataatttgttgaggcgcgtccaatgtaatactgaattttaacacattttggtaaataccaaatgttgttggtgttgagatgcatttggtttacaactttgcaaccttaccagatcttactatattttgccaatagtaaagggtctaatctctggcatttccaccattctacctttcctataattcccatgtgtagttttatgcggccgagtagcaatagaaactaatttaaaaatataatattcatttactagcaaatatgcccgtgcgttgcaccgggtgaatatcaaacaaatatggatggttaagattacttgtgtacttataacacgtgcacaaaaatattgaatttgtacataccttgcaaatatctccaagttttatacatggaaatatcaaaacatatctcatactgtatacatatttagattcaggtcgtatctcaaattttataatacatgcgtgagatattccaaattttctacacattcagaacatattccaactttcacaaaatttcataaacaggggcagttatagctctgatttcaccatgctctacaaaaggaaaaaggtaaaggcatctgcaatgggaaagaaacacactttgtagtatcaaaataaaattcactaaaaaatctttagtggaatatgtgcgaattttgacatgaaaccatattaacgttggtcaaatacaatatcatatgattaatactttctagataatttttttgttggtttcatttatctaaaaataatctatgagtgattaaataattgatcgtaatttcccagtaattttaaatggcttaaaatagtagcaaacaaatttatgtaaatataaaaaataattaaatcagttgcttagaaaaataaactgattttggcctagcattgtggtttagggatgaatttcaaattcggggacaacttgcgggaccaaatttgaacttatctgtgcggagtgtatacatggcccatgaggtggcccaattatgtggcgacctgggaacggcaacccgacgcgggagaagccgcaaccgttcgatctgatcaacagtcccgattgatccggacatatatataaagtcggcagcccaaaccctaaccctaaaatcatttcccctcccccctctctctctcaaaacgacggcgtcagcggcgcctctccccctccgccgctccccctctccctcccgtttcgctagcatggcacgatgttggcgagtgctcgacgcaatgcagcgaggtgagggtacgacgaccatccttccatttcccctctccccgtcggcctcgatggtggggctacgagcctacggcgcagagacggcggcgacggctgtccttctctctttctcctctgtttccgagcaggaggagagcgctggagggtggggccccggggtagagggagggggtgccagcgcaattggggatgtggtgaatgtggccgtgcccggctggccaggctatgacaggagcgcggtcgacggcaatggtgacgagctcggaacaactggatccgacgggaaactcgctcatttgtgtgattttttccctttttctagggttctcaatctgtgtaactgtccgattggatgattcttattcttttagattctccgtgtagttctattcgataggatgacttttttcaggttctcagtccggtgtagttctgttcgataggatgacttttttcaggttctcagtctgtgtagatctttgatttgattttgtgctttatccatagtacatgattggtatatagatgatgaggacatcacttcatcggatacgctcataacttcacacgttacaatgataattccaagtccaagtccagttcggccttcggagacagtactgacttcaaacggacctagcgccttcatgccaactctgatttgggtgatcttggacttcgtggaaagcttatctcgctaccttcaaacgcatccggtctcatatccaaattcatctcgagtaaacgggaatagccaaaacaagacagtgctgttgctgaaaccgaacttgggccttgggccttgtaatagactaggcccatctcataagtgtctccctccacctccacgaattagcacttaaccctagctttattttcctctataaatagctttctacatcctcaaaaacttttgggttttgtttagttgaattttgccaagtgccattcaccttgtctctagtcctcgttcgattagtcggcgactattgattcagagcccccaatagttggtgtgttgatttgccgggtcgattagatctaccacttcaatcgcaactatttctttgtgcttaattacctattcgcaatatttagattgcatcttatcttgttcttgcagtgttctctcgtttgcattgcagggatcatcaaccgcgcgtcacggttggtacgacatcgtttgtggtgtaccgattgcacggcatcctggacttgttctggttggtagccacgtcgtaaatgtcacactcgatcaaaacgagagttatcccctcaccagaagatcgggccacaagagagagcgtcatcagattgattaacttgtaatgcttgtattgaacttggtactactgtaccttttctttaaattgtgacattgtctttgcttgtgggatatggttgaactgatatttggacatgtaaacgggcatgcccgcgggcatatggcgtccgcgggcgacgggcatgggaagtactcatttcccgtcatgtagtaacgggcatgctcgcgagcataaattacctcgcgggcacgggcatgggtagtcaccacccgtgcctgtcgtgcccgactgccatccctacacataacttaccctaaccaatgcatttcaacccaaatcccccaaaatatccctaaatcagctagggtctcgacggtgaggttagcggaaggaggccgagaggtagcggttgtagcggcctcggcggtgagattagcggcaggaggcagcgcagtgcagcggggttagcggtggtacagtgcggctgaattagcggcgggagccagtgcaatggcaattgctaatcgggactgcattttctatacatgcaaggagaaaaatgagagggaagaacgatttgaggatttttttttttgggattctggtgttactatatagctacaaggagatatatgcgacgtgttgtgatgtggagggggttgagagcaaaagtgttacctacgtggcatgccacgttggcggtcaaatgcaatcaaaggacgtttggaccaaggtggtacattaaaccaagttcacggatctaaacgtgcaatttttaagttcacggacctaaggccctgtttgtttcagcttaagattattgtaatctagattatcgagccaggttactataagctagattataataagccgacataaaataagttgttagctgtttgtttctctggattattagttgcttgttagctattagccacccaataatctaaaaaggcacctttagagtagattaccatattacattaatctggcttatagattgtaataatctgttataataagatatctgtttgttttagcttacatctaataatccagattataataatcctaagctgaatcaaacagggcctaagtgacaccaccacacaagtttaggggccggccatgtatttcactcaaaaggttttatgctactagaatgttgctgagtacatagattcctattttctttcaaggaagagcgaggctggtttgaactattaatttactgaatcgagtgaagctgtgttgcgtaacaagactataggttgccaaggcctataagtacaagtggtcgctctaatggtcactctcaaacttactacttgagtgactttcgtcacttagcttctttaatagggttcaaacaatataagaattcacaatatgaagaaaaagtcaatgaaaaagtttataaattaaagcattatgattgctataaacattataattgaaaattttaatgaaaaatcttcattgttttggactgaaaaggaaggaaaaatgggtttttacccataaactaatgaaaatattagtcctcaacccgtttctctttgacccagcccataagtgaagccacggtatcagttcgaacaaccctcttcaacctccggctgaatctttctcgatctccttaaattggttgacaaatcgacgtggagacagctgcggtagagtttggcccggcagcgaaccgtgtgaactaaaaaacagcgaaaaaggaaagaaaaaaagacagaccaaaaatgcgtacgatacgaaagctttacttatttattaattcggtacggatatatatatatatatatatatatatatatatatatatatatatatatatatatatatatatatatatatatatatagatagatagatagatagatagatagatagatagatcagttcgcctgcaccgatcgatctccatatcccgcgtgcgtcgcgtacgtcctgctgcttcgtccgccgccgccgccggcgtacgcgtacgcgcgcacatatatagatcgatccgtttgtgggtgtgacatacagtacgtacagcaacgcgatggcgagcccgcgaaccaagaaaaggaagacgggcgatgagcggtcggcggcgtgtggcgtcacggtcacgctgcccgaccacgtcgtgacggaggtgctcgtgcgcctgccggcgaggtctctcgcgaggctccgctgcacctgccgctcctggaacgccgaggtgtcgttgcccggcttccaagacagacaccacgctctcgccgccgccaagttaaccttcctggagcctgcacctacgcacatggggtcgtaccgaataagaagaaggctcagtaggcggactttgccgtggctcagcaattgcttcgactgtccgagagtgatcggctccaagccctgctggggcctcgtcctcattgccaggccgtgcgaaggctactccgtgtgcaaccctaccacaggtgagattctgcatcttccccggtcgcaccgacctcactgtgccactgtcatgggcttccacgcgccggccagagagttcaaggtggtgcagttaggcatagacgaagaggtagtgggcaaactgcacgccattgtgctcaccgttggcgacgcccgaggctggagggccatctcgtcgttccagctcggcctcggtttcaccgacgacgccgccagcatcgaccgcgatgtgcagccggtgttcgcggatgggtgcctccactggagtttcaggacaaactacctcgacaagccccacggcgtcctctctttctcgctcgccgacgagtccttccgccgtgttccccagccgcctttctcaatggtcgacctcgttccggtccacttgaacggagtcagaaactaccgtctgttgcgagccaaaggcataaggtccgggagcggcgaggaagtggccatgccggttgggaaaacgctcgcggagctcgacggccgcctgtgcatggtacgcgacgtccgccaccgcagcgaccacgacgtgctgttggagatatggaagctgcaggactacgacaccgggagctggtcgctggactaccgcgtcgacctgccagcgccgggccagcgccagcgccagctgctcacggcaccgtggctcgtcgtcccgctcacctaccttggtggctccccgccgggagacaagaagaggaagcttcttgtcgcgaccacggcgcacgaggctcatgtctacgacccggactccggcactctccggacggtggcctccattgacagctcgggggacggggacgacgattcaatacgtctcttgctgtaccaggagagccttgttcggcttcctggcatgcagcatggcctaggaaatattaagtttgtacaactttccaatagtgagcatatgtaatcctgagctcgtagctaggcagagtgaatacttaatatatttgcatccaccgcgtccagagttaatcaagtgtggccagttttatctctcaacaaacaaatatatccttaatcgattttgctatatctcactcgaaagattttttcttatctctcactcgattttctcactcaaatttacagtgcattttcttgtaagttacagtgtaatttataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgatcataaaaatctttcgaaagatgtataggtactcccatccttaattgctacaggattgtacgtgttagccactttgtggagccttcgatcagtttcttttttagataaagtccaaaatcgttgccaacgcaagggtgcgaggaattcacaaatatatcacttaacaaaaaattcggcttctaaaaattataaattatcaacaaatttgattgtggataaattacatagttatagtttgatttgttaatcaatttgtagaaatcaaatttaaacttgttattgtatcgtgaagtgatatatttattacatactagtgaacgtgcacgtacaaagcacattgatacatagaattgttgatcatttactgatacattatctctttttttcccctccaaaaattgtatgttccaggcgtaaaaatgcacactttgaaaggaactttagtggaagtgtcaggtttcaggtcaacaagcatttttaggactccattcaggatattgccccttgggggaacaaaaataacatacaataagagaaagtgcaaagcataatttgtggcttttatcagctgaaaaccagcatagctaatagttggcacttaattaataaaggttgttctcttgttcacatattagaagacaaaaataacgaatctaggaaagcatttccccccattttgatttaggcagcaactgaaggttacatctgggagggggagggcgccggccgtctcgcccgccacgctgtgccactcccgccgcgccaggccggcaccccgccgccgcgccccttgccagagcgccatcccgtgcgcgcggccgcgccaggctggcaccccgccgcgcgccatgcccgcccctccccctctggcgtggagaatcgagaagaaaggggagaagagaacagagaaggagataagaaagagagagaaagaggaagagaagaagggaaagaaaaggaagaggacacttacagttgggacccaccttctttaatccaatgaaaaactttgaatcgaattttatcgtagtaaatgaactcatatgaaaaagttgtcaaaaacaaagttgcagaattcattgacatctaccatttttattttggtaatttttccatccgagttttattgaactatagaaaatttgaattttaaaatatatgaaattgaaataattttttgggtagtaaatgttttcaaatgaaaaaaactgtcaacaccaaatttgtaaaacgcatcaagatctacaacttttgtttgggtcatttttctatgtgactttgtttaaacagtttgaatttgaatttcaaaatatgataccttcaaacaacattttcaaatactaaatgatttcaactgaaaaagtcatcaataaaaaagttgtataactcatcaagatctataacttttatttttgtcatttcttcatccgacaaagcgatagttacattttttacaaaatttacatatctcacatatggtttcataagttataagagagatatgtaaattttgtgaacaatgttactattgctttgtcagatgaagaaatgatcaaaataaaagttgtagctcttgatgagttctacaacttttatgttcatgactttttcagctgaaattatttaccgcttcaaaatattatttgaagttgtcatttttttgaaatccaaaattttaattgataaaacaaagtcacaagaaaaatatggccaaaataatagcagtaagaacacaataacacaatagagcatgattttacaaacgtttaggaaaaagaatcatccaatttggagttcatatgagtgcgataaactagtcttaaggagctgcatgagaaaattaaggtcgatttttgcatacaccgtcaccctcaaccacaaaattggatatagcaaaattattaacactaaaatttggaaatgttgatatgttctattagaaaaaataatgaattatatttcttcgttgatttgtgatgcttagtttgaggggtttttatgttccgattaatattcgtcaccgtattcgtttcgtttcgtattcgctccgtatctgtattcgacaatattcgattccgtttttgtatccggggtttccgattccgattccgaaaaaaatgtgaaaatgaatatggtagagctagtttccgtccgtatccgatccgttttcatccctagctgctaagagatctctaagagcaagtttaatagtatagcccactactagctttaatttatctatagttaatttaatagtcaattcatacaatagttgtttactatactattaatatatggtcccacctgtcatacacatattgtgttttggagtctgcgactacagatatgtaacccactacttttctctctcatcttttatcttattaaaatatgtttacagctcactaatagtctactattgtacctgcttgaggatctgaatgaaactcaacgcaagttgagcgatataaactgaactttatcccctgcgaaaatcagaccgctacaagtctacaactggtagcggttcaaactgggcccttcaaaggtatagtaggcccagaaattaacttggaccgcaggaatcaggatcaatcgagcgtgaggacgacgatcagatgcagagctcgcgtgatttccaaggagtattcatgaattagttcccaaatcattgccgggaatctcagcgtccatcgatctagcattgcctgctgccgtggtatcatcgaaaccgatgggtctcgttgctgtttatctgaacttctttttttttttcatgtacaaaagaaaaaaaaaagagggccggggttgggggggggggatccaacatgacacacaacctcacttcatgagttgagttcatatatatatataacttgcaagtggtttaattttcatttaatttcgcatcaatcagagctgccgacttgtttaattttgtatgaacaagttcgttcgctttggtaaacccaaatgaactttaaaaagaagttgcaaaatgttgttcgaagatacaagaagatagaatggaagtcgctttgtgcttcgaaaattatacacagttgttgatttcagaatgtaaaatcggcacatcactaacacaaaaggtgaataaaaatatttaccgggcaccagaggaaatttacacaccaggcaaaaaaaccactgtgaattcagagaagaaaaagaaattaagctaggcgctagctcagggatcctcggtgatgcacgagaggtgcggctgccacggcgaggcatggctgccggtgctcatgcgccgccggtgttggtgctgctgcttctgcgccctcatcatcctcgtcgtctccggcgacgcgctgccggccgggctgcccaaccgatcggcggcgacggcgctgccctccgacttgctgcggacgtggtgcccgcggccggcgccgccgccgccggtgctcgtcctcctcttggcgtcggggacggaggcggcggggatgaggaagtagatctcgccgcgctccagctccgactccggcgacacgatgagtatccgccccgccgccccctgctgcgacgagcacggccggctcagaacgtggttggggtgcgccgccagcacctcgccggcggacacggcgcggccgtactcgtcgacgcggccgctgaggtgcacgatccggaccaggtccagcgcgccgcacggcagcacgcacgccaggcagcatctcaggttgttccccatttcttcttcgctcctcggtcgaacacttggcgatcgagctaacccaccacctacctactagcttagcttctcttctcttctcttcactgtgttgagctcggtgaggttggccatggattgtatatataggagaggacaaaatgacaaattaaggacttgtttagttcgcgaaaagaaaatttttaggtgtcacatcggacatttaaccggatatcgaaagatgttttcggacacgaatgaaaaaactaatttcataactcgcttggaaactgcgaaacgaatttattaagcctaattaatccatcattagcacatgtgggttactgtaaaacttatgactaattatggactaattagactcaaaagattcgtctcgcgatttccatgcaaactgtacaattaattgtttattttatctatatttaatgctctatatacttgtccaaagattcgatgtgatgtttttgtgggaaaaaatttgggaactaaacacgcctaaaagaagcaaaagagagagagatagatagagagagagagagagagacttaacaccattaacagtagggttttcatcacttcaccgtttggtgagatcacctcatctcacctcactactactcatcagtcatgtgtgccatgaccttatctagatcctaaacaacaattaggtttgtctaatcatggagagatgctgggttctactaagtactaacccatgttctaatgtttttttccttttttcaagattagcagctagtgccttaattagttaattgtgctgtgtttttttctttttttttcttctgctggctgcaatgattcgagcatcatggacacagccatgctgccttgctgtaccttggttgtatgctaatatgctatgccatgctaccctctgatgagtgtgcttccattgcatgcatgcatgcatgcatgagtgctgcaagctagctagccgattatactacgagtgtgaatgctcaattggatatataggagtttaggtagcatggatttgtttaagggcctccattgattagttgtttggtgccttcatctatataagttaattaacatatgaacctggccgtgcaacatcttaattttttttcgtagtagaattaaggtgaatatggaacagaccatatgctagcctacaagctaagaaagctatagtgttgttacttctgatggattgtatatataatggctacctagctttttgagacgatgattagttagtatgttaattcgacgtgctaccatacgctgaactaatcgagtgattagtcgagctgaacgcaacgacaagccaagctgtgacaaaaattattgtgcaggtagagtagtagctctctggcttagatcatcagtgcggtcaacgcattgcacgcgttgatgcttgttgccaccgtgtttcagctagattgcgttgcatgacaagtttgcattgctcgatcgctagctttacaatttagctcgacagatcgaccacagccgacgacctgcataattgttccatccatgcaagtagaggcagggcgaattaagctaggagaactattatggctcaacttcatatataaatgtatgacaccccttactactaggtataaattaatataatcttggtatttataaatatggttgtgtacatctaagtttgtgcgcaaaaaagaattacttaaaaatggactatacatgattaaaaaaactttttgaaatggaaagtattcatatattagaatatgtgtatatataaatacagtgaattttattgtaaaaaataaggtgttccacatgctgcctttcctgcgtaggaactgagcttttatgcggcacggaaaccaaagcaagcaattgacctataattaattaattattaactattataaacttaaaaaatgttcattcattttttttaaaaaaacttttatataaactttttaaaaattatatcgtttaattaacagtttggaaatatgctaacggaaaataaatgagagttaatgtttacaatatactacccctctgtttcaggttataagacgttttaactttggttaaagtcaaattgctttaagtttaactaaatttgtagaaaaaagtagtaacattttcaacccaaaacaaagttattatgaaatatatttaattatttatttgatgaaattaatttagtattataaatactactatacttgtttataaacttagtcaaacttataaccttaaacggaaggagtagaacggaatctaattatagtattgttatggctactcatgtggatccactgcgagtagattcctagctcgatcgcggcattactgtgtttgagctgtgcgagagatcgatcggcaagttgcgagtttaaaacatgctcgtgtacgcgcgtacgaagaacggtacgttcgtaggcacggccacgcacgtacgtttgtccacacgtgggaaggaaaacaccgtgcccgatcggatccgtcgcgccacggactgacacgtgtgcgtcacgtgggcccggggtccacgtgggcgccttccctgtccatcgcggtgggtgcaccaaacatgtgttttcccatttcctactttaagattcggactccaaccgttagctgtgcatgacgtagctgattagtaaattcgagagtttttgatacgtagactcactgggccgccattagacgttagtgaaatccgagcccagacttgtgcagttttgtttcttaagatcactttgactccctcaactgacgaccgaatctaaatcgtatccctcaaccgcaatgccagaaatctcgacccccgaacttgtaaatccagtgcaatttgactcccttgccggttttgggaggtggtttcgctgacgtggcgccacgtggcgcttatgtggcgatattgaccgagtctttggtccacgtgtcgttgacgtggcacttacgtggcaatagaattaaaaaatatgcgtgggacccattagtcattggcacaaaaagaaatgtgggcccactgacatgtggggcccacatgtcagacctcttcctcctccctatctcccttctctctctttctctccccttcttcccattcggccgatgggcaggaaggcggcgagagcgagctggcggcatcggggcgtatcggaaccgaaccgggggcggcggttggcggctaggacggcggcggctcggccgcggtggctcacggcagacggaaacggcgacagcgggagggaagtggggatggaggcggcgaggagggagttggccggccaacacgttgtcgccgccgccgccgccgttgtccttccggccgttgctcttccgcgaggccgtccccaacgagccgccgctccagccgtcctcccccgttccagcgccatggcaagcgacgaaaaccggcggcgcggcgcccccacccgaagctgccgacgacgatgaggccgagcggtgcggagtcgtcggcgccgccgctcccatccgcagccgcgctcgcctgctgctgccgctgcctctcgccatcgcgctcgcccaactcccttgccgccgtcggcctactcccgcctgttgccgtccactcctcaaccgcgtctccgctgcttccatagccaccgccgcagcgggctcgccttcgccgccacgtgtcgtcttacctcacgcggctgtcgccgtgctccgggagccccgccatgggcgtcgtcctgctcgtgtgcgtccatggccgccgccgctccggttacgctgcgccccgatgccgccgccgctctcttcgtccgtgcgccgtcgcgatcatcagtggaccccagcggtgcgccgccgcctccccaccgaggccgagccgggccggccgctcgctctcgccgccctcccgcccgccgccgaatgggaagaaggggagagattgagagaaagagagagaagggagatagggaggaggaagaggacagacatgtgggccccacatgtcagtggcccacatttctttttgtgccaatgactaatgggtcccacgcatattttttaatcctactgccacgtaagtgccacatcaacgccacgtggaccgaagactcggtcaatatcgccacataggcgccacgtcggcgaaaccacctcccaaaaccggcgagggagtcaaattgcaccggttttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaag

SEQ ID NO: 57479 - DNA, 12480 bp, Oryza sativa
ctcattattaagcttactgttttgtttcatgttcatagggtgtgctcccggacggctacgagatagcagtgaagagactgtcgaagagctcaacgcaaggggtggaagaactgaagaacgagctggctctggttgcgaagctgaagcacaagaaccttgtcagcctcgtcggcgtctgcttggagcaacaggagcggctgctcgtatacgagtttgttccaaaccggagcctcgacctgatccttttcggtacaaactaagccatgtttaacctcagttttcctctgtttcttatgcaaagattggtaccatccattaacctgatcttttctgtgtgatcaatgtcagatactgagaaaagtgagcagctggactgggagaagaggtacaagatcataaacgggatcgctagaggtctgcaatacctccacgaagattctcagctcaaggtagtccaccgcgatctcaaggcgagcaacatcttgctagacgtgaatatgaaccccaagatttcagactttggcctcgcgagaattttcggtcgagatcagacccaggctgtcaccaagaatgtcatcggcacatagtaagtctatctaaactagcacatataatataattcatatttctagctatcatctagtagcaatttgctgactgtaaaattaccgtgctgttccagtggatacatggctcctgagtacctgacacgtgggaactactctgtcaagtcagacgtattcagcttcggcgtcatggtccttgaaatcgtgacaggtaggaagaacaaccacagctacaactcccaacaatctgaagatctcttgaccatggtgagttatctgaatatcttatcaccatcatccttgatccttctcgagagaagcacatcgagttgcattttgactcatgggttttactgcaaaaatggtgcagatctgggagcaatgggtggccgggacggtgctggagatggtcgatccgagcatgaacagcttcttctcggagagcgacgtgatgagatgcatccacattgggctcctctgcgtgcagggtgacccggcgaaccggccggtgatgtcgtcggtggtgctgatgctcggcacggacaccgtcgaactccatgcccccgcgaagccgacgctcttcgccaggaaaggcggcggcgacgaatccggcgtcgcgtccggcggcatgtcaatcgtgtcattggaggagcagtcgtagagacggtagtccagtgttgcttattatcagagcggtagagccagaggcctgaagaggccagtgcagaatcctacgagagaagattgtgctacactgtgctaccgtacccatgtgtagcggcaatttagaaatggctgccagatcttcatcggagtgatcatgaaaagatcaagcgataatgaaattgtgtcaaattacgatcaatatgagagtaaactttagatctttttcaactgatggcgaaatgataaacgaaattgtgtcttttcgctttaactgaaactacatctacttattacataagttattggctaaaaaaaccaagtacgacataatgaaagaaaaatgatgatgagcatatgacataacgacaccaataaaaggaaataattaacttattcaaagtttaagtctattgctaaatcttcatctaaaattgagacgattgactctaaattttggaatgcagcgggtaaaacttccgtgttctcgtcacacatttatagttggcccacaacagacggtaaattaattccagaagtttaaattgaagcaagcaaaaactttgagcttattcatattaaacttgcaatcttctatgttatacaagtttacactacacctacacttggatattttttaagacaatactacatacattttgctagtgtgtagttgagttcttatagaaagtcaagcccattggtttcttttggttttgcgcaagcgggttgtgggcattatctccttatcctggctccatggaagatgtgattggagcttcttccggtgttagcttccagtggcttcgtctttcatgctggtgactaaggagtactccagatccacttgtgaggaggtcgtgccgatcgtcatctacatctccggtgagtaaagttgtaagattagttaggttgcgcctgttgccattctttttttcgaacggtcaggccgttgccaacgttttatattaagaagatatcctattttaaggagaaaacatgatcaaaccttacagtgctcttacagtgctcagttaattagggaaaattgagcgaaaaccacaactacaacaccacaccaacagctaacctatcctaagttaccatgacagagttcgacacacggcatcaaacaagcttgccatttgagatgacactgcagcctacacatgttatcgttgccaagcttgccacccaagcgacacaacagcttcaacttcattgcgatgctaccccaacggcaaaataaacaaacagaaacgacatccacgaaggacatcatcccaagctaccaaggaaccactcctacacacagctagcatcaacaatccaataaagaaattgcaatgtgtcatcgttgccaagctttgtcgccccagcaaagcagctccgactctacccacaacagtaaccagataagagtgatgaacacccaatgtagcaaggaacgaagccaaggtagtgaaggcctcgtcaaacaccctaggctggaagagcttcggagacattgcaggagtccaccaaaagctaccgttgtgcgcagagggttcttggtgttatgaggggtcaatgccaggacgacgcctccaaggaggggaacggcgccaaatggcgtcaccgtcgtcatgccagcccatggccatggcaaggctttcgccagtgatcccctatcaaaaccccacacaaccatcctgcacaacgacaatcaccggaccaccacgccatcccttcaacgcccaagctcagtctaccaccccgcaggtcaagctggcaatagagaggacaaattcttcactgcctaaccgcttcctgcgtgctgccgtaagccactgaggtcaccattggcggccagccaccaccgctgacaacccggtcaccaccactggcttcctcctcgtgcagcacctccaccgcctcacgccgcctgccatcgggccatggctgcgtgtgcggccaacaccacctcgcactggccgccggcctcgccttcctcctacgtgccatcccaagcaccgccgggcgggggcacgaggcagagcaggagccggcgccgtcgccgcagcggccccaacccacgccgaccggggcacacgcatcgcacctttcaccgcccgattcacctccgtcgcgccgcccaccgcgccggtcgaatgtgctggttggccgggaggccagatccggccacagaggcaccggatccaccgccccaagctgaactgcagtctccacctccggccgtgccatcgtcggccttctccgtcctcctcgcgctggggtcagttcttccgagctgtttgggcctcgccgccgccttcctggctcgccgccggccagctccggcagcagtgaggtggaggaggggaatgagggtgtggcggcgtggcggctagggttttgcccccgagccgcccgcacgagagagacgcggggacactttgaccgtgtactttaacttgaaactggatatcgcttgttgccatccttatctctagcaagtaaattttgcaaggttttagtccatcgttgtgaaccttcaacaataggagaagttgtgggagaatgccagcgataggtcaaccgtcgggggggagcaaaaatcggacgctcccctcccccacatgcgcgtgatacgtgacgcctgggccctaccacggtctctgaccccacctgtcacgtgtctgcaccaaaaatatttcaccttgtttactcacaatatttcactatgtatagatctaatgttgctgtgaattaaaacattcttttgcaacaaatcacccacatattttggaaactctctattaagggaattcgtttcattttttgtttcacaaaaaatgtttcacctagtgtactcacaatgtacatagatctaatgttgcaatgaattgaaacattcttttgcaacaaatcactcacatattttggaaaccctctatgaagggaattcgtttcattttttggtctaccaaaaatgtttcacttagtgtatttataatgtttcactatgtatggatcaaatgttgcagtgaattgaaacattcttttgctatttgctgaaacattgtttttatataaggtgaaacaacacccgatttaaacgattgaaacatttccgatctacttagtgaaacaattccgatatacctagtggaacatcgtgcaacatttaaaaataattcaataataagctaaatgttttttttgttggaatatatctatgtgtggtcttgttttgaagatttaactgcaacgaatctaatgatgcaatcggatcatgatttggataaataatttaagagaataaatagtttaaagtgtttttacacgtatgcgtcgtgctgatgtcagcgcctgatttccccaaatcatcgggtgattttcccaaatcatcgggtgtccgattctaaggtggtgtttagatctagggacttaactttagtctctatatttaaacactaatttagagtaataaatatagactacttacaaaactaattatataaatgaaagctaatttgcgagacaaattttttaagcctaattaatccataattagagaatgtttactgtagcatcacatagtctaatcatggattaattaggctcaatagattcgtctcgcgaattagtccaagattatagatatgttttattaatagtctacgtttaatatttataattaattttcaaacatctaatgtgatagggacttaaaagttttagtcccatccaaatagggtctaagtttcttccttcgctgtgttctgtccgatttaccatggatgcctcaacttccattcagtggagacctcgttcgggttttctccttggctctaccttcaataggttgccatgaatttgtcgtctccaccgccgtcgatgtagtcgcatcggctgtctagtggatgaagtagataaaggacttgattgctaattccttttagcatattttgtctatgcccagctttgatgaggggtttctccgtaaaactggatgcgctcccagtttgttgtcatcaatctattaattaatttattaatttgcccatcttttagctcacttgctttcttctgtgttttttcaataatgtgtcgtggtcagtaccggcggctgcaggaaaggtaaccattaattatgatttggcaaggtcatatgcatgcatgcgtgctgacctgccacacgggtgttgcttatcctgtgactcgttaatgacaaggacgtgccccaaatggctttgcaaattattgctttccttttcgccactacgcgagtacgccagggtaaaaaaacatacgtaggcagtgttccttacattaggttggaactaatctttcaaacacgtgaaacgggacagtgaattaacgtacaattagttaagtattagtttagaaaactttaaaaaatagttaatataatttttgaaagcaaattttctattgaaattattttctactttctccgtttcataatgtaagtcattctagcactttttattttccacataaatattttttattgaaattattgatgttaatggatttagatataaatgttagaatgtctcagattgtgaaacggaggagagagtagaagacataccgtttggtggttcaggaaatgggtgcgctaaaatgagagagcagaggttggaagacagaacaaacaacatagccgtagtgtgatttgcagtatggtggacaagatttcagtactactaagtaaactgtgcagccggccagtcatgtttgactccaatttcgagctcaaacctgacggaatctgccatttgacaagcgatgtgttgcaattcgcacagagttgacagttgatggcgcaaggctgctcacatgaggccattttttatttttttgggcgtaaataatgccgttagttgagggaaagaatcactacccgcatcttctgccacgatgctcgccgccggctatggcgtcctcgccgtcgccgccgccgtcgtcctcacgctgccctcggccgtgcgtgccgcgccctcgaacatctgcgacatgggcgtcgcgacgtacgctgccaacagcacgttcgaggcgaacctggaccgcctcggcgcggagctccccgccaacgtctccgcggcgcgcgccaccggcggctacgcggtcgccaccgtcggcgcggcgcccgacctggtctacgcgctcgcgctctgccgcggcgacgtgaacgcctcggcctgcggcgcgtgcgtcgcggcggcgttcgccgacgggaagcggagctgccccgggatcaagggcgccaccgtctccgggcccggggacggctgcgtgctccgctactccggccagagcttcatgaatttcctcagcaccgagcaatggcaggtctcagagatactgtacggacaccatctatatcccattcccaccattgtttcttccaagcatattatcattggtagaattaatcactaatcagagaaactaatcactactagctcgttacaaacagttggtatcccgaccatgccacggacagcatcaaggtgccggacgttggctggttcaacgccgccgtcgcgaagatcctcgccgccctggtcgagcacacttgggccacgacgacgagcaacgcgaccgccaagaagtatttctccacgggtgaggaggaattcaaccccaagatctacggattcgtgcagtgcgtgccggacttgtcgccggagcagtgcaaggaatgcgttaggacgctccacgatcaggcgaaaatccactacatgggcaacagccttccgtgggctagtacttattcggtgtggtgcagtctgatgtatagcgttcggccgttcttcggtggccgggcgatgctgcagctctcgccgccgctgccgccggcggtcgatactccggttggtactcatgagcctggagcaggttcgactttatacttcgggttttttttttttttagagttccaacttctaaatttagctttagaagttaggtttagagtagagttgtggagcggtctaaacttagttttacctctctattttactttgtgagaacattccacccagctcccctcctattttaggtggagctgacacagccaaacaggcccttcttgtttttccatgaaaattatttgtcctaattcattgaagttcatgatttggtttctgcagggaagaaaaagagcgtagcaggactcgctgcaggcctcgcttgttcagttggggtactcttgatcctttcagttcttgtgttcgttcgtttcaggagaaggaccaaggctgccgagactgaccaccgtgagtagcattagcatatagtctctgttcagtagctgaaatttgctgttacctgatatgatcttgtcaaatgtcaacagctttaaagaagataacgagagcacagtgcatgatttttgatctgcctacactgcaagaggcgaccgagaacttctcggagaacaataagcttggtgagggtggttttggtactgtatacaaggtaagttagcttgtaaaattacaagacaacagtttgaaatgtactgtgaactagtaatctgtagagtatttgtctgaaaatcaatgtgttcagggagtactctcagatggacaagaagttgcagtgaagaaacttttaggaacaactgggcatggattggatcaactacataacgaggtcctgctattggcagagcttcagcacaagaaccttgttaggctacagggattttgcttgcatcaagagcagacactgctggtttacgaatacatcaagaacgggagcctggacaacattctattcggtaattttccttcccaatcaacgcttcagaaacacaccgataactctgatttttgaatagaatttttcagaaacattctgttcggtaattgtcttgggaaacattctagtatttggtaattttacttcatgccaagtatgtaaaacaaaaaatagaataaattgagcaatgcacatcttcaaattagtgtgaagtactgaatatgtactgtactgtactgtaccatttctggcaaacaagttaaaaagctaagaacaagatgtgcatccacttccttaactctactatagatgcgcgattatgattaagttgcgctattttgtccttatagataccaccaaaggaaattcactcaattgggagcaacagtacaacatcattcttggaattgctaagggtatactgtatcttcacgaggattcaagcttgaggatcattcaccgtgatctgaaatcaaataacattctacttggtgaggacatggaaccaaaaattgcagattttggattggcaaggctgctaggagaaggtcatactcattctaggacaaccagagttgttggaacattgtaagctcgtgcattataaagccttcattgatggtaaatattgatatatctatgtttccaagcctaatggttatatatattttttttgcagcggttatatggcacccgagtacgtagcagacggaaatgtgtcaaccaagatagacatttttagctttggtgtgttggtccttgaaattgtgatgaggagaaggaactccgattctggtgatcatgataatgtgaatctcctgactgatgtaagtgcttaacaatactgacctttctccggtatgcatttgtatacaatgtttaagtttcagaccggtaatcggtctatttcatataacaaactaacatcaacgtgtctaataggtctggaatagctggacaaaagggacaatttcacaattcattgaccaatcgcttgatgggtactctcgaagccaagccatgcgatgcatccacattgggctattgtgtgtccagccggaccctggtgagaggcctcatatatcatctgtcattttcatgttaaccagggaaaacatggagcttcagccaccagcacaacctgcattcttctttgggacagaatcggcttcctcttctacatcatgtgggcaacgcagctatgtgtatgaccgctatggttttgctagcgtttctgtaaatgatgttacactcaccgagccatatcctagatgactggtcttactaggaggtcacaatgcgaatgggtaaaagtcagagtaccgtactgtgtccatacacacgtcttaactttgtccaaggaatctaatattgtcgcgaaaaggtggggataatctccagttgctcggagcgtaacactaatgagtgggccctgtagacatcttcccccgccttgtcactaaccacgagacacgtgtctgggtaaaagacagtggaacgacatccagctacgctcaaccccgtcagctcctccagtgggcccagtaaagtcctgtaaaggccccaccggcggtcagcatgcaatgggattaaccatacctaattcctgtttgtatgccccctcctacaagagggatggcaaccagaggcggagttaggattatgtgaagagtagggcctaatcattagagtatgaacttcttgaacgaattttaataggaaaattagtaaattccttggtattttttttgccaggtgtggggcccaagcccaagctgccccacacctggctccgcccctgatggcaactatgtattccccccagactataaggggagggctaaagccattgtaaacggggatcacattctgaaaatctactaagttcagaaactctcatcatctctagaatagataaacccaattctttataaacattgcaacaagggatctagacaaacacataggagtagggtgttacggttctgagtggcccaaacctgtataagcccctcgactcttgattgattcccaaactcttttgtaaacattgcagtaatggatctagtcaaacccacaggagtagggtattactcttccgagcggctagagcctgtataaacccctggactcttgtttgattctcgcgttcctaacctcagatccacacactagcactttgtccgaatcacaaaggagtgcctttcctccccgccagaggagctcgggctccgacaagtatgatacaaccttgatcaaataaagagccattagtttggttcttaaacctaagtggattggaacaaccatatcgattaataaacattagcaaaccaaatattgggagaatgaaaaaaaggtaagagagaaggcattgagagagtagagagctaccaataagaccaagtgtatatgcgaaaggggttgtactctaggcattagttacggtgctcaagtagcacctccaactctccaagggagcgaattccaatcttaaataaaagaaaaaaaatattatggggtttccctcgctgtttccaataaaaagaaaaagaccaatgtgttatcatctagaatgatgtttccattatactcagtttaaataatatgtagtccgttgcatgaatgataattattgtcaataatgaatttcaggcttaaataaaagaaaacaaatattgtggggtctccctcgccttttccggtaaaaaaaagagaccaatccgttagcatcttgaaagagtacctcagcactagtgccgcaaccgttgaatattctctagaatggcacaattgcttacctgtatcggtgactgactgagtgtgcataagggaaaatgatgataaccacagcacatcggcctcggccacaataggttgtgctgatcaagcgaaatgggtagctccaaaatgaaaagcaaatcctatcaaatgcatgggccatttattccatgatagaacttgatgaattatttttaatgtaattcctcaaaatgttattgaaagatattggaaggtagtaaggtggtgtttacatccagggacttaacttaagtccctgtctttagacactaatttagactattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgagttttattaatagtctacatttaatatttataattaattttcaaacatccgatatgatagggacttaaaagttttagtcccatctaaacagggcctaaggtaacaaattttacataataaattttggtgtctctttatgactcttaatgaacgtaaaccacccatacagatctgatgcatgaaaatgccttggatacatgagtgcgggtgaattacatgtttctcatatgccgaaggagtttgatgtacaatatgtctctggaatgtgtatttgcggtatttccttcaacaggggtgaactatttatttaaaattccctacatgaaataaaattaatgttacccttatttttctttgcagaataatgtggactacaggagttattctttgattcatcctcattgcccagctgcttccggtttattacagtttgttctgttcaagtgttgtttggtgggagcaagcagtttccaatctatgtaaactattgaacaaacaccaataaggtaaccatttaccatttgagacaaaagattgcaatttttcttagagaaattctatattattagaggtgggagacattaattaaatatactaaatttgaaatgagcatggactcacttggttgctatttgacaatagtagcggtgtgtcacggcccgaactagacccgaccggaactagcccgtgacgctccaaattaacctgttattcgataccagtcccaggaaacagtgctggtatcacagggagacagaatattacagcaacagaggtatctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctagaagaactcctcatcagccggttccgcttcatcttcttcagcaactgggggggattatttatatagagcaagggtgagtacgggagtactcagcaagccatgggaaataggtgtttaatgcaggcttcaaggaaaggctgttgtttttgcaattgatttttatttggacccttttctaaaaacaactaagtgagtgcttctcaaacgacgcggatgagacagtgcgtctcgtccggtcggagtatgtgcaatgtatcagtctttaga

SEQ ID NO: 57480 - DNA, 528 bp, Oryza sativa
ttgaaaataaaaaataaaaacatcgaaagaacacaatacggtattaactaaattttttttaaaaaattctgaaattagaaaaaaaaagattttaattaggaatgcaatttataaataactaaaatttgtgataaaaataaagattattgaaataaaagactatctaaaacacgtgacgagataaattaagtaacatgcctataaagaagtagagtggaggcggttgatacgacatataaaaattgttaataaaacaccaaatagaatcctaatgacgattaaaaggaggaacatcaggtaggccgtgaatcaaacgagtaaggcggttgtcgagacttctataaagtaaaaaaaaaacacattgatcatcatattcgatttttaaaatctcagtgacaataaaaaggagaagcagcgggcagggtgtataagagtatagttgcagagcccgcgacggttgacaggacttctagaaaataaaaaaatgaatttcaataataggtatgtttgatttttagaatcataatg

SEQ ID NO: 57481 - DNA, 7519 bp, Oryza sativa
acgggcctcctcaacgccacggccaggtacgcgcgcgggcaacaccaacgcgtcgtccaggctgttcgcgacgggggtgatggtcgggttcgacgcccagttccccaagatctacgccatggcgcagtgctcgccggacctgtcgccggcgcagtgcgggctgtgcctcggcgccatggtggcgcggtggtggcagacgttcgagcccaacacgcagggcgccaggagcgtcggcgcgcgctgcaacatgcgggtcgagctgtactcgttgacaacgtcccttccatgctgcagctgcaagccgaggccgtcgcgccgtcgccatcgccggcgccggcgccggcagggaagccacctgctgtgccgggcactacaggaggtgagcttagctgactttactactatgcatattaattaggagtactctgcttccatcttttgttccctgaaaattattgtacctagtgtgatgctggacgtatgatagcttaactaatgccattataattttgcaaagtttgagatataccatcggtatctcaatgacatgtaggatccacatgagtcaatgacatgtgggtcaggacggcatggttttaattttgcaaaattataatggcatggtttcaattttcccttttaggttaagtacagttcagaattttcatcacgccaactaatccatagtttaagcaagaaacgtccgaatttctcttggtattaactagatgaatgcctagattttccatgattcgatccagacctgttgctgtcatgctagttagcgtatagttcactactattccgtactagtgtatactagtactcctatcatacagttgactaagtctactttttccaccgactaatttcttagagacatttttatttagggaatataatatcgaaatcaacctaatccacaagacaaaattgtgcaatatgatactagtaatacgtgtggtttctctgtatgtgattcaattatctgtcagtcgcctaactttcagttgtttgatcagctagtagttaagtgaatgcacggaaaaaaaaaggcactctcttcttactctgaaaatttacaccatcttttctgagaagaatcttgtgtcatgtatttttctgtttgtttgggaacagttgtctatcttttcgtcttctgcttactgttctagattcagtaactgcaggcagcaccacatgtgcaatggcaatctagaagctatgacttgtagtcatgtttatatatggggatataaacacaggcatacagctgttaccaactttagattgtcaaattggtagtttgtagtttcgactagatattgttattaacattagttagtttatgcatttcactcaagcaatgggagttagagtggagcactagtcaagaaaagctaacagtgagtgttatgaccataatgcataacattgataggccataatgcataacattgataggccagtgccaaactgccaatgtgatatcatgattcattacctatctggaatgccattttagacccaaaataaaaataggcgtgcaataatgatcttgcagaatgctgggttagcttatctgaaaggctatccttgctagttgcttactgttcaacaccaaatggcagtttttacacaaaatttgagttttcggaggcaaatatttcacacaatctctatcacatggaaaatttcaaagaatctgcaatcgctatcttacttttcaagtgtgaactcatcatcagttcctcctggtttgctttctgctaaccgtgtcttgagaatctttcaccacaaccatactacttttttcccatgtgtaatacggagtataatctacagggaaaaggagaaacggagcaggtaaagttcttgcaattgtaatgcctatagttgctgccatactggcagtcactgtaattggcttttgtttctggaggaggagaagaccagaaaaaacacctccaccaggaccgctccgatgtgagtcccctgaagtctgagcacttaaaatcatgtggtaacaaattaaatgattcatttgttctgtgttcactttataattgatctatgccagccgcatctcgttcggaggactttgagagtattgagtcactttttcttgatctatcaacactccgaatcgcaacagataacttctccgaaaataacaaacttggtgaaggaggatttggtgttgtttataaggtattgataggcttctagcatctttatcgcaacaaaagtaagtagaacctgcgccagataacaggtatatatattcatttgtgcagggatccctaccacatggtgaagagatagcagtaaagaggctctcacaaagctctgtgcaaggaatgggggagctgaaaaatgagctggttttggttgccaagctccagcacaagaatcttgtccgtttggtcggtgtttgtctagaagagcatgagaggatgcttgtctatgaatacatgcccaatagaagcttggataccattctttttggtgcatttcccctccgtgcattctaaaaatttgtcaacattaatttgcacaagtaattcatgtcccctgatgcttctcattttcatgagacagatgctgagaaaagcagtctgctagactggggaagaaggctgaaaataataaacggagtcgctcgaggaatgcagtatctccatgaagattcccagctgaagatcgttcatcgggaccttaaggcaagcaatgttcttctagactctgattacaaccccaagatttcagacttcggcttggcaaggctcttcggaggcgaccaaacacaggacgtcacaaatcgcgttgtcgggacatagtaagcacatccagtcatccatcaacacccatgacagacagatcaaagattgtgcatcagatatcgtcaaagttaaccatgttcttaatttatctgcagtggatacatggcgccagagtacgcgatgcgtgggcactactccgttaagtcagacgtgttcagcttcggcgtcctggtcctggagatcgtcacggggaggaggaacagcggctcctactacagcgagcaatccggcgatctcctaagcattgtgagcaccaccaacttcttagctcaattgagcaaaaccaacattacatttctcgcagtgacaattcagttaaaaaaatggtgatctctgacgacgatgcagatatgggagcactggaccatgggaaccatcatggagatggtggaccggtccatgggcgagcgcgcggcgggcggcgagatcgcgaggtgcatccacgtcgggctgctctgcgtgcaggagaacccggcgagcaggccggccatgtcggcggtgaacgtgatgctgagcagcggcacggtgtcgctcaaggcaccgtccaggccggcgttctacatccggaagggcggcggcgacgacggcggcggcacggggtcgtactcggggtcgttcgtcggcaccttgccgtcgtccggcaggtcggcgcccatgtcgcccaacgaggtgtccatcactgagctcgagccgagataaggaagaaaaatgtagcagagccatgtcatgtcacaggagtgaagggctccggggatgcctaatttgtgattttgtgtgctgtgatggtgtcctcaagatgctacaatgtatagaaacaggcagtaatcgttggcaagaacaaaatgccagcaaaacagtatagcactttagtgttgtcttttaactcttatggcgaattatgctgagataattgcatgatttgcaggtgttcattacaaatatattaccctcgtttcatattataagtagtcttgacatttttcttactttaactttttcaaatttaactaagtttataaaacaaaattaacatctacaacaacaaatcagttttattaacatgtaatatatttttgtagtatgtttgttttatgttgaaaatattgttatatttttctataaatttaatcaaactaaaaaatgttgattagttaaaaaggtcaacttatataatattgaaatgaatagagtagtgtactcactggtacatgatttatgtggttgaacatattcgagcccacatgtctacgtatgccaaatgctcaactcaacaggtaaatcaagatacataggaggaggtaaataaatcatagtgcactggaggaggatctaccttgcaggacattgccagatattcctagggggaatgggaataggtgttatgtggatgctgcttgggtgaatggtttagcacaatatttttccacatgccaaactctcataatgcgctctttataaaagctagtactatcttgatagctcaatcttctttgtaggcagaattactggctctgatggcaatggagatcgcaaaatttcttgactttgcaggtaccatctttaacaataagaaacttcgatgctgaaccatgacattggagtctcagacggtcagaccctgaaagtttgatgcaagtcaaatggattatcaacagacaacagggtagccgacaagatagccaaggatggtagacatgaacaatcttctgatacggttcatattttgtcaaaatatgttgcatatttaaagtttttttttttttaaaaaaagaggccacatgtctacagtgaacagtgcgtcagactggcagtgcagatagcaattacctttctttaatcctcctgttaatcacagattctatagttttaatccatcgcccatttgacatcagatcatccctgtgctgtgtgctcgatccagatctcccgccggtagccaccgcgcgtggtcgccgcggcggcatcggcatggcgtccgagctgcgcgccctcgccgcggtctcggccgccgcggccgcggccatggcgtacgcgcgcttcgccaccgcgcgcctggccccgggcgtcccgcgcctcgccgcgctcctcccggtgctcgccctcctcccgttcctccccttcgccttcgcctccatccacctccgcaccatctccgccttctccctcgtctggctctgcgccttcaagctcctcctcctcgccgcgggacgcgggccgctccacccgtcgctcccgctcgtccgcttcgccgcctgcgccgcgctgcccatcaaggtcgtggacgacgagaagcggaaacccaccacctccacctcctcctcctcccggcgtctcgctccggcgttcgtgctgtcctacgcggccaaggcggccgtcttcgcggcgctcgtctcggccaggtgctaccgggaggggatgccggcgtacgcggtggtggcgttcgacggcgcgcacgtctacctgatgctggagctcttcctggcgtccgccgcggcgaccgcgcgcgtggtgctcggcgcggagctggagccgcagttcgaccggccctacctcgccacgtcgctcgccgacttctgggggcggaggtggaacctcatggtccccgccgtgctccgcccgagcgtgtacctccccgtgcgcgcccgccacggcgccgcggcgggcgtggccgcggcgttcctcgtgtcggggctcatgcacgaggtgctgttctactacatcaccctcgacccgggctgcaccacgggcgaggtgaccgcgttcttcgcgctccacggcgcgtgcgtggtggcggagcggtggtggctggaagaagctcgtcgtcgcgcgtggaggtggagggcgccgcggcgggcggtggcgacggcgatgacgctggcgttcgtgacggggacggggtcgtggctgttcttcgcgccggtgacgcggagcgggctggacaaggccatcgtggcggagtgcgaggggttcatggccttcttggaagaggccgggtggaaggcggccgccgcggcccgtttgcttccgtcgtgaaggcccatgttgtaaccgagcagctgttcgtgggctgttcagctgattcatgttgtaacggcccatgtcaagtctttccctttgtattgtggcccgcggcctaactcgattcacggccaatccaaaacaggttaagaagcagtccaactcgcaatgagagaagtgacgagatggatcaaacagttgcggaataagtgcacttaccatccctcatctttacgtagagtttgtttgatatcccttaactctaataccaaaaatcttcacccctaaactatacaaaaccgtgtaatttggtcccatagcagtatgaatgtttagtttcacagacgtgacatcctagtcagcaaaaataaaaaaaaaatgtggggcttgcttgtcaggtcccttttgttccttctcttttattcccaagagagggaggcgaccgacgagagagtgggggagaggctggcgagcctaggagggaggggggagacggccgactcacccttccgagctcgccgacctccttgcaagggaggtagaggcgagagagggaggggaggcggctgacgaaaacggctgggctcctgccatcccgcgtcgcttgcagatgcctcatgctgctctgtcctcgtcgattgaatctgttgctgcagattcatgttgctggccggagtgtggagtcaacgcaacgcgacggctccagtctcatgggtgcggcattggctagagaggggaagggcggagcctggtatcaccgagctcgagcggtagcctcgactcctctctcctgagtagcacgggtggcgggagagacgacgatagcggcggtcggcagtgtggacttgccatcatccacctcgaccttgtggtggcgccatcctcaccctcagtttccccacacccgcacgttccaacgacccctttccttgccctcatctttgatgctgctggccgccgtcctcatcgtccgcctccccgcacctcgccttgacctcgttggtcacaccttccttggcgtccacctccccgtgcgccgccttgacctcgccagccgcgccgtcctcggcgtctgcctcccgccttgatctcgccggtcgcgcctttgtcggccttcacctccttgtggtagaatggctgcgggtggaatggctggtagagttggtcggatgatgtggaggggcgggggcaaaggggagcttgtcaggtgcgggaagcgataacggcagcagtggtgcagggcgaaggggatgttctggcggtggtggtgcaaggccgcagtggtggaggcgatgcggggctgggatgaggggcaccatgcctgacaagtaggcccggagatctgttatgccagcaaaaacaaggtaaagtaggatttatattgctatgggacctaagttgcatggttttgaatacttaagcggtcaatatttccggtattgagaattagggatttcaaacaaactcgacgtaaagttgagggatggcaagtagacttattccaacagttgcatgttggtgcccatttgccaaattccagccgaatggctttcctaaaaaaaaaaggttcgcagtgtgttaggaacaaaaacgaatttcaaatcttctttttcacatcgccactgttgtgtcactcaagtagacaaggatattgagaa

SEQ ID NO: 57482 - DNA, 691 bp, Oryza sativa
  unsure (1)..(691): unsure at all n locations
tatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataacttctgtcgtatcaccagtaatgaaaaccacaagccctttagtgttgtactgttgttgtatactccatccgtttcgaaatgtttgatgccgttgactntntannacatgtnttgttctttgttttatttaaaatatttaantaattattaattctttttctatcatttgatttaatactcaaaatatttttatgtaagcatataacatcacatatttcacaacagactttgaataaaacaaacgttaaacatttgctcaaaaggaaaccgcgtaaatctttgtgaacggattgagtattctaactgggtcgcactagagcggcttgtgttaaaatatctggctttttgtcgaagttttttagagaggtcttccaataaaatttgtgtaagtttggtaaacagcgccttgaactgaagaggcg

SEQ ID NO: 57483 - DNA, 691 bp, Oryza sativa
cagcaatggaggcctggtaaacgaagtagtcggcgagggatacagtaaacctgttacctctgccgaggatgaggcggatgaggaggaggtcatcgtgtgcggcgatgatctggggctccatggcgtagtcatcggatgcaggattgagggtgggagagtggacgcacacgtaggagacgagctgcggctgggcggcggtgcacagggtcacctggatttcatggccctcccttgttttggaagtagcagtggtggcgttgcggacgtcggcgccggcgaagtaggcgagcttgtcgaggagtacccatcttggcctgcgccgcgtccccttgtcgacggaccggccgtggaaaggaggacacagggaagcgtccatgacgcccatttgcgccatgatctgatcctctcctggttttcaacgcagcagccgactggatctatatatactataataaatagaagaacagaccttcaatcgcaatcggaatcgactccgacggcgtatcggtatcggaggccgcccgccgaggccgaggaggaaggggaaagaagagcaatgtggcggctgggggctcgccgctactcatcactaactagggtttccttctcttctcactctaccgtggccttggtgcatgggcctgaattccggcccatgcaccctggtggatccaaaccagcgaggcccagt

SEQ ID NO: 57484 - DNA, 1145 bp, Oryza sativa
aataagagtttgtatagcttggctgggtgttattattgtatttcagaactataatttatgccattatctgcccacattttcagcggtgatttgtgtgggaagggtaaattaatattctatagttgctataaattagttcttggcaccttttgttatctaaaagacggttttatcgggtgcaggtaaaaagagaaaacagaaacagcctgggatgttgctgggatcctcaagcaaaaggaagtccgaaactccctatttgacaaatgtggtgctgccactgccaacgaggcacggtgtgcaaaaacaaccggatgcggaaggaggtagcatggaagctgaattttcagataatatgttattataataagctgggatatgagtaatagtggtaattatcatattttattgatatagtgtgatcccgtatcaagactatgatccctcggttattctctcctatgtcgtgcttgtatgtgtaagggacgacctgaatgaactcagttcagacatttttctgtcctatctatgtggtacacttgttttatcactctgctgagtatgttctatctctgagccagttcccactaaactgcctcccttatcccttcttttcaaagccgtagaccacggcaacccctcgacaacggcaattagttaacctataataaatacttttttgtaactaggagagcaaagctgagaattatacccttcgtcctaaaagaactcaacctaggaagcacccttcatccttaaaagaaactcaacccaaccaagaaagggatgtaacctctcacaaagctgtgttcgctacatcgctaggggaggataggaacaaatctcctacgcacggaaaacggagcagtccattaacgcgcgattaattaagtatttgctaatttttttaaaaaagtggattaatatgatttttaagcaactttcttatagaaatattttgtaaaaaaatacattgtttagcagtttggaaagcgtgcgcgcggaaaacgagagaggtgttaggaaaaggggcatccgaacgtagcctaggactatgaatctagactgtcttttgtctagattctttgtccagatttttttttttggcagagggagtaagtcttgctacttatcagcaaattgccttg

SEQ ID NO: 57485 - DNA, 1953 bp, Oryza sativa
ataatagccccgatagcacaagccatcgagacgggttacctcttgtcgagataactcactgaaaagaacaaaaagggtggtgatgcgccgaagttgtattggattgtctcccgtattaaagtggtatggggttcatatttataccccgaggacaaaattgggtccattatggacacgacttaaactttcccaaagataaaataaaacaagaccatacggcggtctattaccaatctctatcaaacctactcaaatatcctaattaatcgatacaattgtcataatcgagctctatctctaattggcgatgacagttattccaacccaggctcatgccaagcccaactcatagcatatcggcacaatcagccacttgcgttatcggcttgaccaaactcaactttgtttctagccgatatgatacccagccgatacgctacccgacttcaaaaccgactcgatcttgctccttcttctccgagtctgatgcaaaattccgttgttaacactagcattgaaaatggatatccaatgtgcgtataaaaccatccctaagcttctgattatcctcctcctacatgggtgtatgagtggcaagagccccagtggtatcctcaattgtacggtcagtggcaatcaacagcatcatggacaggtcaaagttagtagaaatacaacgtgaggttgctacactcacacagctcatgtccacatagaagtacatcatggtatacaatcggtggaacacctagctatgtactatgtcagtatgtcatatccttcgtttcgaactagaacttctatatttgtgtttcttgtcgtaatgaactaccgtatctatagccatggacattatattgtgaactctattgtttgagctacatgtggacatcattatgctttgaaatgtgtgattgttgaattgttatgctatgaattgttgaattgctttgaagttcaaaatatagaaaatatcatgccgaatttttgtattttacatccaaaaggtaggtttgaaaatatcatatatatttttctaattatctctaatttctatacacatttaagtgtttttcaattttttgtagcattgttctgttctgctacacaaatcacggctaccatgcaaatatcgtggttacagcgccaaaccatgcggtaaccgtgaccaaaccgcgaaatcaccgaatttttgaattcaaatgtttgacgatgaatttcacagggttttcagtaaccgccttactgcggggttatggtagcccccatccaaacggtaaggaaaacactgctggtagcaggtgttcagttctgttaatggatgaatcaggaaagatgtgccacgtatactgagtttgactcgttcaattatgtgctagtcatgctactagttagctgcaccaaacagaagtgttcttattgagatatgtatgatacatggaaaaccctgtcataggctgaccattctggggataccattacttgttcgcactacaaaacactcatgtgctgtgcagtctgaatgcactggctgcctggcactagtagctctggaaagcttcagtttggcttctttgatatcttgtttgcatctcccgtgtactgtacatgtaaatatgagtgcgcactgatcattgtatacaaatcattttttaggatgtattatgctctacagactactggagtacaatatatcagcttcgcttaagctatctctaaaggtttgttaagacttaagagtcgccacgggatttgtatcattgtatggaagaaggcgcatggtaccgaggatgagaacgggggaacatcatgcggaaaactggtgtggaaggggcgcgtttgtgttgtttggtatgcgatggacaaggctgagctgcatcaccatcaaggcatcaagacctgcatttgttttctttgttgtcatcatccttgctggactcgtccttatttgtt

SEQ ID NO: 57486 - DNA, 4173 bp, Oryza sativa
  unsure (1)..(4173): unsure at all n locations
tcctgcagccctgcacttagccatgtattgtacaaaggggaagaagaaatgtgtgttctaacattgtgttacattcttgaaatatttcagcaaagatggcatatgggtgggtcatctgctctctggttactcattgcctatggaagtgtcacctcaaggaaatggaaaaagttatagtgatgttggtggaatgtggaagcattccatcaaagtttcatatgatgccacgaaggcagcatttcctggtggtcaagttatagcacatcttgatcaaaagtaagtgtcatatcctttttgtcggtgatatctaatcgactaaccgtataaaagatgctacttcattaccttgtgcttctctgatgtataataatcttgaactgttttagtttaacattctaattctatcagttggtgcttgacttgtaggagcttcaagggctggcaaaagaatgctatcatgagctacttgcaggagctgaacataaggataggaaaacctaatgatttcatctaatatgctgcagcaggtgtccacataaaatttttctgcgtcgtatatcaggtttgcttctactcatgttttggtgccaaattcacttctgcataattttttttttgagaattacacagcacaacacagacacataatgcatgcacactcacccctatgaacgcacgcacgcaaaccctacccctatgagtaggggtggaaacgggtcgggttcggtcggatcttatccttcccatatcctaacccacatttcataatcgggatcgggtcgggcacgaatattgtcggatacgaatacaagcacggataatatcgggaataaatacggaacaaatacgtaccaagacggatacaaacactatcggttgcgaatacttattcagatatgaaatcaaagcaacatccatatataccatataggcaataggcgttcaaccagtccatatatgtataatatgaatatgttagaggcgtagggaatagtaatgcctatcagcacaacagaaccaaagtggctgtggttgcatcgtgtagtaccaatgcatttggtgccaacacttcggtaccagccagagatgcacctgtgcttgcacagatactagtgtttgcatcaccactagccattctatcctaatcctacaggcaaccaacaaaagtaaaataagaaaaaaatccttcaagtcgtaaagtgatgttgataaagggcaataaaacacttaacttttgctcacctgatggctgggcctggatgactgctgagaggtgactaccagaggagatggtcggcgcctcggcggtgaccggcggggccttgcgacggtggtcggcggcggtcaaacggctgtcgcatatctaccggcgattgcaacagtggccagcgggcgcgggtacgcagcaacgtagccactagtagctagcacatcgcctagcggctagcatgcgcggcggcggtgctggctgtatgcctgtgcctgtgattggttgctcgcgtgcggcgtgcggcgccctctggctgctgcctgctcgcctccctgacctgaggctgagtgttagcgctcggtgggccttttgggctgttatgcaattgtgttgatgcctggtggtggtagcagtccgggtcatatacgggtagttaaccgggtaatacccgcacaatttaccggatactctgtatccgtcggatactgtcctcctgaacccgatcttatatccgtcagaaaaaatccgtttttgaatccgatatccgtgtaagcactcgggtatcaaattttgacccgaatttgtcccgtattaatacgggcgggcgggcgggaaatacccgccccgttttcacccttacctatgatcatcttcgaagactaggccggcaaatcctggagatttgacacgcccagattatgtaaatatataatttgagggaaatgtcaattttcatctttgttaaagtcttttgagtttctaacgataccagtatcatggattgttcgttctatttttttctttgtttctgcttagatcacatgtcttctgttggagaaagtcctgaaaatttgcaaaatagtagttcattaactcaaaattgctggcctatctgaggcctacccaatattctgttgaattttgctaacatccgacatttttatagtagaaactagaaaacacaacattatcagctaacaatgctgctttaatattntgtcaaactggccccagaaacattntaggaaggcagaaatatangaaatgccacantngtttttggtattcgtgcaagcaaatatatataacaaaacccaggttttatgattgaagttgcaaaatcaaaggggatttttttagaacacgcaggagatctgcatatcatttcattaagatagagggaagaaggtggacagcgttagagaaaaactccgacacccacccacccgaaagttcaacagcaacaccacacacccacaaggaacaaaacggccctagtatcctagcactatagccttagacaaaagatcatagagcttagaagctcctgctagtcaccgtcctggtttaaaggtttcacaaaggtccaaccatattaaaatctttagttattttttatccactttgacctattttgttcaaggcattaataaatttatccagctagagtaattaattaagtactaataaataactcgataatattcacagatgtattgcatggcatttaaatgaaaaatgagattttatgagaccttgagaccacaatacctgtgttatgtgccacaaccgtagtatgtagggttttctgcaattttgacatgagaatatgggttttcttaaccttactcttctttgtatggatgactgaacaacttcactcctgcggctgcacaacaactgcaaacatggtttctttttcatgaggtgtaattggttatggtattctctcctaaaactcaggtaacaatagtgcctacaactatcattttactatatactagctaaaggctcgtgtgttgcaacggatattataagagataaaagcaaaagcaaaagcaaaagctacaagtttatagcataggtagttgattaggcatataatgccatattcagagcaaaagcattcacgtgtggagaccttatggattcatatgtcagcttgttgacgttggacgccaccactagcatcatttaaagtagtatagagtatagataacacttctaacataaacctttcaaccaaattaaaattaaatctcagaaaattagctagagttagatgttttttttaaaaaataaaaacagagcaagagaaaacctagatgtctctcaaaataaaaatattaacccaaaagtgatagcttgggtgagcaggttaaccccccttgctgtggtttatatacccagctaagaccttgttttgctggccagtgttccggctcattccccatgggttagctaggatattcaactaaccaaggcctaagatgacatctgtaaactcactttctacgtgtatcataggcttgtattgtgtgactcacagtttgcatgtctggctctggcatatgtgcagggacaaatggtaaaggtgcagccctgtgccagggaggcaaaggagaatgcagcctcgtgagttgatgatgttaatgttcctggatgctacacatgagaagtgagaagcaagcaatagtcatccttaatattgcaagggaagccaggatcgatgctgctctgaagaaacggtctagagtcatgtcaggaaaggtggcagcaaaccatccagctagcacgttatctaggctttcatatactagctgtctagtaggagtatttctcaggtttgtgcatatggtggccaaataaaaattagtacaaaagagacccatataaaaagggacacattttagtattataaatctggacaatagtgatactaggttactatattatgaaacaaatagagtactttgttttggggatgcaactagttggactccaacagggaactcttgaacattttttcttattataaatagtatgactaccaaagtaacaaatgactatgtgtgcacattatagaacaaactttttctatgatcagtgtaaaccttttgttatatagtttagcagtcagcaatgaaagctcaaccttttaactgttacacctgcataaaagg

SEQ ID NO: 57487 - DNA, 635 bp, Oryza sativa
ccgaccgagcgttgtaacgggtgaagtctattttaatcttattattgttatatagtttaattaagatgtggaaattcgctttgatatatgtatatattttttagaaaatcataaactgcagttgaggttgatcgtctcaagttagcatgcaagttttttttaaacggatttcttatatgtttccttctgtattactaagagccaacgaaattaacaaccgactcaaatacggatatgtattgctaaagcaaacgaacttaaaagctgactcatatacgaatgacataccaaaataccgataaaaatatcttcaatttttataatagtagagattatagttggtcattacacgttacctttctggtaaaaagaaaacattatctagatcgtggcccatgtaggcctggccggatgtcagctcgctcgctgtcctctatccggtacctgtaataccttttcttttttcttctcttggaacaagcgaagagtagaacaagcgaagagtagagatttttgataagtgaacagtaatagattttagactggccttgagaatctttttttgacaaaaacatgttaaacttttatactagtagagaagaaatatgatattatcttatcttaattcttgccca

SEQ ID NO: 57488 - DNA, 3459 bp, Oryza sativa
aacagaggtagtagaaagcattaggatagggagaatagccaatatgatccctaaagtttcgctcctggatcattttagttcttaatctttcatattgtacaaacaagttctttaaatttgtcatgtgggctgatatagtctttggtcccaccaaaatcgccacatggacatgccacgtcaccttcctatgtaaaatctatatgatttatccaatttaccctcacatgtatcataggaaaataaaaacaaaagaaaaagttaaaaaaatatggtatatgtaagagcaaaaatatacttcaaaagggtgaaaaaaagaagtatttttttcctatgttatgtctaattcacacctatatttatttttctatgatatacgtaagggtaaattggacaattcattatcgattttgcatgaatgatgacatggcatatccatatgatgattttggtggacccaaggactattctaggccttatgacaaagtttaaggatttctttggaccatttaaaaggtcagagactaaactgatcctatagagaaactttatggactaaagtagctattctcccaaaaataattaggaaaagggtggaagcataggcatggtgaggcaaaattatatggaagagaggagaatggaaagccgatggttgttcttcccagctggctgctgcccttgctgatgccaagtgtcctttctcttttgttttttttctcaattacacatcagatgtacatgcacacgaacaccacatgcacacgcctgcgagtgtgcccctgatacacggttaaagacatagaaaccaacagcacatatttggccctagtaaattcctattcaaagatcactcgcgtgttttatcggtggaccctaggatttgaacctgataggtggcgatcagacaacctctgcctaaggcctacatgcgtgacaagagctttcttgagtttttttccattgtaaaatggagttaaaactcaaaacatgttgctctctctatctaaaatattgaacattgctaagttatttagcagagattaagattgaataggaaagactttggtgcgctttattagttgagaaatggttgagggtgagagagtagttaagggtaagttggtggataggacaagccttgttccggccaactaaatcaagtggccatattttaacaaatatacttatattaccttgtcctatagttatgatatttttgttttatcattattatccataaacattccatgattgacatatcatgtaaattgtcacacttttctcgtgaagtcttgccaccatagttattttgagccatcaatgattggtctatgctgcaaattatctctcctcacaaagccacactattctagaccaatcattgatggctcagaaaaaggacccgtcaaaggtgacggttatctgtgactaattcatagggccatcactggtgtgccgtcacagatgtagggttctggcgtagtgtctaactcgaacgtgcatatttaaaaccgagcgtatcaaaatgtcacgtcaaccggctagatttttatcatatgcctaaatattggaagctggcctaccatatagaaacatacatttacactgtatcaacgacgattcaaataaaacaataaccctgatgagcaacatatacacttgactctattgccacactaccgatgtgcttccatgaagaatttagtgaggatttacggtccacacgttgatgcaataataattagcaatgactatatatttagtggtactccctccggttctatattaattaacgttttggacaaggttaaggtcaaacttttataatttagactagcaataactttaaaaatatttagtttaaagtaactagaacaacttatatagatttatcttttaaagtactataataaaagtaaacatgtatttatttattatatatattataatagaaaataaggttaaagatgtatcttgtagatcgtgtcattgtccaaaacgtcaattaaaatgaaaccggagggagtagtaaataagctagattgaaaatatatattgacgtttgagactgagcatgccagagatccaacgttattgctatagcaattaatagagaacaataatcacccatgttgagtgttttaactatatagagaaataaatgatatcttaaagagggtatactgccgtatgactgcatacactccatctggtgtgtatatgtgcaccatctggtgtgtacatgcatatgcaccatataatcgaaaaagaaaaatcatcactaagaatacattgagtttgcttgtcatgtcatttttttttaaaaaaatcgaactagcctatattccggcctgtaagtgtggtctgtggaggtccatatactagtcttgaatgttggaacatgctaatcagtcagaatcacaatataacacttttaagtacgaatttaggttatgtcaactgttaatcaatccccaacacgacaagtctcagtgtaaagtaaacactcacccgctgccaactgaaagtggttaattttgaattagccttccgatagaatgcttttaaagaagacagggttgccgtcagtttccatccagctcggtttgatttggtactcaatttcgagtttggcaccaagtaacaatcatgtcagcactcaaactgatctaaggcatgtacagtgttcctgtgatggcagttaaatgttcactttcttaggagacaaatgaagccttgtgctgccagaaaaatcgtaagaggtcatatcatggatatttgacatattaatctggaagtcctcgaattcaatttaaccctgggtttttcgcatggaattttctactagctagtaactgttcttgacatgccccggaatttctataattccaatgtgagcccttgtgatttcactcaactttctttttgaggaaacactcaatttctaatctattactaaattatattttgattactcatatgccctgagtttttttattttaatctgatattagttgaacatgagttgactgctttttttctctctcaagcctttgacttttaacattaaggacctctagataaagggaatgtatacataagcttaggtgcacacacactaaagacaccaactaataaatatcataagaaattctataaaaaatttacacttacttataataatattatacataagtgcacgtttcatctttaaattcatcaaataataataagttcatccaaaaccacaatttgtttttgcataataacaaatatataacttcgaaactatatagatgtatgctatatttactccaatgagaagtctagctgtgcaagggagtaaaatgtcattcattatgtcagattttaaactttcataaactcgaactatataaactagtttgtcattaaattattgataaatatcattgcctcctatccaagccacttaagttc

SEQ ID NO: 57489 - DNA, 20261 bp, Oryza sativa
ttggatggccatggcgactgaccttagcagtagcccagagctgctgctacaacgacagtatctaatctactaatagcaatgatctgcaaccggagtattcagaaataaaacaaattaaggtgcagcaatacataaaaccggtatatgcatatatatgatctttagagtcgtcatataataccatgatcatgaattggctcctttaacaaattgtacatactaaataaatttcaatgttgttgaatagggacagtataaatctgaagaagaaacaaatccaaataaatgtcagtcgtgttgaatagggacggtagaaatctgaagtgacaaatccaaataaatttcaatcctattgaatagggacagtacaaatctgaagaagagacaaatccaaataaatattgggacagtggaaatctgaagaagagccgaaaccaaatcaatactcgtatgtccttaatccattgataatctggtatataacatgaacaaatcaatcgagtgcgattcaaaggagaaatgtaagccaataaattgaatgaacatatatggttatggttcaagaaaaggaggaagaagcatacctttggtagatgaatatatacccctgaggtttcttgaaggtgaggaggcggctgaagctttaaaggcagggaaaacgaatggaacgatggtttccggtgtgaaatagtatgcagtaggaagtgaatcgggcagcgtgtgaggattcgaccgaacaggatgtggaggatgatagtttcttgaagttgaggagacaacaactatcttgatgacagctataaagtttgagcgatcgaaccacgacaggtgagcggtggtttccatttggaggtgagcagtccaagagctggcggggaaccacgacgctacgcaggatctggaaggtgaggcgccggcgccgcactcgcagtttctagcggcgcagggagacgtgaccgctcgaactcaagagggtaacgggaatggtggtgtggatggagtgtgggaagatgcggtggaaattgggccaaggagtgtggactgggcttgatggtgtgtaaagttgggcttgttggccagcaaaagaaaacagagggactgcacattaaccattgatatttgatccaatggattgccaacagattgaccgggagaagcgcttgatcgagatccaatggctaggagaaaacggggtgacgtggaagcatgaggatgcagagaattgctagtagtggggatgattgtataggtatataggattcactattttttttgtaacatttgaccactcgtcttattcaaaaaatttgtgcaaatataaaaaacgaaaagtcgtgcttaaagtactttggataataaagtaagtcacaaataaaataaataataattccaaatttttttaaataagacgaatggtcaaacagtgcaagtaaaatgtcaaaattccttatattaggggacggagggagtaaatgtgtatataattttgctagctgactcttccctgctcaagaaggttacacgtatctaaggcaaactatctaagtttacacaagtacacaactacaagtggaacatgattaaattaaaagtttcaaatttacatgaatgatcaaatgattactaatgcttaatattagttatctgtgaaatcacaaattctttttgattatgaaatgcccattgcaatagttgcaactatcccccaaaaaagtcctagcatgtgtttaggcattgatgattgacatttgggaggcaaagagcacaaaacaaatgtacagcatgaaacacctgagtaagctaatggcgcagatgtttctgaaactataaaagacatgtaaagggcaatgacaaaaaccagtttgtaggaagctttacaaaacaccctaccatacatgctaatacagagaatataagcatggaagtagatctatacctatctcaacaaacatcgttggtgtattggtgactggtccatggtgagtagcttccagtgtaatcttcacaagcaataagaattagaattttaaaagcagaaagttcagaagaaaaaaaaaatcatcaacagaaaaggtacctcaaactctggaacaagaccttggtctaccgcaatcttttgcatcaaacggagccatggaccaattcgaggattgggcagagctgcccatcctggtctccctccttgaggtggcgtctcatcttctcttagatgtggcacaccttaaggtgcgacacaccaaagaaaaatgacaccatgtttaatataaaataattgaatacatgtggtactatgaagtatgaaccattaatttacacaaataagcatatgtattgcactcaaaaaagtacagatgcattatttgtaaacaaacaaataacaaaatacaagttcagtaccttttcaggtttattaaccaccatttatgtcatatcttatttaggtattcaatataactcaaacacagaaaaatattaaacatttaacagagccagggataaacaagaaacatatagcactttatgactaaaaataaccaaccgattggatggacagtaagcgcaggacggttggagacagcagtgtgtttgctgaggaatatgacctcagaaacagcctctccagtggctgcctgccaccggttgtcaagatcatcctccgcaatgatgctgcgttcatgcttcaatagtcgaacgtccccgtttgtaaagctctccatcccctcctacaaaacatataccatcagagatttatatggaattgtcgcggcattctaacaaattaaagaactgcaaaatgccagaaacataacatctgatggatgttacaaaaaaaattgtaacaataatttttgaagctaaaacttaataaaacaaacagagtcactggaacataatagatatgtgttggtgtacatgatctgcattctgatcactcattgccttctatgttgcctgaagtagggaaaagcaatttacacgcagacaaaaccttggaaagttcagggacaccggattctgaccaactctttttcgacataccattatttatcactgatgatagaagaaacatagcactgttattctccatggttctgctatgcgtctttaggaacaggtttatcagctccatagtcacctaaatctggatttatttgttgattgaggcagatatattttcgcaaacatttgttctgatgaggctaattgatcaaattggtgacttaccttcttctgccatacacttaaattagcaagttctattattcaaaggtaagagacagattccccctaatattttatggaggcgtatagctgtaagtgcacgatatctgcttgcattattcatggataaaagctcgagtgtcatctttaaatatatcgacgttcttatatattatcatacatacaaatggtttaccttttccttgtcactaaaaagaacagtatagacgccactctccattttgctgtgactcatcatgtcatgtcaattttaatgtggcagcatgtggacggtaactatgtgacaaagtccagaggagcttgaaaagctaagggcaatatatatttttatactatcaatatccattcatgaattaatttgcaatgatgtaaaaacagattataacatccggaatcgtcctgcgatctgcgtagcaactagtatggacatgcaaatctctatctagtatctgtaattgcataaacccgcaccaaaagcgcatcctataacctgggcacctggccgcatatgcttgcaaagctcagaacagaagaacaattccagtcttcagaaaagaaaacgcctgccgcatcgaacaagatacctgctccacaaccataaacactagccatagccatggcccaaaccctaattaaggagcagcgcttccccgtgctacactacaagtcttggggaatttgagattggggtggatgggactagataagatggggggcggtgggttgcttacggggatgggcgggccgggagaccagccgggcatggcgaggaaggcggcggctgggccgatagacgccgggtccgacgccgtcgccaccaccagcaccaccatctcctcttcctcctactccgactccgaccacgcctccctctcctctcctccaccagagcaccgctcgcgctcgtgctcggctgctgcttctcttgtccaggagaaaaatcgatagaatgccgctcctctacggtgggccgtgggcttgataagttgtgatttgtctagggcctatttcaacttcttttcttaccttatactccgtagaaaaagaaaagaacgaaaatattgaaactcaatgtataaaatggagttctatacaatttttcctttttttttatttttgacagtagacgtagtcacgtagcacaccacttatacatacagcaccatacttataccctaagcgtaatattcgtgggtactacgatttgaatcctggtgggtaaagttgtgaaccatcacaccactaaggctgtgaaccatcacatcactaaggctgcattcaatagggtaacattgtgagataatttgttttgttttccgtatgcacacttcccaaactattaaacagtgtgtgttttgcaaaaaaatttctatatgaaagttgctttaaaaaatcatattaatccattttttaagtttaaaatagtttatactcaattaatcatgcgctaatggctcacctcgttttatatatcttctcttttcctctcttctcaaactcaccctaatgctttcttcattctattcattttttttattttcaagatagggctatttttatgatattccatgtaaacttaccaaatatttcataaaacgggttttccgactagaaaaagcttgattgtttgctttgcggggaaaagtgttttggtttacatattacaccggattttaactttttatgataatctcttactaggaataatatttgtttaatttagtctcacccatcatgtgttagattcatttttttagtttgcgtaggctctctgcctaaagtttttggtcttgattggcaggatgcgcactttgcaactccatacaaaatgtaccatagcagcgtaaattttgaaatgaccaaatgctgaaaaaaaaaagctccgtgcaaatgctgccagtgagtagcatatatgttactgcaagtttgcaattaatccgctgtagacctctttcaggttagcatggaagagcataaaagcaaacaatgtagagctaaggctgtgtttagttcacaccacaattgaaaatttagttgaaattgaaacaatataacagaaaagttggaagtttgtgtgtgtagaaaagttttgatgtgatggaaaagttgaaaatttgaagaattattttgacggcctaaatatgcagcttcatattcgaagcaccatagccttatggtgtgttcggcaccccctcttcccaacccctctccctcttccatacgtacgcttttcaaaccgctaaacggtgcgttttttgcaaaatgtttctatatgaaagttgcttaaaaaaattaaattaatccatttttgaaaaaaatagctaatatttaattaattacgcgctaatgaaccgctctgttttccgtacggaacacagccttagagcatctccgattcaggcccaaaagttacttccttggattgggactattctaaaaaattttagacctaaaaatctatttcatctccacctaaaaatataatcccaaaaattagttggttgaccatataggattggatgggcccataattgttaccgacgctttgttttgcttttttttaacatatgcacggatcaaatcactcctgatcctgccactgcccttcctaacgccgccggctcctgctgccgtcagagaatccctcgccgaccacggttgactgatggaagatttcgcctctaatgtggaaaagcggaaggctagctaatcctctacacgaccatgacatcaatttgaaggttaatatcctaggcgatcctcatgttaggattttctctattaatcacgttctttttttttaatttgatctgataatatcgctaggggagaaagtttctgttggtgatgaataatggtttggcagttaatttgatctgtgatgaatcatacttactcttgtttcaagggcttgtgcatgaatcatcgtccgatgatgacgatgatttttttgggtcgcagcacaaatcatgcatagctattggtactctgtcaatacatcaaaacatggtgggtatgtcatgggacatgaagtggttgatcgcaacagagaaacatgacacttgaaattttaccaagattactttttcgataatcctacctatgacctagttttattcaagcacaggtttgtattgagccaattttatttgatttatctttgttatatgcatagatatgtatgtctcattagtaatgactacgcaggaatagaatgagcagacccctgtttctttgcataattaatgcaatagaggatcaagatgactattttgtgcagaagataaatgcaatcagtatacttgggttaagttgtcatcaagagatcactgcagcaatccgtcagtcagcttatggtatagcagcagatgctttggatgaatatgttggtcttgcagaaagtaccgctatagagaatctgagaaggtatgtgaaagcaattgttgaagtttttgaacatgagtacttaagatcatccaatgagaacgatacaactcgattacttgcacttggagagaatagaggtttccctagtatgttaggctcttgttaacggtgaaatttagtaagccccgaagtcatcataggcctagagtcagtatcggcttcagagtcatggaatcggccgataggaattatcaagtcgtcaatagtcggattcttggtagattcggttaacgaaattaatcaattaaaggaactttatccagaaaagactgagttgaaggaggatgcagcatgacagtttatctattaattagaaagtgtctgttagtttccttttatatttaagaaagtgtgtttagtatccgataaggattttatgttttcctttatctttaggaaagtttctttcttatccaacaaggactagtatctacccatgggtataaatatttacacccggggtcattgtcaattatctcacagatcaatgcaactactctcggcacattgccaccctctttcccgaggtttttacttatcacggcggaacttggcacctaacgtggggctgcatcggttttcgatctccgatgaaggggtaagtcctacgttcctccggccctggcaattgtatcggctacattagtgttgttcaaggctgcatcgcttcgatgtcttggatcactttggttcggttgacattttttcctacctatttatcacatatcttagttaatctagtttatcatcttaatttgatcatatcggctgagattcgttttagggtttatgctggtattgactaaattatcttactagattagattaactaaggtatcgatcaccctgaaaaatagtcaaaggcttgattgtttagactttatgcttctttgcatactttgcgatgcatcatccctagtcgtacttagaatcataaaagctaacatgtctttgattataataagggtttcatcagggtttcaaccgatgagttccagccgatcggctctttggtgatcttcaatttatatatcttgtcagttgcaggatcaaactgactgtcatgcctgcatctcatcaagatttggacctgcactggacctaagcagatcttccaggccattgtgttcgtcgacttagtttgtgccaccacaaatctgacaccatcgaccgagcgcggatttttcatcaatagctctgtagaccgtatgcattgaaagtgtaagaactgccctacggaatgctagggtatgtactaagggcacgtgcatgagcctataatgattctagagtcgttgcttcgaaagatctctggatttgacacgcttcacttttttttgtttgcacggatctcataacgatatcaatgtacttcatcgaatccccactatttgcattgcaatttggaggagatcacttcggaggtgttcagctcgtataggtgcagggctagcaccaagatataaaattttgatatttcattattttgttttagaacatgttgttatgtttattttctacttcagtttggtgtggaactatgtgatgttggtcgttgtacgtgtttaacgcagtggcagggttatctcaccaccagaaaaagggttttttatggctgtatcaaatttttttcgttggcggtcacatgagaaatcgacttgtaaaattctaacgaggggtggagggtttaggaccgccaacgaaaatccattttcgttggcggttgcttaagaagtccgcttgcaaaaataaccctttttttaaccggcgtgcctcttaactagatttttgctggcgggtactaaaagcaccgcccttgaaaaaatccacgcacattgaaaaatcattgcccattacaaaaatcaccacccaccactccttatccacaccgctccaaattacaaaaatctcctctggttcctccaccagcatccatagtacaaaaaaaccggaccggctcggcggttgaaccggaaaaaaccagaaccagagggctaggcggctcggtttgctgtaaagaccgcccctgcatttgaaccggaataaaccgcctgaaccgccagttttcatgtgaaccggtgaaccagagcgagccgagccggccggtttgtcatgccaagagaggatgggccttgatgggacagtctaggccttgtgcacgtgcatgtgtactactgaaaatagcaagaaaaagggatggaacgggggttcgaacgctggttggctgactgaaagccctatgcatccaccacccagctaactttcacaagtgataagaagagaatatgcatacaatataacacgtcgggttcaacattcgaaccgtgtgaaccggcggttgaaccgctggaccggtgacccaaggactcgagcgattcgatcgccggttcggttttttcaactatgccagcatcctctcctcctcccccttcagatccacccaccagcatcatctcctcctccctccccataggcagcggcagtggctctaacggcggttcttgggcgatggcggtggctccgacagcgatgcgcaacggtgacggtgataggaggcgggcgcttcttcttctcctcctccccctccctctcccacgatctcactgccaccacctcctcggcggcggctgggcttcctagatccggtggctccaccgccagatttgacggtgacagttgtggggcttggtgaggcgagaggagctcagcggcagtgaggtccgatgaggcgggaaaagctcagtgacggtggggcttcccacatacggtggcttcctcatctgatccaacggtgaaaagcatcaactgctgctcggtcggtgacggtgacgacgacccccttcctttctcccggccagattggtggtggaggcagattcggtggcgatgcttctagctgttgttgttgttcttttttttcatgttcttttgtttgttcaaaatgcttgtatgcgtgttcacttgcatgctaattgcatctaatgaactctctggatgaggatttgaatcgtagcctgaaaacttggatgcgaaaatctgagttattttctcttttctttgcgaaaatatattttggggatttattttttttcatggaaaatcattttcgctggcggtttgcttaatcttgccgactgtagaagtcgattttcgttggcagtccacttaaccatgccgccagcgaaaatctatttttgctggcagatgaagcccgcttgtgaagatagcctattttctctggcctttgatcgcatgcgattagcttagacgccagcaattgatgcagcaacggggggttcccgatctttcgatgagaggaggataaactttgatttgggggaggacacgacgttggcggtccgactacaactaccacaggggtgctgcgccttagcaaccggtacaccgactccacgttgttgttgttcttgccgtgccaagaataaccttgaacctgtaagcaatcgaagaacaagcaagaacaagttgacaaggaaacagcttacggcacttgtcaaatgatgaaactgaaacaaaccaaaatggggttctgaatacaagtatccgggtggtctagccgacacacgcgagtacaagaaagtagctgcagctaaacttacatccaaacaaaacccaaagtgcaaaatggtggctgctaggagtttatataggtgaaggaatgaccaggagaggaggtgggagcaaacccttggttttgtggacccctaatgggctgtaaagatacaaggcccaagcccaagtttctgatgtgaagaactattttcgtcattctgagcagcctgggtcaaatttgatggtgaggctacacatagctgaaagtagacgacgagatctttccaacaagtactcatttgccccgtttgccctccggagtgaagagcattgacttcatcaaatcagcgctgctagtgctgctttcgatctggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcatggttgtatcgttggaagggatgtcctcatcaggtggtggaggcagattcggtggcgatgcttctagctgttgttgttctttttttccatgttcatctgtttgttcaaaatgcttgtatgtgtgttcacttgcatgttaattgaatctaatgaactctctgaatgaggatttgaatcatagcctgaaaacttggatgcgaaaatctgagttattttctcttttttttgcgaaaatatattttggggatttatttttttcatggaaaatcattttcgctggcggtttgcttaatcttgccgactgtagaagtcgattttcgttggcagtccacttaaccatgccgccagcgaaaatctatttttgcttgcagatgaatcccgcttgtgaagatagcctattttctctggcctttgatcgcatgcgattagcttagccgccagcaaagatggattttagccgccagaaaaagcaatttttttagtagaccctattatcttctttatggattaaatccattttgcatcgattgaatatacaaccgcttattacaaaggccttagttaaaagtcaaggataaacgtatttaacaaagatgacgcattaaaagccacaaaaaatgaggaagaaatttgtatggttgttggtcgtcttcacacctttgttgttagacccaaaaccccaagctaacatgttagcttgaatagtacatgcatgtaactatagttggagatttatactatgtcatttctacaactaaattattttaagaaaaactttttggctttagtcatgcgtcctaaataactcaaagaagtaggcccggccttcccttcgaggacgaaatcttcagcatatacttaggaaaggcccttaatccttagcatatacatactcctactacaagaaagttaaagggcgaaatctagaaagaagatagattagttgccacggctaattattaatcaaatcaatcaacaaaaatacaaaaggttaaaggtgctaaatccagcttgtaaagcagggttgcggcgtcagctgtgcgaaaagaaaaggaaaaaaataggggacaaaagattcctctcctgccaatcaggcaatcaccccacctgtgttttgtattagctgctgcggagtaaggctgtgtttagttccacactaaaattagattttagaagtttaaaaaaaaaggtagaagttggtgtgacgctgtgtttagttccgaaatatttcttcaaactttcaacttttccatcacatcaaaacttttctacacgagcaccgctacggtgctctctacttatagtattctactacaagtagaagcaatctgaaccattaatttataaaggcaaattagtattttactaatttacggttaagggtaatttttaacttttatttttttcttaatagtaggatcagttcgtctgtgtcaccgctccttttgttctcgcgtgcgcccgactccggcggcagtgcccactccggcatatgcgagctcctccgtggctccgtcaaacagataatactacaaagaactactgaacaaagctatatagtcaaatcgagcagcaagagcaaatgtgctgttataaactcaccatgattatctttaaaacctatttgattagtttctccacatgttgtgttttcagttcttaaataattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctggttatatgtctccttctcgggtctggcgtggaacgcgtactgatctccagcatttgagccgctgggcaaggagtagcctcccgaggctgatcccccaccgtaatcccgcaacgatctcatggaagcacgccgccgatctgctcatcgcatctgctccgccacactcaccctaaacctagcacggcccaacgatgctcaagtgtttctaactgatatgcaaaattacgaattcaaccatcccgtccatatttttttggacaattataccctctaacgtttctactaccgctatttaagatagtagtataaatagatctgatccattagatataaaaagatcaacggttttaattaatttatactccgagtagaaagcaccggagtgggactctttctacacacataaaacttccaacttttctgtcacatcgttcaaatttcaaccaaactttcaattttggagtgaactaaacacagcctgagtaggaaaattttgatgtgatgaaaaagttagaagtttgaagaaaaaagttgagaactaaacaaggcctaagcttgcactgtccccgtgctgtcctatttctctccttcgattttgcacagcacacattgctgtccaaagcattgacttggatgtccagtggtcaatccttacgagtcccacgagtgatcaccggtaagttcttttacaaggaacattgaccaaatttaaacttggaacattggtcttttacaacagaagtttgcctggtccaaatttacaacaattctagatttcagttgaccgaaacctttttttttttggcaattgcttatttgaccccgttttgaactgtaactattaatttgaccatactttttaaagtttgcttatttgaccattcttttcaaaagtgaagcttccgtctgactctgattcgctaactccgttagggttagatttcttttttttttaaaaaaagaaaatatttctaatattactaatgcccaagatgccctccaaaccctatccaaacccaagactctctctctctatcgtgcggcggcggagatctgtgggggtggcggcggcgagggggcaacggctatgttggccgcgcgtcgagggagcagtagtggcggccgtgcgaggagggagggagcagcggctgcatcggcagcgtcggcgttggccaagcgcaaaggaccggtggcggccgcgtgaggagggaccgggggcggccgcacgcgggaggagggagcggctgccgcgctcaaagcgaagtgagggagcggcggcggctgccgggctcggagcagagggaaggagtggcagtggggctgttgccgcgcggaggggcgacagcgctggttgctgccgtggggggaagggagggagtaggggcagcagcggcggctgctactgtgcggaagggaggcgaaggcggcggcggcgtcggtgtgcgcagcagggagggtggcggaggccggcgcgcagcgaagggagggaggggagccaggcctagcggcgacggctggcaccgccggcacgcggaggaaggaaggaggcggcggcagaagaagagagaagagaggaggagaggagagcagagaactgacgggtgggccccacatgtaatagggtcaaatgagtaagggcaaaaaggacattttatactccagttaacaccgttagaagcccttaacagaatagggtcgtactgtatcttcaattttgaaaagaatggtcaaataagtaaagttgataaaagagggtcaaattggtagttagctttcaaaatagggtcaaatgcgcaaatgccttttttttgtcatctaaaattgtacaccactaagtctaaaatacaatgtgctacataacatataacttagttacttctattgttaattttattagtataaatggtattaatttatcttgggtaattttacatttaaattgtaaatgtctatatgttgtaaatttatttcatatctaggttagaacaactatttatttaacctttatctaataaataagtgattgcggagtgatgagagattagattttatcaagattttgaaaaatgaccaaaagttttctttcttcatacgtgcatgacatctgcgcatcatttattaataagaagaataatggtcgaaagtttttaactatgaaagatctacaatcccattactattttcttactctgatagttttaaacttatctagttacgacttacgagaacaaaatatacaaactttctataaatcattgtatgaggaacgtgaccatgcaagataagtcattacaatttagcactactagctaaacactgaatttggttaaccgtacatgttgcaaatcaagagttttacagatgggatcctctgcactgaaggagaaaacgcagaggtgctgcattagctcatgttctgatgcgttagatcttcatccaacggtgtaaaccagcgtgctacaataaaaaggaggtcgatagtaaaatcagacacggttggctacagtatatatctaatgcaaatcactatagcacaagactcgatcactgtgcaaatagtattctctagtattacagcagatgacctgcatccaagttttactacattggagatgaagggttgacagaagtcagtggtgaattgagaagaaaaattactagggtctacttgcataattatcgagtaattttatactcctaattaatatagggtaaatagttggaaatagatatcttacgcggtgtccatactatgttgtaaggccttgtttattttctaatttattttcccaaaaacgtcacatcgaatctttgaacacatgcacagagtattaaacatagataaaaagaaaaattacttgcacagtttacatggaaatcgcgagacgaatctttagagcctaattagtccatgattagtcataagtgctacagtaaaccacatgtgctaatgaatgattaattgggcttaataaatttgtctcgcggtttccaggcgagttatgaaattagttttttcatccgtgtctgaaaactttttccgacatccggtcaaacgtccgatgtgatatctaaaaaattttcttttcgcgaaacagtgcctaaatgtaataggttcctcactattagaagtttgaaaaacgttgagtaataaattgtgtaaaacacacttatattttacaaatcttctccaacgtttgaaccattttgtttaaaatttgcacatctagctgaagacttattatactcttttgagtagcatagttattttcagaattttaaaataaacaacattctaccatctccctctcaaaagagaatcacaattttatttgatactccatcatcaaatatagaaaaaaaagttgagcatccaatgaatgggacccagatatctcgcaagggctatagtgaaaaacacagaaaaatatcatcacaaccgacttacaaaatacgtactatatactatacagtatacagtctaacaggaaaaatcaagcaccgccttttctttagaattattaaagaagaaatcttaccgttgggaaaagaaataaagaaaatactttaaccccaaccccggtggaggcgacgaggctcttcgtcatcatcgtcgctcgcctttcttcctccccacgcccatctctcctctctctctttctctctcttctttctctctctagaacaaacacctggaggaggagtgtaagtaaaacccttgctccccgcgggcgatcgatccggacacgctgtctctctagggctccgccgccgatcggagatccccgtctccgcggtatggcggcggagatctcggcgctgctcgacctcctcctccatccgcccgccgccgcggcgggggaccgggacccgcccgcgcgccgcctccgcgggcccgcggcgcgggcggggctcgaggccctcgcgggggcgctcgccgcgggcccgccggccgacccggcccgcgcgcgcgccgtcctcgccgccgcgcgcgccgtagtctccgcggtcctctccgcctcaggtagagtgttcccacccccctccacccccgcgatcccgacctagctctggctggctcgctgctccctcccgttttggattctttggtcgttgccggtgagggttttggatttaggctctgatcttgcagctgtaaaagcttggtgctcatgagatgcgctcctgctggtactgccttgttggcttggttttgatgctgtttgtagaactttttcttaggaagcagggttcgcttggttttgagagttggtcctgtgaaatcacgaccagttgttcttgttgattacaacaaccgacctagttatctccccttttatcttttattattagtattagtatttggttttatgtgttttatatcttgtttggtgatcaactttgccaacttgaattgttgtatcccttcctctctttgcttggttgtatgctatctccggagattatctaatagggcatttgatcccctttgtttgatatattttcttgaggccctttgtttgatatatattttcttgatgcagcagcgctttcatgttttgtcaggaagcccaacaccgttcattttttgtgcattctctatccacttctttactcttctccaattgcctttctcgtgcctcattatagtcacacacattgtgaaattgtgttgcattagcacgagtactacaggtgctgcaaggtcacgaatgatcaccagtgtgtgcatcttgttaatatttatctacaatctatttactcgtataagttctataattgcgttttagatacttttggtatgcacatgcatgcattgtacatgtttgttttacttatttttctatgcctagtgatgcaacacattttgctatgcctagggatgcatgaaatccagttttcttatttgtagtaactagctttagactagctgagcttggttctgaattgcctgataagatgactagcaatcagtgggaattatctagagattggatatttttacttgtgatgttggtaattttactttccctgttccatgttcaaattaggattaaggtgtttgcatttgagaataaacttgccaacatcggaaactttttgccaataaaattggttattgctatgaccagcagattttttattgactttggttagtagttgtaatttttcttgacagctttaaggtttctgaacattcattacaaaatttgtcttttgatatattgcttccatgaatgcgcaaaaacaatcaattaccagtttccacttctgatccatccattccatttggtttcgaaaataatatgaaatgtgaagtcagcactgtagttgagttgagtgtaccaccatcctttattgaggggcgttacacttttgttttaggtatatctttgtctcttttaagcgtggatctatagttggtgccttagagtaaatacattgctgcttctgattctagtttacatcgttcttttctttttgtgctttatatttagcagaatgtctttctatccaaagctatgagtcacttatgcagatcatatggtattatggttcccattgaaagtactgtagcttcaagtcacttatgatgttagtactgaaaaaaatgcggcaataatccttttgtagtcattttctcattgactaaagcatttctcatatcccctgcatttcactgtctatgtgctttttattaaccgttaggaacaccttgaaagagtcaccatgacatgtctatcatgtcctcgataaacgaatgtctagcaacctgcaaggttttaatatcaccttctatgttacctttgcacgttttgttatcagtggagcaagtggagtcaacggttgtggagattgtggagaggtctttggaattctgtctattgtatctcgaaaaatcatcatatgcatgtgaagactatgggttactggtaagttctttatgcttgatttattttttgggaaatgatcgtgttgacctaaaacagatcactttgttgttaccttttgcaatatgatgtaatatcaccatgctgatcatgttccttttacttcagtctgcatttttggggagtttcttaagttctctaacgtagcattattattatttttattatgtttttcatcttttcagaacgaggttgcctatttcatggaatgcgtgctgcttagagggactcccagcaaggtttactcgttggaacccagtgtcgtaaatgatgttattgagcagtggtcgtctgtccaagttgattctgagcgtatcagcccacaagagaagtatttctgctatttaaaaggtgaactcttggaaacttgtcctttaaaatgcaattcaaggtttatggaatgttggtgctttatttgctgattgttttttgatggcacaaccaggcttcaattgctcaaatagtggagatgatctgcaacggtttcgtttgacgttatcacctgaatgtttacagcaagattatgttattgcagagaatactgaatcatcacacacagcatccccaaacggcatggtgtcaatagcacagcattttgcagttgttcacctacattgcataccagtccttcttacattggttcagaagctttgccagtctccagctttggatgtgatagaagataccaactttaatatgaggttgtcttttggccaaagaattttgaagttagtacatggtttggctatggaatttccttgtgatgcttctgatgcgatgatgctttgttcagtagcaagatgtactgatagtctgccagtcttgtttaaacttaagttcaagttcgctaaccatgacagagtgttttctggagatggtgttggaactgtgttgctgcaaatacttgacgaatttctgcagctaattcatattatcttctgcaacagtgatatttgttgtacagtacaagtatgcatacttgcttccctgttggaaattttcagcccagaaaaatggaaatatgacagatctgctgcttgcttgatgccccctttagtttactcaccccacattgttcaatatgtgcttaaacttctcaatgataccaaacgttggacaagtcgtgttgacagggacagacctggcaaagatgttctaggttattcatgcaattccgagacagatggtttgtcttgccatgctcgttcaaagaaagtgccattgctgaagaaatacacatctgaggagtatctgcaattaatcttcccttcagaagagcaatggttggatgatttggtacatctcatctttttcctccatgaagagggagtaaaatcaatgcctctacttgagaagccgcagatgagttgcacaaagcaagttactctttcagagttggagtctgtggctagtcatgaggaagaagcactttttggtaatctatttgctgaagcccgctctacaggagtagctgacagtgttgaacagccaatttctctagggagtggcccttcgagcagccagcatggccctattcaattagctgctgatttgatatgctttatgaagatgtccatcttctcccctgaatggtgcactgctatatatgtggatgcttgcaggaagttccacagcaatcatttggaacagtttctgtcaatacttcaa

SEQ ID NO: 57490 - DNA, 626 bp, Oryza sativa
acgtacgccggactaatagagacgccacaatagacgtaccaatctgatgtacgaagccggcgacgagtcgccgccgccgccgccgccgccgtcgtcatggccgcacaccacgcaccactcaccggtcgatcgatcagctcgatcaacgaccaaactctcggatcgattgaggcttgcctactcggaagatttataagcgagagagccttgcagctcgctaatggcggatcgaccggtcgacgacggcgagtagctagcgatcgatcgatggatcgatggagtgatcgaccaacgagagcgtgacaagcagcggggtggaggaggtagaaatagggggggatcgacgatcgagtggggacatgtcagcatgtggggcttgctcacgtgggtgccgcctccccattcgcggagaggcggtggcgggggattttgccgggcccacccgccgcactcaccttacccagtcccctgcttttctatgtggcctgattttgatctcgctccctgacggtcagttcgcgaggtaattaattatgcacgctcgttaatttcaggccgtccgatgcatgtggatggtgacttgctagccagaagtacattggaattggaattcaccgtgatcaata

SEQ ID NO: 57491 - DNA, 620 bp, Oryza sativa
agtctctttgggcagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgcatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtcttggaaacgaaaacggtaaattcgaaaataaaaacagtataataatatcggaaaccaaaaacagaacaatatgaacgaaaatgcattggtatcgacaaaaatcaataacaaatatctaaaatcacacattttatttcgcataaccatataatataagaaaattaattcaaggatacac

SEQ ID NO: 57492 - DNA, 516 bp, Oryza sativa
ataagaaccaaccaaaaccttaagacatttaacagaatttagttctgtgcatgcatgtgcataaaaattaaaaacgtagattaagtgcagcatctctacatagtacatacataataattcaagaatcacaaaattttccaggaaatgtcatgtaacactgtaatcacaacaggagcacgtaccaattaacaggattcagatatgtcggacctgagataccaaagatatctctgtccacagccatctggctatgcagagtcactcttcactttattggactttatagtgatgaaaaacataacactgaaacattaagaaaaaattagcacataaaaactgatactggtgtcaacaaatgaaagtattgaaatcctcaagaaaaagctacaaaggtggtcacattcaaatgccatctactttggaccgagagtgtggtagttaaacaataaataaactaaagagcaggcaaataagtccttagggtagttcgaagtatctatgttggtctgttcagca

SEQ ID NO: 57493 - DNA, 566 bp, Oryza sativa
ccataaccaaggagtctttgttgccttgccaggggcagtatgcataatttttaaaagtccaattaaatgtcgggaccatgctcctttactgtccgcttattgcccctcccctctttattatcatagtagtctagtcaaccactatgaacctatacctttatgacctacccaccacacttactctttatcgacattgggattcttaaaattaaaatgaaaccttattattctcatggtctcaattttatagcttttaaaagtcataccaactgtcaccctctttaatcatttgccacgcttttacttacttgctcgacccgtcataatttctatgacatcatcctagatgcctttaaaaatcggatcttatactgtttacattgtggtgtctcgacggatgccatcttaataaggactaaaagagccgtgaaatgccgccaccctcctgtcggacctatccagtgtcgtctctactctgtatcggcatctggatgataaaaatcgaactagactattggagcgctctttttcactttctagaattcctatcaatcgatgcgacccta

SEQ ID NO: 57494 - DNA, 825 bp, Oryza sativa
caatcaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggtttcgaacaacgttgggtatatatagtactacgcttaggcttatttatattaaaaaccgtttgacccatcgtgaatacttttagtgccctcattatatttattcacctaaaaattaattgatccaatcatattcaacaagacgtaaaatgttaatgaaactgtttgatatataacacgaagtataccgagaagtttttataacagttcttcaaaaaagagtgaccaaacctcctaaaatcaacctattgaaattagaaaatgccttttcttccattaaaaatttaaaacatgccattgtgagggacttgggacgaacaaaccttacatttgttaaattccctttggaaccagtgtgtggaaatataacttgtcaaaaatgtttaattatatttt

SEQ ID NO: 57495 - DNA, 554 bp, Oryza sativa
ttgtacgagaattcagcataaggcagacttttatcccatgccccaccaaatcgagcgcacacgctcgcaacatgtcttccaagatctgattgaccctctcggtttggccatctgtctgcggatggtaagctgtactgaaattcaaacgggtccccaattcttcctgcagtttttgccaaaattttgaggtgaactgattccctcgatcggatacaatcttcttgggtactccatgcaaacacatgattcttgagagatagaactctgccaaccttttgcctgtataagtagtgtgcactggtatgaaatgagcaaccttcgctgtcggagatttagatcaggttgggtgaagatatatttcaaactcttgtgatccgtatatacttcgcagcggttgccaatcagataatgcctccagattttcaaagcatgaaccaccgctaccaattccaagtcatgtgttggatagtttccttcatgtgggcgcaactgcctcgaggcataagcgaccactctgccctcttgcattagaacacatccaagcctgtgacggg

SEQ ID NO: 57496 - DNA, 631 bp, Oryza sativa
taaaatttcattaaatgctttgcttaattctataattcctagatttttctgggatttatttgagctaaggaagtatttttaataaatggaattgcatttaagaaataatttaaattgaaaaaggttttaaaagtctttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccggcggctccgagcccctttaaaggacccccgagctcttctttacccgccgcaccctcgcctttgcctctcgtcgtcggaaacgccctagcgccgtgtgccctagcaccgccgtcgccgc

SEQ ID NO: 57497 - DNA, 695 bp, Oryza sativa
tagctatagaggttcgtttgcatagagcgagcatttataaacagtagttgaaagcagtaaaacagttgtaataataaatcaatattaaccacccactgtccaacgctaccccacgttgcaacaggcccaaccatccacctaggctattcaattccattagactagacttggctgagaataatcacggtgaatctggttgaccgcccataaccgcgggcacggctattcgaatagttttactctgatcagaggtgtacaactgtacccacaagacacagccccacgatacgtttccgtgcgccgacatgccaccacgacataccggatagagaccgtgacaggacccttcgcataaccccctctaaccaagcacaccacacctcaggtttcacccccactcctcgcaaggcagcgggcagtcccctctcgtgcctagatgaatccggaagccgcataggccgtcgcagggcccatccaaactccatcacgctcacccttgcctgatgcgtcaactagaggaaaggtacactacaagcccagccgttgcccacgctggcttgtggtaagtatgataagttcttccagggcatcccgcgaaccggtccttaaatgccatgggcgcgaccatcaaaaccatgcacccacagcgcacaatttagttaattttaattcaccaacccggagcgggggtatta

SEQ ID NO: 57498 - DNA, 4568 bp, Oryza sativa
tgggggaagagagagagagagtacggggggggggattcaaatcgaatcccgcccatttgcgggcacgcatgctggcgggaatggcggggagggcggcgacgtggggacgcggagtggaggcgtggcgtggagcggagaaggcggcggcgcggacggtttcggcggcggttgccgtcgtggagcgggcggctagaggaaggggacgacctgacaggtgggccccacctgtcagcgtcccggagagaggggaaaggggaacggaccggcccaaaggaaggaggccaagcgcgggagggagtgggccgacggcccaatagagaaaaaagaaggaaaagaaaaagaaaaggaagaaaagatttttcctgggatttaaaattgcactttggtgatttttaattggttaaaattatttccaaggctctgaaaattccactaaaaatcttcttaatgcactggagcatggggaactcaagaaaaaattccaccacgctaattccaattattaattgcatttattaactagggattttgctctaggttaattaagataatttcttcgggcaatttatttaaccaaaaaagggggggaaacttcagggtgtgacaggaaacaacttcagtatgagtctttggttcttgcccttcttgtgaaggatcatcaatgatagcttccatctcaggctagcaatataaagataagaaatcacaaatcacattacattcacataaatatgtaagtgcaaaagataaaagaaaaatataactcacaataacattctttacaggctcactaaaacccatcttgctgttgcaatggcactccttgaaaacataaattgtagtgggtggcagtgtggcacgtccttatacttagtttgcttctaaaattacatgcaaacagtttgtaaataaagatgccatcactttctgaaagttttttcatatgcatatttagagtgctaaatataacatgccattagtgtaacgttttcttatccataatatgtcatccaatgttttaacaacctatggctgctaggtgcttatatccaccatgttagaaccacagcaacagattatgtagttaaagtgcagttggctagataaaaatatttagggtgattgtacataagtattactaactcctagaaaatgcatgtctagtttctgtggatcacacatgacacatacaaactcaaaatctgaaaaaaaaatcaacttattatacacataacacataattaagttacaaataagagtacaaaagaaccgacacattttattttgtatcttaccacatggcattgtgcaatgtagctccgagagcatgtcctttgctagtactgagcattctcatggttgttatgtttgttttacagacacttctcctatagaaagggaaacactagtaagacaagtagcttatttctatcacatatagataagacaactgtacacaatattttgatagtacgttgtattggtcaatcacatatggtttgactggtcagaagtaaaaacatatttagattcagatcagaaaataatatacgcgtgttagttgtaccacgaaaattgccagtttttacaaatatgacatgcatgtgagcttcaggtacaaacaatatgctagcttcctcttgcttttaaatgtttttcattaccatatatatgatttattcacttgtttctcttggaatgtaaacaaatatagagaaaagacatactatgattttttttactagaatatgagacttgacaagttaacagcaggttctgaatttgaagtcaacaataggtaactagttgtcattaaaccatggtcatagtttttgtaccagcaaattaacccaagatacaaaacaagtagatgcggcatcatgattcatgtagccaacactgtgtaagatttttgaaataatgccatgatttccaataacattcaagtctataccttatgctttggatctgaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcattatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcaaatactcctggtatattatggttacagagttcatccgcaagcgcacggatataccattgtagcatttcacccgagagtattccaagggtatcgtatttattttatctcgtgggaagatcatgtagagagaacttgactaataatttatatattacttgtgataatcatattctaagcaggggttaagataatccaagggtagagtaacacacaagcactaactactcattcttatgatatattatctaagctaagtggaaagaaaagaggaagaaaatctattcctatacttctaatatacatagtatacatacattctagttaaccgacatactagctaataccctctatccgatgccctcctggtacttcgagaagccaccccagactgccgagttccgtacgacagcccgttatgaccatataatcggggctaaatacggaggaataccctccccaggaaattaacttaggattatatacagacgcggaggaatacccgtactgagctgtcaccatcagcggcccacctctcatccgcagcatataaccccaaataatgatatcccgtaatctagacaacacgtctaaacgaccagatcctactctaatatcatcgtcatgacatagagtaattgcataagcaaacattatacccacaccaaagcatctcccagataagctagccgtatatccagtataacaagaacataatgtaaagtagatattcatatacttggaaagtatttcaataccataaatgtatatagaagagtattctaacaaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggcgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgaatctcgacatcgtctgat

SEQ ID NO: 57499 - DNA, 805 bp, Oryza sativa
tgccatccaacagcttttcaaatagcacgaaaatcagtatccatacctattttttttcagcagctccggatcatatgcccgcgtgtgagcaaacacccggtctttcagcatggagtaggcttgcctttcccagtcaccgacaaggtcgaggtcggcgtcgttcaagagatgtggaatgtcggcatcctccattgaggcatcggtggatgagcgagtgctagactcgtcatgatgacttgatcgagagccggctcccatattgaactagcgggacaatcgtctcttcattctgcacaaatgaataagaatggactaactcgggcgggggttagaatagcgagatatttacccaccggttagcttcactaaggaaacttgtgaatgcaactaatggcttaaatttgaggtaaacttgcaaagcgtgaatgaattttgagagcaaagttcggagaggagatgaaaatgagttgaaatgggatggattttcctcaactggccagttggcttaaataggctgcccacaacggtcataaccgaccgttgggacccactagttgttgcctcaaagaaagaggcacccgaccgttgccctggccggttcaaccgaacccctggtgggcccaactggccccactttcgaccgttggaacccaatggccagtatggtcgtggcatagcaaatttttgttgaaaattattttgttttgctctgaaaaaatcatttgaagtaatttcctcaaaactcaaatctaaatgtagttttttggaaactcaaacatgcattgataaagaatccaaattgata

SEQ ID NO: 57500 - DNA, 4004 bp, Oryza sativa
acagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacatagacacgacctaatgcatatcacccgacaattcccgaccgactgccgaataaattccgaataaacttttactaaatccctagactgtccctagtcgagaaatccaattaaataagcgaccaagatttttcccacaaatcaaaagaacaaaccccaaaattttcccgaaacaaaatccaagtgcaaaagggcatatgcatatgaaaaaaaagggttcagaggctcttaggtttctagttggcttgtcctacggtcaaggtcggctctgataccaacttgtcacactcagaaaattctcgaaccagaatttctaagctgaatgtgcattaaattcctgtctaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaagtatgatgcaagatataaccaaaggaagctaggggttcttttgtataaagcaggcatttcaaagcagtagttgaaagcagtaaaacagctgtagtaattaatcaatattaaccaatcactgtccaacgttacaccaagttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataacactcccctaaccatccacaccacgctaaggtttcacccccacccctcaaaatgcagtgggcggtcccctcttgcgccgcggtgaatccggcagctggacaaccgaacacctcggccgacccaactccatcacgcccaccctcgccaccggtgcctaggaaagggtcgagctatactttagatcaagcagttacccactcccgcttgtggtaagcacagtaagtctcccagggtttcccgtgaaccggtccttaactgccatgggtgcgtccagcaaaaccatgcactcacagcccgccattcagaattttttaatttactgacacccttgcggtggcaccaatctaaagctatgccaatagtcagagtatatgaaataatgtgacccccatttgtgtactagttgaactaagcatggctaagcatttcctaagccaacatctagtcattttgatacccaagttatcaatggcataaggtaaccaatatgtggctaaggaacaggacccatcccacattacattgtaaaagaatacaacatttaatagaaaaatgcgggatattggtaaattgggtacaatatgatcaaacgtattgcatgacttgccttgctctcgaactgatgagacctcagtaacgtcttcgagaaaccgcggatcgacgaaacggccgaaacctacacgacaaacaaagcacacaggcaaaacatgctataagactactgaaacaggaaacaaaaccatttttaatggattctttgcatttttcttgatttactgagacttgaatggacttaaacggacctcggatgaattacttatgaattttagaagataaactgtgtttttactaataaagaaaaagtccttaataaattattgcgcaataatacccagggctgacgtcatccaaggggggaggggcggcgccgacaggcggggcccatgggtcagcggctcaaaggggagaggaagggggcgccggcatgtgggccccacgggcagtggctcaaggtggccggtctaccgtggaccgggaccacgcgggtggtccaccgccggtccacaggaccgacggtccggatcggctgggaggccgatcggacggcacggcggcggctaggcacggctcggcttggcttcaaaaccggccgaccggccatggcaaccggcggtgacgcgcacggtcgccggcgacggcaatcggcggcgcgggaaacgacggcggacggggtacaggacggcggcgtcgaccaaaggcaacggcgagcgcgtggagagaggcggcgcaaacgagagagaggggaagagggagaaggggggatcctcaccggcgagtatggcggccggagcggaggatgaaggtggcggcgacgacctggcgatgaggaggggcggacgggcggcggcggcacctacggagggagttgagaaggattaggagtagagagagtgaccacggcggccaccattgttggccgggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggcccggcgcgcgaccggaggtggcggcaagcggcggcgctatggcgagcggcgcggcggcggtaggtggcacgggagagcgcggcgaaaagaggaaaagggagagggagatgcggggaagctttataggggctcgagaggggtggacatggccgggaaaccccccgatttggccggcgacgtgggggaagagagagagagtgggggggattcaaatcgaatcccgcccatttgcgggcgcgcgtgcgggcgggaatggcggggagggcggcgacgtggggacgcggagtaggggcgcggcgcggagcggagaaggcggcggcgcggacggtttcggcggcggttgccgtcgtggagcgggcggctggaggaaggggacgacttgacaggtgggccccacttgtcagcgtcccggagagaggggaaaggggaacgggccggcccaaaggaaggaggccgagcgcgggagggagtgggccgacggtccaatagggaaaaatgaaggaaaagaaaaagaaaaagaagaaaggatttttcctgggatttaaaattgcactttggtgatttttagttggttaaaattatttccaaggctctgaaaa

SEQ ID NO: 57501 - DNA, 941 bp, Oryza sativa
gggcgtagcgtgcgagcggttgaactcatgcaaatactctataactgttctggtccttgttgcagggaacggaactctctcttcttttgtgccacaattccctcgggaacctgtgctttattgaaactatgacaaaactctgtccaagtaacctctgccccagttggacgggtcaccatgtagttgtcccaccaaacagaagcaggaccttgcagctggtgtgtagcaaaagcaaccttctcttgctcgttgcattgcaaaagattcagcttcttctcaatggcatgaagctagtcgtgggcctcgatttggttggtggtgcttcagaaagtgggcggcttgacacaaagaaattctaacagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaaggcataggaaccaattcat

SEQ ID NO: 57502 - DNA, 838 bp, Oryza sativa
tatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaatatgggagccggctctcgatcaagtcatcatgacgagtctagcactcgctcatccaccgatgcctcaatggaggatgccgacattccacatctcttgaacgacgccgacctcgaccttgtcggtgactgggaaaggcaagcctactccatgctgaaagaccgggtgtttgctcacacgcgggcatatgatccggagctgctgaaaaaaaataggtatggatactgattttcgtgctatttgaaaagctgttggatggcagagatttgctgtagtagatgagcctggttctcgtttgcttactttgcaattcctgtgcaccttgaaagaaatagaagatggaattttcttttgcttttttccataaagaatacacacttacatggaaaggattaagtacacttctttgttttcacgattcctgtaaaatcaatcttaagaatggaatttctgggttcgagaaaaacagattttgggaagacatttctggtgctccaatttgcaagaaacctaggacgaatgacatccataatcctacacttaggcttatgcacaaatggattgcta

SEQ ID NO: 57503 - DNA, 1406 bp, Oryza sativa
tagtggaatattattattctaacacaaatatgtattgcaagtataactagttctcctttattttggtagcattgatgatcgaaatcgatcgctaacgaccgtcaatagagcccgagggagattttcatagtgattggaagatgagatcaagatcgagctgtgcaggaatggctggccacggagagaggcgacgtgggcaaagaatataggcacggttcgtctccggatttcgggggaaagtggaggagaaggtggaggacgtgaaggggaccgcgcccatgaagttttagcgtgagaaaggggacgggcacgcaggattttgctggatgtgggtgccgcggcggctatggcagtgtctagccaggggaggaagaatgccctgacaagtgggcatacccgtcggcagcataggagagaggagggacgtgaagcagactttgtggtagggagagaaggcaagctgtgctgggcgggagcaagttggctggcagaggaggagaagggatggaggagtggagatgggctggaagtaggagaaaaagacgggccggaaatagcccaaggaagcgatggagagtttaatttgtcgttcaatttaaatttaattaatttcttaaatgaacattgtgatattaaaattatttcttgagctctgaaaattcacaggaaatttcaaatagtactttagggcatgcagaatattaaaaaaaatatttctagctaaaattttgaatgaaaattttattttccacattattttcacttttaattagctttaacttttaatataaattgtagaaatttattatttaatgatttttagtcctgaaagaaaattgaggcgtgacatgttttccatgcaattaaaaatctatcatgtgtacatgtggtatctctgactgtgtattccttgtaatcaaaaaaatatcaaagaacataacgaaggatcaatattaagtgcacatcatctattatggatggattagttcaaaggtgccaaaaggtagagcaacaaaattaaaccgcacgtacatgcagattagtcagaaatttatgaaaataccttcatgatttaattacagatatggtggccgagagtggatatttctgggtgcaaacgaatttgtggattcatggatcaaagccttgagcccttgaccaacacctgtacgtgcacaatttttatggccaaagagcaacattggttgtgcgtctatgtatggttatgatattaatctacggtcacgatattgtaatgcatctattcaatggccagatttttttttgttaacatttgagctcgtagaatgtatccaagtagtataggtctagatagacagacagacagatagatagaaagatgtaagatagatagatagatagaaaggtgtaagatagatagatag

SEQ ID NO: 57504 - DNA, 3572 bp, Oryza sativa
ggtgtaagatagatagatagatagatacattgattgatggatggattgatttagcatttttgaaaccaaataaaatgtaatttaatagaaagaaagaaagaaagaaagaaagaaagaaagaaagatagatagatagatagatagatactccctctgttccagaatataacaagttttagggttggacacagttattaagaaagtaggtagaagtgggtgatggagggttgtgattggatgagtagtggaagtaggtgggaaaagtgaatggtggagggctgtgattggttgggaagagaatgttggtagagaagttgttatattttaggacaaatccttaaggctaaaaattgttatattttggaatggagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctaggtcaaagcacaagcagggccccggtgggagttagcattggagaacttaaacttagtgtttgcttttcggcccctccatcgtggtcttgctgttcaaaggacaacctgtgctatccatcacttgaggcatgcctggaaaagtgcaagtacgatgaataggcacgcagccgactcagaggctaagtgctcgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatttcatttcataaatttcgttatcgcacataaggacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaactttcagttttcctgaaacttccatctccaaaatcacaaaactttctcttcaaacatatgaaaacattcatctgaaaatcacattactttccaaccgtatctaaaacttttatctaacaaatcataacaactttcaattcaactataaaactgtcatctcgaaattgcacaaactaatgattcaaattaaaaacttctaggcaaacttcataaaattttcaattgaaaaatccaaaaattttcatgctgtactcaaaatccctcttcctcctcaacgatcgtcatccttgtaataacgaccgcaattatgaccaagttgttcattcctgctattgccgctcctgcacggtgtgtggcagcagtggcgagggtggtgtctccatgtggcggctagcaactacaatgctgcccctggtggctagagttgaggagctatggcatgggtggtgcagcacaatatattaggcgaacttctccaatctgttgatatgtagatatggcacaaaatgttgaaggaacaacttcaacatgctagtagataatgccgtaagggcaattgtgaaagatctcgaatccacagacagcaagagcttagtccaaagctccaagaagatttaatccaagttgtgaaataggaacatccagttgtattggtaagttggtaaacggaagtaagctacaaacttgagggcatcgcctcaatttataggcttcaaaaccccatgtacaactcataaacaactatatgataactagatgacaacctatttgataagtaggatgttactcaaaacaatccatctattactcaatgacaccaagaacacaactcaaaggacatatatcttctagttctagcagtataaggacatatgcaatgacatcgtaattattgttaagccttcatgaagcatgtactatagatgcaaaactcaaattgccttcttgttcttagtcaaaaatcatattttgctcgtaacacttatactttttgaattggtcgtctaatgtccctcatcaatgggggtacgatatggccaaaggagttgacccagggatgaagcgcggctgggaacgtggacaaggatcatggcctgacacaagcgcagattgaagggcaacgacgagcagctctactgatgctgtcgattggaaacattgaagagagaaggaaagcagcgaacgaaggaataagaagagggatcatactcctctgccccccaccccgatgggctagatgggctctaaacatgcacctgtggtgcagctgtgccaaataggaatcttgcaatacatatactgcaaatcacattttaccacgaaagattttgctggtatcaatgtgtgccaccaacatattccagcactatgactgtccacatggcatgttgaacagtggggatagtcgtcaggcactacaagagatcttatgataggtgacattttatttatgtcataataacaaagagttatgtcatgttttgaaacctgtgactctcatgtgatgaaaatccgttcgtcacagatcatgcgtctcgaatcaggctctacgacgaaacatacttttttgtcattaatctagtgatgattcttctctcgtcattaactctgcattatcttgcaaaaaaaacacaaaatctcttgtgcctaccaaggtccatgtagtatgcaacatgtttatgggcctcagcccaattgcaagcccaattagattttgggcctaacctatataaaaagaagtattttattcactattttcatcccaattatattttatccaattttttttgtgtgaaataacaaatggttgaaccccatttcaaaagcccatataggcccaagcttatacaagcccagataacatccaatagcataaatccaatatacaatatggcacaagcccaacatcccatataactcaagctcaatgatatacgcacaaattca

SEQ ID NO: 57505 - DNA, 652 bp, Oryza sativa
ggtgttggttaattaaaattaactaaatggtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtgatggagtttggatgggccttgcgacggcctatgtggcttccggattcacctaggcacgagaggggactgcccgctgccttgcgaggggtgggggtgaaacctgtggtgtggtgtgcttggttagagggggttatgcgaagggtcctgtcacggtctctatccggtatgtcgtggtggcatgtcggtgcacagaaacgtgtcgtggggctgtgtcttgtgggtacatgtcacgcccggaatttctatccaaaattccaaacgcttacatgtgtgtaaaccctcgttcaggaatcagccgaggcacacaataacaaagataatagagtaccattattactctaattaattaacgaattaaatgtcattacaaaagtagataggtcctttccatccattaagatttaaacagcggaaaattagaataaccggggcagaggacttcacttcacaggcaa

SEQ ID NO: 57506 - DNA, 552 bp, Oryza sativa
agcctgcgcagacacaaccctgctccctacccccttcgaccggatctaggtgggagggggcaaccacgctggggtggatgtagccacagccaccaccttccagtcgctcccgttcatctagatctggaagggaggggagggaacccgcgccgggtaaatgggaggggaggggaaaggtgggaggaaaaagagacttaggctgtgtgaaatttgcatgggtaggtggtgatttttatgaggtataaatttttgcaggcgaaccttttacaattaccctacaaaaatacccttatttttacagacggacctctagatccacctgcgaaagctaatttttgcaggtgacactagatttatagtatctttagctattttttataaacggtgattttatagtctgccagaaaaaaaaatcataacgttgggaaaaataatttttctagtagtggtaactagtgggtgcaatcagtcagacaatcaaatattttgaggaagctagttgtcagttaggtgtgtggttacagttttcagataataaaagcttttattgaa

SEQ ID NO: 57507 - DNA, 679 bp, Oryza sativa
  unsure (1)..(679): unsure at all n locations
agagttgcaatcctctttcataatatactattttgatgacttcaacataccgctgtagaaataccctcccaaaactatattttctttcttaacatggaaaacatacaacacctaatgcataattttctggtgaactgtttttttcctctaaagtgctttgtatgtngaatgtaggtaagaggtatgcgacacnagttgcctttttgttttagaaagggncctaacttgcancttttacccagaggaaattgaggggaccggtatcgtcggaaagaaccctggcaatggcnnaagtcaactttgattcaagcaccctattccgcatcgtcgaacccatgtannttgggcaagtgttgatagaaatggccttgacnatttgcaccattnggactacatgnatctacggacaagattgagcatcattcctcaagatcctgtgatgtttgaggggaccctacgaaataacattgaccctttggaggagtacagcgatgagcaaatctgggaggtaattcttattttaaatttactagtacctccatccctaaataacatatggaagacaaattactatagaaaatacatgacattcataccccaaattaaatgagggatggattgaagagaaagggtagttagctttagaagcatacttattttggggacaaaacttgagtgt

SEQ ID NO: 57508 - DNA, 921 bp, Oryza sativa
ctttttttctcagctccaaacttcaacttcctcacttttcgttcgtacgtttttcaaaccgttaaacggtacttacgtttttacgtttttagtaaaaagtttttatgtagaagtacttataaaaattaaataattttttttaattttataatagttaatatttaattaattatgtagtaatgagttttctcattttacgtgtgttaaaattattcctcgaactcccaaaaatgaaaaaagaaaatattcctccaactggtgccaccgaatggagacttagtgttctggaaccagtcaaccagattggtgataacaagagctgacttctttgatttttactgatcatcgtttgagcgtcacagcatacgcacacatggcaatcagaattcagagaggaagcagtcagtctaatctccctaataatgtatatgcacaagaaaacaggtacaagtgcagattgaaacaggtacaagttcagattgacgtttttttttaaggggaaggacggcaggacatctgccggaatttaacaatagagaaggtatgtcctgtttgataaagtaagctacttcggtttctgaacaagaagagtttgggaagattcttctatttctttctaaccaaatattcaaccaggtagttaacaacgagcctctaatcgcatgcgcttgctctttggaacctgcaggggtcagattttggaattggcaaactaggctccaaacttgtctgacaaagacacattcactgaacagatgatgtatcttcaaaagcggtacagagacaacatatccaattgcatgattagtgtctccggagcaaattctgggcaataagggtttttttttataaagaattaacaatccaaagaatttcatttttggttcaaccagggccctccatagagatacaaaatcattc

SEQ ID NO: 57509 - DNA, 2097 bp, Oryza sativa
caaactttcaatttttttcatgacatcaaaactttcctacacacaaactttcaactttttcatcacatcgttctaatttcaatcaaactttcaattttgacgtgaactaaacacaccctaagacatgtgtcatcgactactaaatttatatggttgtttgagttagcaacttagcatacgggcaatatactaatacctcagacccacaaatacttgtactggtagaaatgaagttttttgaatggagggtaattaattaccgacggagaaaaaaagagaatggcttggctcgactatgatcacacttttcaaaccagaaaagtatatgaattcccgcaaaaaaaagaaaagtatatgaattcttgtccaagtatatgaatttgactatccaaaccagaaatttcatccaaatatagcttgccaatcaagtcaaacaaagaaaaatcgccctcttcaggcaaactgctgagttcaagtgcagactaatctcatacgatttgggggggccttagctccataaatacacttcgtctccttcggtccttcctcctcaacaccaaccagacagaacagaggacaccgctcacaagcaaatacagagtcgagagtgagacttgaggcagaggccatggccggaggaggagacgagctgaagctgctgggcatgtgggcgagcccgtacgttctgcgagtgaagttcgcgctcagtctcaagggcctcagctacgagtacgtcgaggaggatctcatgaacaagagcgacctcctcctcagctccaacccggtgaacaagaaggtgcccgtgctcatccacaacggcaagcccgtctgcgagtcgcagatcatcctccagtacctcgacgaggcgttccccgacgccggcgccaccctgctccccgccgacccccacgaacgcgccgtcgctcgcttctgggccgccttcaacgacgacacggtacgttggtaccatgtcacctcacatcgcgatcatccgcatcgtctccgactcttccgtttttgattcaatttgatttgttcgcagctggtggaggcgtcgccgcggcgtcgtgggggaagacggaggaggagagggcggagggggagaagaaggtggtggaggcgctggagaagatggaggtcgggctgagggagtgctccaaggggaagcccttcttcggcggcgacaccgtcgggtacctcgacgtcacgctcggcgccctggtcagctgggtgcacgccggcgaggccctgtacgggatgaggctcttcgatgccaccaggagcccgctccggacgcgtgggtggaccgcttcgccgcactggatgcggccatggcggtcttgccggacgccggcacattagccgagtacgccaagaagaggcaggcggagcgggcagccgccgcggctgcgaacaactgaactggcatgcaggggccgtggttcgcgacgtggttgggcctcgacgatgaatttggtgtcatggtgtgccacttgtagtcccgtcacatgtggcgatgtgggctttgtttgccacgtgaatttgttgtctgtctgcgttcttacggttggatattgttcgtgtggttttggttagcccgtttcttccaataaatggaattattaatttttagaggaacaagagtgaacattttttttttcaaagatgacgaaaattattacatcctgggcttttacataaggaaaagtgtagttggactaaatcctagttacccttaagtaataaaaacaactgaaagccaaaaaaatcacacaaattttaaggatttagcaaatatatgttagctacctgagccaattattaaacattttggtttattattaaaattggtagtgaatatgtctcttgcatattgcgaaacccatatttctctcgctaaaatttattgaaatggctagaaatcaagtaattttaaagtggccagacgagacagtcgtgcccgctacaggacatgggtgcctctgtgatggcacgacagagcctgagctggagccacggatatgatgtggcgagctaatgggcactcgccatgtgcccccactgtaaatggccttattgcaccatttcttatgtttc

SEQ ID NO: 57510 - DNA, 1295 bp, Oryza sativa
aatagtgttaattagagaaaagaaactagtacaagtggcgtctgggtgagaaaggtctttacaacttaataacatggcccaatgaaaataattacagatttggctgtgaaaaaaaaagagagaagactatactgtgcgggacaatgaaaaggtacaccaataatatattagcggtcataatctaataacaatgcctattcgtaaataaattttaccggcattaaaaagaaggtaccgagagataataaatttgatacgtgggatactgagaggcatcaaattttaccagaaaggctatttctctttggtacctttttaagagagtatcgaacattttaagataagtttatgcatatgtatgcatttaaaataaaattgtaacaattattggggaatgctatacagcacgagattgtgctatttcactagatataggcgtaaaaaaaatacatcccctagaggcaaaaaagagctgtacaaaattacataagcgttgtggttaagttgggaggaattctccaagtcaccttgtgcctgccattattcaggttcttgactcttcctttatttttgccataaggttgggggctaccgtttccttgtgctcgaagatcctttagttcctttctttctagatttcttaggctatgagtaggattaaggatcgcagccctttcttgggcactttctttttgttggctagcatttcccaccattcatgtacgctttggcatggctcccaattgctcaggtccaattactgataagccacccagccgaccatcagtctccagatccttctggtgtatctaaaggaagctaataggtggcatgtcgtctcgttcgtcgtacggcatagggggcacactccgctatttggccatcctcttgtagctagtcgatcggaagtccagactctattttgaattacaagccacgcatagaatttgcattttgcaggagcccaagatttccaaattaggggattaaagtttgtgccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgctttcgtttaattttttagaccaggttagcggatcacatgtttcaatacat

SEQ ID NO: 57511 - DNA, 1881 bp, Oryza sativa
cagcggaaccaacgggctaacacccaacaccacagacgacggctgggaaccaggacgaaaccctaatcttcacttcagttcatcttcacttcaaggcagaggaactatatactcaatttcaacaatggtgcccgggcaccatggagcaccaaacaaatgtactatatatatatatatatatatatatagagcaagggtgagtaatttcgtactcagcaagtcacgggaatttaggtgtttaatgcaagcttggaagagaggcaaggttgttttgcaaatcctttgtttgaaatcatttttgaagtcactaagtgatttatttctttttgagtttggatcgaaaagagacttacgtctcgatttgacttaagagatgcttttcaacaactcaaatggtaatgtaccgacctcccgggtcagatcattacttatcggctcccagagccatttcacttgattaatcggctcccagagcctttttcattttctcggactcccagagtccagctgcccagcagcacaacaatccgcttccactcaggaagcctagtctatgatgcccgcagacatcccgaatcacacagattcgtttccgaccactcaggtcatccatttgccacataggctgattctggtaacgattcccacaccacaacaacttttcacaaagcacaggcaataaaatctacgcaacgggaaccacctcacatctgcccatgaccgtgggcacggctgttcgaatagttagttaacctctgcagaggggtacactttacccacaagacacgaacttagtccagacactggccggtatcagaggttcgcgacaaagcctttctcaagccgacccagggttacctcatgccacatagaaggatcaaatcctcacataaatacaggccattctaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagctagggtgtcccattccaccttgtggttgcactttgatcatgttcgatgagtttcccacaggaatcggtccttatatgcgaatacgggacagtgccacataggcacaacccccgtatcgcgagttttcacaattcattttattttcaaacacatcgacaccacatgtctagttttgaagacttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtaacttgccttgctcaaggtcttcacgaagcttcacgaatcttcgagaaaacccgcgatcgacgaaaatccgataaccacaactatacgcaaataatcgaaaacctaaacaaaagaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccaggaccaaggaaaatgattcatggaattttggaataaggaat

SEQ ID NO: 57512 - DNA, 1355 bp, Oryza sativa
tgatccaagagggtggttgaacactattacatcgattggttggcgcgcaaaagggcggctacgtattcatagggattattgtctaataataatataatataaataacaaattagtgtaaactctatctaatgcatccattattcacattcacatttgttattttttaggccgggcccgcttacatctgatagcttataggtcatagactgccctcacagaccaacacatgcagccgggaagaatttcccggtcggtcacccatcccaaattgctcgggaagaatttcccggtcgatcacccatcccaaattgctctaggccaagcacgcttaaccctccaggccaagcacgcttaaccctggagtttttttggagatcggcttccggaaaagaagcttaaccctccaggccaagcacgcttaaccctggagtttttttggagatcggcttccggaaaagaagcttaaccctccaggccaagcacgcttaaccctagagtttttttggagatcggcttccggaaaagaagttgtaacttgttaatatgagtattctattaatcctattaagccctaggccgggatgttacaccctcacccccttaagagagatcgacgcccccgtcgatcaaccccgccctggagttctttggagatcggcttccggaaaagaagttgtaacttgttaatatgagtagaaaagaagttgtaacttgttaatatgagtattctgttaatcctattaagccctaggccgggatgttacaccctcaccccctgattcccggtcggtcacccatcccaaattgctctaggccaagcacgcttaaccctggagttctttggagatcggcttccggacaccctcaccctattaagccctaggccgagatgttacaccctcaccccctgattcccggtcggtcacccatcccaaattgctctaggccaagcacgcttaaccctgctctaggccaagcacgcttaaccctggagttctttggagatcggcttccggaaaagaagttgcaacctgttgatatgagtattctattaattctattaagccctaggccgggatgttataattttaaatgtattaatattgcatatttccaaagtgacgcagacccacctagtttgtaaagtaatattactaatttgaattgtattcttgctaatattgtagttatagaaatttgactatgggggtgttaagatccggggtgtaaagttttggcgtgtcacatcgggtattatatagggtgtcgcatatggtgtttgagcattaataaaaaactaattacagaatacgtcaataaaccgcgagacaaatttattaagtctaattaatcc

SEQ ID NO: 57513 - DNA, 669 bp, Oryza sativa
catgttgttcttgaccaacccacggcgcaccatctgggggaagtcgatacgggccgcgtcgtacgcctccaccatgcgcgccaggtgcatgatggtagcgtcatcctccgagctagcatcttggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatctccacccgcggtgactgccaacgaagtcctctcgggtgagccagtgaggatcactgcagtgacctcctaggcagcgtggggctctgcatcgtcaccttcctgctccaggagctgcttgccctggtagtccactccatgcggataccccaagacaacgcacatgccccgcagctccaaaacgaaaccagtcaggtccagaccacgacggttgatgctgccggccatctacaaacaaaaacaaaagagaaaagcaacattttaaaggtcagattttgacgataaatgaagcagcaggacagagagagactagaggattttcacaaataagaaaggatttttattttgaaaatattgctaaggcttgggatctaaggcttcgtctagggtcaagctggctctgataccaac

SEQ ID NO: 57514 - DNA, 1726 bp, Oryza sativa
tctgacccgggaggtcggtacattaccaaatgagctgttgaaaacatctcttaaagtcaaatcgagacgcaagtctcttttcggcccaatcttagaaagaaataaatcacttagtgatttcaaaatgatttcaaacaaaagatttgcaaaacaaccttgcctctcttccaagcttgcattaaacacctaagttcccgtgacttcggagtacgaaagtactcacccttgctctatataaatatatatatatagttcctccaccctgaagggaagataaagtgaagtgaagatttgggtttcgtcctggttcccagccgtcgcctgtggtgttgggtgttagaccgttggttccgctgctgctgctgctgttggtgtttcctcgtccgcgtcgtcggttgtattctcgggctgtctaagctgcaacctatgttaaggtaaataagtcctccatttattttaaggattgctatgattcatatttgtcaccgtgggtgccagcactatgtcctgggactggtactgagatcgcagtttcgtaggaagtggtttgcgccgttttccctacgacacgctcctgtcaggtgccgttgtacggcggtatcagattggggtgtgacaatttaactagtatgtattaatgtaaagtcaactaaccattgtaggggtgggttttttttttctgatgtggaatacatgagagccccctactggaccctacctacatgacctaatcattccaccacacctagcaagaggatggtgcatacttacaactgaaaaaaaaaggcgtggtgacactaatgtttgatctgattaattatttgaaatgctaccattttaagcattttcatacaaagaagaccatatgtgcacattttcattcaaacgaaaaacatatgtacattgcccatttttcacccacaaaaacaatgttgcatggaacatttgattgtggcaacaatgttgtattgatttttttttttgcattttcaatgaaatacatctggtcatttccatgaaaaaaattcaaataatattgtaaacacattcccattaaaacatacatttccaaatatgcacatttaatttccatgaaacatgtgcaactccattgtacaaaaacatatacatgttgaaaaaataacaactgcacactaccattcaaaagaacacttagcatcactctttattgccccccttatgttttctttttcagaataacatctgcattttacatccgtatgttgcctattttgtttcaattttattataactatttaaacggcatgtgagaaatgatatagttcgccattgcaggcttaaaatcatttgtccaaacatcatatacaatatatgataatgagaaaaaaaagtctctgctacatcaatttttttatttaaaagaggcagttggtgttggtgacgatgagtttgccatcatacactctcatcaccaactaaaatacaggggccaataaagattgagacatacataccatccattcctgaagttacgaaggagaggtagtaatgcatatatacattaattatttccatgcagattaaatgttgatagaaaaatcaaagatttttataggataaattatgatgacacgagtcatatacgctaaatttgatatgcacttagagaaaagagaaattttacggtccttgagaggtagtactgtgcaaatttccattccttactggaggtactaagagataa

SEQ ID NO: 57515 - DNA, 1305 bp, Oryza sativa
tgaaaggggtcaaatttagaggtagtctaaatttgagaagattgatgaatgaattggaataaatgtgtgagggaacgccagtagaattgagagacctagctaataaatcaaaatttggagagagtgcaaaattaagaagattaggaaatagttagaataaatgcgtcagggatttctaataggattggttgtcctaactgatgtggttggttttgactatataaatactactagaaaaagatagcaattacgtacctaagatacttatgtggagaaatagaatgggttttagaatttctactttttcatctagagtttagttggtgagatgacatatcactactacaaaacgccggttcttaataaaaacaaaactgacacccaaatattgtcagtcgcatgtaccgtttttcttttataaaaatcgacacatataataaccttataggtgccgattttttaaataaaacgacaccctaaactgttgagccgagtcgatcgaccgagtcctttcgtccttatcctctcctcaccttctcctcccctcccacgactctctctctctctctcaaacttaaactcgccagtggaggtggcagtgtgcgtgctctcgcgaatcctaggtgagcgactcctagcggctcccacgcggaacgcgggcatgtaacgctccgctttttgcgtgacgttaaaaactaattcggcaaaatcctattcgcgaaaattttcgttctttgtgtgagagtctaagttgtgccaaggatctcaatttaatcctgttgttccctctcattgaaatcaaaatcctccacctcgaaaattcctcttccgattcgagtctccgaaatcaaattccgagagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactccctctcatccaaatcccaattcttgaagtcaatctctcccttccttgaactcgttgccaaatctttctcccgatttcgagagaatcgatcctcatccaaatcatttccttgactccaccctatgttcccgagaacaaatacccaagtattccttttgaatcttttccatgacttctcctgagtttcccttgatacatccctaaaccctcgagcccgaatatcaaatttgaattggaatccaaaccctaaatctcaaacaattctatccaaatcagaattctctgtgaaagt

SEQ ID NO: 57516 - DNA, 1982 bp, Oryza sativa
  unsure (1)..(1982): unsure at all n locations
tagttggttcaagtctctaaatttttctaaaattgagatctacatgttaaaaatatccacatgtactgttcatgcttgtttatgtgctgttttggtgattttgctcttttcttcttagattccgtcgttaccggagagtccgtttttgcagaagaagaatttgaagagttccaaggccagcaaggcaagtcacacagatcccaaacaaccctttgagcatgttgatcctatttaaagctattgtttctattcaattattgcatttattttcgaatgtcattgggtggaattaacctattctttgttatagcccttttgttcttgattactttattccttgataccttggggtaatataacttgactagttgaactttatatatattggttcagctagatattagatatgattgcttagccatgcttagaaatattagcacactattgggataacttatgactcactattacttaacgatggcttaatgatagttcacgatgttctatcatgattggttaattaattaatgtgccaactaaaacctgataatggtgggttgtgagcacatggttttgatggtcgtgctcatgacaattaaggactggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtctatgccttgntataagggggtgattatctccaggaaaggtgcgctgcagtggattgtgttgtacgagaggtattgtcacaactcctttccgaggtaccggggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccataataaaaggtgctttaattggtaataatttgattagctcctggtttggagatagaactgtgcagccgggatggttgttcagaatggttgggcctatacaacagggtatgttgtatagcgttggattaatattgtttaatacttaactgttttattaaattctgaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacagtgatgctgatggtgtggaggattaggtgtagccttggtcaagctgcctgtggagtggagccgtctgcgccgtttatctttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgccgcccgctctcggagaccgcctctcgtcgccggacctccacggcgcctccccatcccatccgacgccacaaacgggatccctaagtcctagagatgctcccacccctttgaatcgaactcccgttgccccggtgagatttccccttctctccgccggcgatggccgccgccgcaatccaccaccgtcggctcctttcgctccgattcctctcgctgccacgctcccggggatccccttgacctccccctggctgccccaaggccgccggccttctcctttgtctccgcgtcgtgtcgccgtttccgccgccgcataacaacgccgcgcgtgcatcgccggtgaccatcgggtcccgcgtcaccgcgtgcgcatcacggtcgcgtaccgtttc

SEQ ID NO: 57517 - DNA, 2315 bp, Oryza sativa
accagcgataaaggagggtggggttggagagagatccaaacttgcgaatcctagctcagagcagatctcgccggcggcggagcttttcctatcaccggggccaggtgcgctttcctcttctctccgcctcccgcgaaacagttacgctaggtgttttggttgaggagagagggcgctcatatttgagttccgcctcggttggcacccaaagtaggtccttagtatgggtactctgttggaccctgtttttttccgctacagtagcctggagcacgcattttgggtttggttgtcgctatgcctaggctgttggagatagtctaacgactgcgtttatgcaaagcaagggcagtgaaagttgcaatctggatggattgtcagcatctcaaaacttacagggtgatggagaatagtattgcatagtagtggtgggcaagaaaaatggaaaactcaattcatgctttaaggggatatcccctcatttttacatgttacttaaaatgtcataaaaaattgaaaaaatttagtaggatagatcaatatgtgatatgtcactttacaaacatgcatattaaaattcaacttatacaagtagaaacaaaaataataaatttgactacgaatagaacgtgtaattcacagtcaaatttgttatttttgtttcgaattatataattcgaattttagctcgcatgtttgcgaaaagatatatcatatatttatctatattgataaaattttcaaatttttttataactttctgaatgctatgcataaaacgagtggatatcctcttgagggacaaaaatccacttccaagaaaaatcaatgaagtatattcaaaacaaattggtcactggctgaatagtttctacatcagttaaccctgcaggcagaggcaaatctctctctctctatatatatatacaccacctatcatagcttcgtacctccaaaagacaaggagcccaacaaaacaaaagccaaaagctccaatccttgggacgtactactgcttaggcctcagagcgttggatagccatggccggaggaggagatgacctgaagatgctcggcgtctacgtgagcccattcccactgcgagtgaagctcgcgctcagcttcaagggcctgagcttcgagtacgtcgaggaggacttcaagaacaagagcgatgtcctcctcagctccaacccggtacacaagaaggtccccgtgctcatccacaaaggcaagcccatctgcgagtcgcaggtcatcgtgcagtacatcgacgaggtgttccccgacgccggcgtcaccctcctccccgccgatccccacgatcgcgccgtcgctcgcttctgggctgcctacattgacgaaaaggttcgtcagatcaccatgcacttttattgattacttgatttctctcttatgtttgtgaattaagctgattgatcgatctgcgtgtgttctgtgcgttgcagctgttcagtgcgtggattctggtgttcagaagcaagacggaggaggagaaggcggaggcggtgaagcagacgtttgcggtggtggagaaactggagggagcactgagcgagtgctccaaggggaagcccttcttcggcggcgacaccgtcggctacgtcgacgtcgtgctcggaggcttcgtcgcgtgggtgcacgcgatcgaagaggtgttcggcctgaaccgtttcgacgccgccaagacgccgctcctggcggcgtggttggagcgcttcgacgagctcgacgccgtcaaggaggtcatgccggacattggcaggctggtcgagctcgccaagatgaggcaggcacaggcagcgggggcggccgcagccgccgcgggtgaggccagttgaagtttgctgaatcctggaggggagtttgaagtttgaaacacaaccatatagattgtcgtgtgcttccacattttcgcagttcctatggctgtacctcgtcttgtttctgcaactatgttcatcagttcgtattgccgcaccgtgtatcttcgccatgtaccgtcgcagttgccaagtgggaagtggctattctaccaagatgatgtatgatgtgctacgtctatattaattcatacgttgatttgtttcaataatatttgttcaaataaacttcttcatacaaatgtattttttcctactcccattttcatttctttttcgaaaggccgtcacccaagacattatcattcaagaggtttgctctggtctaacattgacacccctaggtactggtattggcaggtaaaaaacaaatccaaccgtttaatcacgaggggtacaatcgagaacgaa

SEQ ID NO: 57518 - DNA, 1774 bp, Oryza sativa
atctgtgtgattcgggatgtctacgggcatcatagactaggcttcctgagtggaagcggattgttgtgctgctgggcagctggactctgggagtccgagaaaatgaaaaaggctctgggagccgattaatcaagtggaatggctctgggagccgagaagtaatgatctgacctgggaggtcggtacattaccaattgagctgttgaaaaacatctctcttaaagtcgaatcgagacgcaagtctcttttcggcccaaacttagaaagaaataaatcacttagtgatttcaaaatgatttcaaaacaaaagatttgcaaaaacaaccttgcctctcttccaagcttgcattaaacacctaaattcccgtgacttgctgagtaggaaagtactcacccttgctctatataaatatatatagttcctccgcccggaagttgaagatgaagtaaagtgaacattagggtttcgtcctggttcccagccgtcgcctgtggtgttgggtgttagtccgttggttccgctgctgccgctgttgttggtgtttcctcgttcgtgtcgtcggttgcaatttcgggctgttctgagctgcaacctaagttaaggtaaataagtcctctatttattttaaggattgcaatgattcatatttgtcaccgtgggtaccagcgctatgtcctaggactggtactgagatcgtggtttcgtaggaagcagttcgcgccgtttttcccacgacacgctcctgtcaggtgccgttgtacggcggtgccagattggggtgtgacagttgactacttaagaaattttatatatattaatgtgtagaaaatacaaatgaatttacatcataatataaaattatattgatgctagccgcacaattacatcataaatttatatagatgctagccacttgattgcgcaaaagcatattctggcacacaaacttcccgtgtactgtccgtgcacaccaactaacaattatcatggaaagttcttgaaaaaaattggatttgtgctcctaataatattacacatctttgcaacgtctgatattcaaatttattatattttaaccataaaaaagaaaaatctaatatttttaagaataaaaatctatcagaattttctcttttgttatggctaaaatataatttatttaaagataaggtttcacatataagtgtaatacaatttaaagtatgtgtccattttcttctagaattttttatgatatttgctagttggtgtgaatggaaagcttgtatgcataggatatggtccatgattgacctaacctactactttactttaataacaaataaattaacactctctatttcatattataaatcatttttattctttacttagtgaaacttctttaaatttaattaagtttataaacaaatatagtaacattttcaacaccacacaaacatactatcaaaatatataatcaatgttacattcgataaaactaatttggtgttataaagttactaaatttaatctgagtcaaacgtaagtttgatttagaaaaaaatatataatatgccgtcccaaattatagggcgccctcttttttaaagaaaaatcaaactcgataacttttggactcataatcatactaaacatatatatgctaagtattatgctttcatgtgttgctaagttcatattcgttaggaatatgatatggaataattttttcttgaactagggctttggaaagccccaaatatgtctctgaaaaccgtgtaaaataatata

SEQ ID NO: 57519 - DNA, 4352 bp, Oryza sativa
atcggcctaaatgagcaccttttattaacaatatactttttacatacatacgtatgtaatagttagtggcacatctacattgcaaaagctataggaaaataatcaatgtcaatgtcaagttgcaatgtgaaggttttctgtcttatgtctcagcttatggcttttaacagggataaagttgctgcttgtgctaagcactttgttggtgatggtggaactcataatggaatcaatgagaacaacacgatcactgatgaacatgggcttctaggcattcacatgcccccatattatgactctattataaagggtgttgctactgttatggtttcctattcaagcttgaatggtgtcaaaatgcatgccaatcatgatctggttactggctacctgaaatccaaattgcattttagagttagtattaataataagcaacttatttaaaattcctcttatgtgataaaaaactgactcttcatgctctctgatcgcagggatttgtgatatcagattggctaggaatagacaggataacgtcaccacctgatgcaaattatacttactctgtgcaagctggaataaatgctggtattgatatggtatgtgaatttctttcaagaagattagttcatattttcatactagctacaataagcatggtttagtttaattttagtcaacattcatatcatgatactggaagtggaactggtcttactactttttttttgtggggggaagtcttaatacttattataccaatattaagctggaagtttatttcgttctttttattcagaaaaaaagaatacatcatttcatctccataacaggtcatggtgccattcaattacacccaatacattgatgatgtgacatctcttgttaagaagggtattatcaatatgagcagaattgatgatgctgtcaggcgtatccttcgagtcaaatttataatgggcctattcgagaaccctttagctgatcttagcttcgcagatcagcttggaaagaaggttgataactacaacatgctgtatactccacagagtaaatttcacaaaactacaaatactttggttaaattatcacaaaaccatagatttaaagtgatgtaacacagaactacatatttaacaataaatttatcacacaactataagtttaaggctaagtatcgcaaaactacagatttaataataaaattattatcacaaaactacaaattttggggtttaaatccttagcactaatgttatgttggacttataattgttttaaattttgtgattaaattatcattaaacctgtagttttgtgataactttgttactaaatctgtagttttgtgatattctaccttaaatttgtagttttgtgataaatttagtgttaaatctgtagttttgtgatgtatcaagttaaatctgtagttttctgataatttgatcaaagtatctgtagtttcgtgaaaattactctacacaattgacaagtttggaaatcatccaagtaaatgagtaactaatttaacaggagcacagagatttggctagagaagccgtcaggaaatcacttgttctattaaaaaacggcaactctcccaatcaacaattcctgcctctaccaaagaaagctagaagtatccttgtagctggaagccatgctagcaatttgggctaccaatgtggcgggtggtcaattgaatggatcggaggtagtggagatattactgtaggtatgtgttttttctatatatcatatattcttttcttttaaaacgaataaatctactatttcaggttcttatttgctaaattcaactatacttaagaaaagctattttgattttttttccttactgtaataattaaatgcatttattctgttcaggtacaacaattcttgaggccataaagtccactgtcgctgattcaacacatgttgtctactctgagaaccctgatgaaagcttcatgaaaaacaatgacttctcattcgctattgttgttgttggtgagcgaacatatgctgaaacaacaggtgatgacccagaactcaccatcctagaccctggtacagacacaatccgaacagtgtgttccacagctaagtgtgcagtggttatcatctctggtcggcctgttgtcattgaaccatatcttccaatgatggaagcgctcgtcgcagcttggcttcctggaacagaaggtcagggtgttgcggatgtactgtttggggactatggcttcaccgggaagctcccacgcacttggttcaagtctgttgaccagctgcccatgaatgttggtgacctacactatgatccactcttcccttttggttttggtttgacaataaattcatcgcagccagggtaagtaatttcatcaatcatccacactaatgcagctcaaaatctaatcctaaaaatctgaaaggcacactagttcgaatcaatgctttgtggtttgaccttcatattgtttcatgttttcaggttctctggtgctgacagactgagagataggaatggggggatgatatacgttgtgttgagtttggtactgtcagtaatactgatgcatgcttcgggcataggtatattttaactcgagttgccctttcctagtcgtagtatggttccacatcaagtgctccatgcctccatcgttatacgttgtatgtactagctctatggagattttttgattgcaaagatgcatttatccctaaagctaggtgggtcagtgggtgataagcagatttgttctttcacggttttaccaaattatgtgtggttataatagagcatttttatctagggaggacaaagtagatggattatgctctgcaaatactgatgggcctacagcacttctttactctccgtaccatgtgacactccacagaaagtaaaggaatattaaaatgtgggtaagaaattgatgggtttgaatcatactccctccgtttcctaatgtaagtcattctagcatttttcacatttatattgttattaatgaatctagacatatatatctatctagattcattaacatcaatatgaatgtagaaaaatgctagaatgacttacattgtgaatatatatctatctagaatagtttgttgcattatgatattcacattgcaaatgcccttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccgccgcgccggccctctcgagcccctcgatgccgggcaccttcacccagaagtcgggcttccggtagccgtacatgctgttccactgcccgtacgctatgagcgataagagagtcgcgatgaaggtcgctagtagaaagtatcgtagacatgggcgcctgtccaggcaattgccgtggtcgtcgtcatcttccgccatgtcggcgcccatgactctaaccgctaaaacgatgcggcgagaaattaacagtatcaggaccggacctggataggcacgtacacctgtacgttacttataaaagactggtcgtaactcgtaacggaaaaggtaagactggtcgtacccagacttcgggcctccggtagccgtactcccgcgcagcgtcgtcgtggccggcctcgtggatagcagcagggcagcacagttggccccagcaaacccagtgtccacaggaggcaagctcgcgaggagcgacgactaccacaggcgcttcttgttcgcgcggatcggcgccctcgacagcatggtacgtcgctgccgccgctgcttcgactggtcttgatcgccatgagcccatgagctgccatgcatgcatgctttaatactagctagttacgttcgacaagatctccaatggatcaaatataatagggtcgttgaatccaatcacaaaacggcaacactaccgaacgtgatcaccatgtcccacagagtcttataagtaacgtaccaaatccaggacaggtcctgact

SEQ ID NO: 57520 - DNA, 5784 bp, Oryza sativa
cagcgcggcggtgtcgtacgcaggcgtgcagctcggccacgtcgacctccccggcgggttctgcgtgccggggcaggtggtcagctccgtgccaatcgtggcgaccagcgacggactggggatacccagcgagctctacgagcgtatggagagccagcggcggcggcacgagcgggtgtcgttggaggtgcaggtgagattggatgattgctgcggtcaactacctgtgatgctgtggcgcacggctgtggtacatggccagccacaggggccattcctttgcaaggtctcccctatgttgaaggatggcgaacctcgtccaccaagattatattactaggttggtatagatgtaattgttactattatattgcagctgtatatatatgttccaaaagaaattgtcattaagtaccttgtctattatcagtctatatgctctaaaaaatttacgacacttttttttgcaattctcaaaaggactatctaaaaattattcgatagattttccctggaaaatcgctcatattttcaagccaccaaatagctattatacgtctcaggttaaaatgtatcaaattaaagtacatcacgggtgttaatcgcatgaaactatatatgacgcggaaaaataagtaactttcttcgttgtcaagtctgaccaagcggcaccctacgagctgggatcatgtataaatcctcgtagcatgtctccaacaatcggatcatcctttttatttgggtgaatatgcagtttagtatttcaacttttgcttagaggtcgaattagttcttgatgttttataatgtccaaatatgtccttaaaaattatgacacggaaaaataagtaattttcttcattgtcaagtctgaccaagcggcgccctacgagctgatcatgtataaatcctcgtagcatgtctccaacaatctgatcatcctttttatttgggtgaatatgcagtttagtccttcaacttttgcttagatgtcgaattagtccttgatgtttcataatgtccaaacatgtccttaaaaattatcacatgacttaacatagtccttggacccacttaaaacgccacgtgaaaatgccgcgtcattcatgcatgtaaagttaaacatttaaatgtcaattttaaccttacattttcttgaaaaaaaaagaaaataaaaacaaagggaaaaatacgaagatgcaatcataaaacaatgtggttaccaatgctatatctttttggcaatggtcaaaacccttttgttttctcaatagtttttctttatttcctgtgaaaacgtaagggtataatggacatttaaaaatttaatttgcatgcatagatgatgcggcatgtacacatgtcatttttagagggtccaaggactatagtaaatcacacaatgaattttagggatttgtttggacaatacgaaatgtcagggactaaatccttaatcgaaagttgaaggaccatgttggttattcaccctttttatttcgatggttaggattttaggccagaaattttctccatcaatttgatatgatggtgcattagtggactgtaactatagtgtagttatagtgtaactacaatgcaattacactatagttacattgtacctacagcatagctgcactgtaactacattgtaatatctatataagttagatataaagttgcatattatcattgttatggataccacatacctaatagtagttgactaagctcggcagggtccaccatgtactaagtcttatacggaatcatacctcgtatatagaaggagttccggataaggaagaacaaatagttctatatggaaatgacaaggactatccggattgtatcaatattggtctccctagtactacttggataatggggcatctatgggtataaatacaagaccccctagtgggagagagggcacgcaacagcaactgatcaacatagatcaatacaagccaacacacgccaagacaagccgccggatatcgacatcagagataagcctagacaaacctaatatggtgtctggggaggccaacaagagggatctagcgctatctctgatctggccgagtgtggattcgaggaggaagactaccctgtcgttgactacgagttggttatccatgccgcatgggttatcccaattattgtacttgtgtgattcagatgaataaatgagcaacactagcttcggccaacaggagtaggttaatacctgtcagattcacgaacttgtataaaaatccttgtctccatctcttttacttcaatctcgcacataccctggtaccaacgatctgcatactatgcaaaataccgtagtcgtgatatcaaacgtcgacacatatattattctaatacttatatacatgttatattatagttacaatggaattataatacaattatactatagttatatttaattttttttcctaaaaaacttgcagcagtttttagatagtccctttggaaatacataagaagttatataatgaacctttttaaaaaattcacatgctaacttaggatgagagtcggactcctaattacttcagaattctcgccaagccataagaaagcaacatacaagatgctggcatcatcccaataaaggttccgaattagataccaatactattaaattaaaaatttcatatactttttaggaaaaaaattctaacaataatacgattaaaataactttcatccgttgtgtcggtgacatgggaccgggagtatcatggctagaggcttgaggcagacacaatcgcccacgtggcctggcaccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccggtcagatcgtgggttaggtggcgacaggcggtctgacgcacgccttgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctaacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggaaaaaagaagaaaaagaacgatcctagaacaatcgggggctggctcgcactttgtagcttcttcatacacagatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcacgttgcaatacacgacctgaataaaattatgaacgatattaacaactttccgtgaagtttattattaaaccatctgcacatataaatgatactccctccgtcccataatatagcaacctagtatcggatgtgacactttacagtacaatgaatctggtaggaaacatgtctaaattcgttgcactataaagtgtcatatccggtagtaggttgctatattatagaacgaagggagtatcatgtatcaataatttgtaacgaaattagtactccctctgtcccaaaacataagcaattctagcatagtgtcaagtcaaacatttttaactttgactattataatagaaaaaataaaaaacatcaatcatgtaaaatagatgttactagatttgtcattaaacaaactaacataatatacagctctttttatttaaaatattttatttttatatatattgttggttatagtaacattttgaaaactgtgtcaaaatctaaaaatactcgtagtatttttgaacggtgggagtaatgtttttctcggttgcaaacaactttcctagtaacctacgactcccaggttccaacaccacccatccaaaagaccgaaacctccccgcgtcccagtcacacgcgctttataaagcagggttagcacgcgccccttccggtttctttccccctctccgcatcctccacccgcgcttctccctaaatctccctaaaccctagaggagatcccctccccccgcgcggcgatcgccgcgatccggttctacccccgttcgccgggccgccgccgtggtagatgaccatggtgaccccgcgcgcacccgaggtaaagcctggcatctccccgcgactcgcacaccattgccctgctccgcgtttggtcagagtgctttgcggttcggtaggcgtagatggttgtgcgcttcgagatggtttctattagggtttgggtgtttttttttactgagatgcggtggagatttacaaaggtttgggttttggttgcatgtcctgttgtttgcagctcctgcagcaggaccaggatgaggagatgctggtgccagaccaggatgttgttgttgagggacctcagccgatggaaggtgagatttctctgtgtttttatatttttcctctgaatttaatctgatctgtttgtcaagctttgttattaattgggttatatttttttagggtgttaactcaggccattttttcatagtatgtttcatgggatgcgactagtctctagaaccactgcccaaaacattaattatgaatcgtgcattcacgctgtacttgcaaacttctggtatttagttttttcggtactcgcaaacaataggttttgtaagaattactgaactctactgggaggtcgccagggtcagtaggagtcctcgggcttgttctcccaaaaaataagtctagttaactattgaagaatgtgcggtttgtaagttaactattgaagaatgtgcggtttgtttccagatggttttagctctttgattataaggtgataaacatgtcctgtagtcctgtactattggttgatgctaaggaaaaaaaacaatgcagaattccagatgctggctaagaaacctggaacttgaaaagagtaatattccaatctactgaacatgctctgtttgttttttttctttcctggttgtgtgttggttgttttttgtggtggtactggtatacctgtcgttatcaggtcattgaaaaatgggcatatgctaattttcaccggtgcatgtgacactagagtcatgcaattgtttatcatgttacttttgttgtttaacatatttatttcatcttgcagactctggatcaacagttgagaacgagcaggtaccagaaacctctacgtccagatttacgtggaccattgaagatttttcgaatcacagaaagctgta

SEQ ID NO: 57521 - DNA, 4469 bp, Oryza sativa
ggctacgagggcatcgacctgggcaggccggccgccacggtgtcgccggagttcagggtgacgctcgggacggcgaacggcgcgtgcgtggaccgcgcggccgtgaccgtgctgtactcgggcgtggcgctgggttgggcgcgcgcggagccgcgcgactgcgcggcggggcgcttggagagggacgtggaggtggtggcgcggggccagggagtggggctgtcggatcgcctccgcgcgcgcatggcgtcggaatggcggcgctcgtcgatcgggcgcgctggagctcgacgtcgacgtgaagatcttcgacgaggacacctacccggtgcacgctacctaccacatccctgacagggtgatgctgtgtaaggtgaggacggatgggcgagggtcggagtcgccgtcttgcccttggttttcgccgataactttagctttcgcatagaaattagtaggcacactgcaaactgattaattaatattagtagattgtatatttgtactactgttgtttgtgtacaaagtccatatattaagattggtagattgtgcatttgtactattttttttaacaaagtccgcatatgttttttttccataaaagaaagttacaaagcgagacgcttatatatgtgtgcacatttaccactatgaacaccttcaatcaccacatacatctggttcttgacaggtactgtatgtctttaatcactaaaaagataatttaaccataaatatgagtaacccatgtcagattttaaacctgaatttttaccattatctaaaaaagattttaaacttgaacttggattctcaagtggacatatttttaaaaatacacagtatgaatgcagacgttcataatgtggatatattcatcctatgaatgcacgcaagcacatttacccgtacagacgcacaccttacctatgtgagtatctcttaccatatatatcgaccatacattcatgcttattttacgtagtttaaatatgttgttggtaaaattccacaaaattgcgttgatgtatcggaatttcttctatcttttttttccctcgtacaactggaatactcggttgagtttttcttctttttgcgagatacttgctaatttgcaccatacaatcaccaaattatttcgatttatttatacacgtttgatgagtttggagaaagcgagcatcagaccgttgggcctcacctttttcttatgctggctcatcagccaaaattgaaattttcactattagggcccgtttagttcccaaaaagtttttccaaaaacatcacatcgaatctttagacacatacatggagtattaaatataaataaaaagaaaatctaattgcacagttataggggaaataacgagacgaatcttttgagcctaattagtctgtgattatccataagtgatacagtaacccacatgtgctaatgacggcttaattaggctcaaaagattcgtctcgcggtttcccgacgagttctgaaattagttttttcattcgtgtccgaaaacccctttcgacatccggtcaaacgtccgatgtgacacacaaaaattttcttttcccaactaaatacacccttaattttggagttgattttggggttttttcatcgaaatttatttttcagtatttgtttttaaattgttaagaacatgtatacaagttatatttataaattattttttgtttgcaaatatatcatttcatttattccctaaaagatgcgtgagatgtttgtgattgcgtgtgttcggcatgcacgccacgccacaccggtcacatgaaactagacaccagcccacatgagtgcatgacccaaatagtgttacagtgagaccgaaggacaacgccggattactactctcactagctgatgacgtgaaagttgaaactactcccttcgtccaaaaaaacacgatttcatcacacctcgaattcgaggtgaacctcgctacacacctcaccgcgccacggcgtgagctttcaacctcagctatatagaagtagtactccagtaattgacattgtgttgcttcctccgcaatcgcttcaaacagttgttgccacagacctactccctacgtctcataaaaaactaacttagtgttgtccagattcgttgtactattatgtatcacacgatcatctccaattctagattcttttttttttggacggaggaagtacggcggttgaaaccgatctttatcatttctctcctttcaaatcacccacgtggtcagtgtatgtgatgcggtgtcaaatcctattagagcaagtttaacagtatagccaactactagctccaactcatctatagccaatctaatagctcatttatacaatagttatatactacagtattaatacatgggcccatcatcatacacacattgcttcttggagtccgtgttacagctggctataaatctgtagcccgctgctcttctctctccttatttatctccttaaaatatgtctgcagctggcttatagcctgctattgtacctgctcttagagcaagtttaatagaatagcccactgctagctccaaatcatctatagccaatgtaatagtcaattcatacaataggtgcttaccatactattaatatatggtcctacctatcatacgcacgttacgtcttagagtccgtactgcagctggctacgatctgtagcccgctgctattgtacctactctaatgaaccacctccttttacgtgtttggagggagagttcactctccctaccgaggacagccttaaaacaaaagcaaaccaaacaaatttacctcacattaatccctggaatttctatttctactttaaatccagccatcacatcgatccgcactaagagcaagtttaatagtgtagctaactgttggctccaaatcatctatagctaatctaatagcccatttatacaatagttagctataaaaatatactataccattaatactcggttccacctctcatacacatataacgtcttggagtccgtgttacagccggctacaaatctgtaacccgctttcttctccctcttctctttttttctcaatatgtggttatagctggcttactgttgtactatacctttgctttgtgaattgtgaggtgcggccgcgccgatggaaacgtgtgtgtccgtctcgagcccctcgaggcctcgatgtcggggtaccttcacggcttcacccagaactcaggactttggttagtaaaacgccatggcacaagaaactctggacgccttggtaagttggtcccgactctgattggtacacacgttaacttgtagcacgtcttgaggtatatggttgcggtaatcatatatcgcaaggggaaggatttccatacatggatggaatcaaattgttgttcgatcgatcggaagttcggaactaatcacggaatcgaatataaaaccggctaaatagaccctaattttcttggactctactataaaatctccagtcgaacgtaaacctggtagcattgttgaacgtgctaattgcatgctaatcatggctcatggggaagacctcgacctccaagctgcggaggccgcggcgccataccatgctctccagggcgatctgcgcgaacacgacgaggcgtctggccgtcgttgctcccaagcttgcctcctgtggacacttggtttgctggggctaaccatgttcctttccacgttcgccttcttctccaccacgacgcggccggcggcgacgcccacgctgggcgggaggtactaccacgaccacgacgccttctccgtcagcatcgccggctacgagggcatcgacccgggcagcgcgggcgccgctgtctcgccggcgttcagggtgacgctcgggacggcgaacggcgcgtgcgtcgaccgcgcggccgtgaccgtgctgtactcgggcgtggctctcgggtgggcgcacgcggagccgcgcgactgcgcggcggggcggcgggagagggacgtggaggtggtggcgcggggccagggcgtggggctgtcggagcgcctccgcggccgcatggcctcggagtggcgttcgtcgggcgcgctggtgctcgacatcgacgtgaaggcgttcgacgaagtcacctcgccagcctacgctgccagacacgttcctgacagattaattatttgtaaagttacgttggatgagcaaggatccgactcgtcggcttgcccgtggtttgagttattgtaattggtttattttgttaccgtggtattgccgtattggcgatttggcggcatgggataatttcaaacgatcagtttgtatcggagtcgatgattgatttgatcagttccaaccgaattatggccttgattacgtttgtgcatagaagttcttgtcccttgcgaactactaccatgataaccatgaacaaacaaattaacgtgctcgatctactttttgcaata

SEQ ID NO: 57522 - DNA, 1213 bp, Oryza sativa
ccgatgtagtagttccagccgatagtgataatagctgatgccgatgccagcagatagcgatagggtttaagcaatcggttatatgtccaatgtagataatgatataaaggcaatcggctgatgatgatgtaataaaataacaatataatccagtataaaccaatcggctagtaataatatgataaataagcatcgatccgaaggttaaagtacacatcggctggaggtctgatgtcatgaaatccacaatattagattaaacagtaaaacctttgttgcgataagctaaatccaatatgtatgcaatccttataagccgatgcaacatccagataactcatcggctgaaaccccgatgaaacccttattggcaatcaaaaagtaggctagagattatggttctaaacacgacttagtagatcaaacttaactgatgcagcactaagtatgaaaagaaacataatatctagacaatcaagccgttgactgagttttcagggtggtagatgtctaagctaatctaatctagcaacacgatttagccgataccggcagaaaccctaaagcgagaagcagccgatagaggtaaattgatatgctaagactagattaacagagacatatgataaataggtagacaaatatatcatccaaaccggaacaatccaagaggtcgaatgtattgatgcagccttgaacgacgctgatgtaaatgatacaatttcctgggccggcggaacattggacttaccccttagccggagatcgaacaccgatgcagccccgcgtcaggtgccaagtcccgccggacgataaaataaagtagaaaaggtaaaaggtggcgatgcgctgaattgtattgattgtagcgatagattacatagaccccgggtgtacatatttatacccatgggttgatacaagttcttgtcggacaaaaaagaaactttcctaaagataaaaggaaaaaataaagtccttataggacactaaacacacttttctaaagataaaaggaaactaacaaactattcctaattaatagataacttgccatgccacattctctttgaactcggtctcttctggataagcttcctttagtagatcaattttcttaaccgaatatagcaagaatccgacaactgacgacttgacaactctcatcggctaatctctggacttcgaagccaatgctgtctctaagccgatg

SEQ ID NO: 57523 - DNA, 696 bp, Oryza sativa
agattggggtgtgacagggcaccatgggcagcattcacgtcgcacaccgtgcatgaggtgggagggaggcagtgaggggcggaaaggaggcggaaaagggaaaggggaagcagatgctacagttggtgggggtgctgctgcatggtccgtcaacaagatcaggtacctcgccgtgtacaacaagtagagcacaacccctccccctgggcccgctcaccagggcgacgtgacgatgccgtctcgagctcgataaccaccagatctcgttgtgttccctttccctttcccaatcgttgccgcccatcccttcgatgacgatgagtttttttgttggatttgttatttagtcatgacttagaatgtacaacaggtcttatttttttaatttgtgattcagcttgtacataagttttttttgttcgatttttttttggggttacggggagcaactcaatgcatcggttggaatcgagccgatgcatgcattgagaatttgagactttttttgccacatgtgtgcctcaaaggtgtttgctgtggaaccacaccaattatccaaggtcattagtcctgcctgagtggtactagataggaaatcccagcatctatgggcttgttcggctcccatactacagtagttgtgttgctgcctatgtcgtagtgataatagctgcaatattgtagcagttggctgtg

SEQ ID NO: 57524 - DNA, 1214 bp, Oryza sativa
tctactcatggtaccactagtatgattttaggtagatgcttcgcttgttaattaggcaacattaggtggttttacaactctagactttggaaatactcttatcacctggacactatggaatagttggattattgtggaattggattcacacctccccctctattcaaaaccctcaaaatggttttaggctgggctcggggtgcatggttttgacagtagcacctcggccatataaggaccggtcttcgggcctctgttgcaaagcactaccgtacttccacacgtctagtgggtaaggcttagtttttggctcagtcaggttataaacaaaagtacacggatggagatggacgaagtcgggagtcgatggacatctctagggcaaatgaaggctacacgagctgcggcccggtagtcgagatgtcatggcacagggccggtgtcctgctgctaggggctcagtcctgcctacctgtcccgggggttccggccataggtggggttgggtcggtactcttgtttatggctaggatgggttggaaactatgtcatgtcttccgtccgtataccgtggtggtatgtggcacgtggttacacatgaggaagatgtgtcttgtgggtaaagatgtacacctctgatcagagtataatctattcgaatagccgcgccctcggttatgggcaagtcgagcaatgtacccaagttagtgtttttaattcttaaaacctgcttaataactaaaatgtggaatggttggcctgggttggcttgggacgagttgggacccagggtctggttgccagttcggtctgaatcatcgtaggccttgggttaaggcaggttcgtgtgggttcacggccttgtttaataatattgtatagctctaggaccgtgtttacaaaatagctttgagcaactaagtgtcttttagtgctgtttactgcaaaccctaaccctttatattataacccccttgtactcccttgcatttattctgcacatatgggtgtgtcttgttgagtacggtggttgtactcagtcttgctcaatttttcccaaacccagaagaggacttcctggaagatgaaggcatctagctcgtgcctgccgtcatgcgcctgtggtcgtcgccctagtcttccgctgtttcccgtttgtctttgtgtgtgctgggccttcgccgcccatgtaataaagtaactatttacgcttc

SEQ ID NO: 57525 - DNA, 2064 bp, Oryza sativa
gctgagttctcatacaacaacagttatcaggccagcattcagatgtcgccgaatgaggcaatgttcggaagaaagtgccgcactcccttgtgctggaataaggttggcgaagcactggtgttcggtcctgacatactcaaggcagcagaagaacaagttaagctgatccgacaatgtttaaagacaactcagaaccgtcagaagaattacgctgacaatcggaggcgtgaccttgagtttgaaaaaggagatcttgtgtacttgcgggtatcacctctccgtggaatgaggaggtttgggatgtccggcaagttagcaccccgctacatcggcccctacctcataaccgccagacgtggtgtcacgccccgaactagccccgagcggaactagcccgtgatgctccaaattaacctgttaatcgatatcagtcccaggaaacagtgctggtatcacaggaagacagaatatcacagcaacagaggtctctttattatagagtaggggtacaatcatgttgggctgcggacagatcccgagctcacaactgcattacaaaagggaagcgaaagccaagacttggaccaaacatcataggcgcgacttgggaactaggccgaaaccctaaaactcatcgtagccgacttgctcctggaagaactcctcgtcagcgggatccgcttcatcttcttcagcaactgggagggggattatttatatagagcaatggtgagtacgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcatctcgtccggtcggagtatgtgcaaggtatcagtcttttgaattggtcaaggttggcacccggccaacggcttttaaacggccacctgggcctggctgatcccatcagccgcaggttttccaaacatcgaacccaaaccacatcaacaaatttcacaaaacagtagtcaaacaaaactacgctaggaatcacctcacatccgcccatgactgtgggcacggctgttcgaacagtttaataacctctgcagagggggtacactttacccacacgacattactaacccggatcatccagcccgtgcagaatggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctccccccgtttagctagttactcagccaggggtgtcccattccacccatgtggttgcacttgtcttatgttcggatgaaattccaaggaaacggtccttaagtgcaagagcgggaaaccgtacacccggtacattccccggtccgcgattttggaaattcatttagttcgtaagcaccgacccacgtgtcgggttttccatgtcttttgtaaaacccaagttttacccaaggtgtttctcagtttttaagtttgaaggcgaccgttgatactcgtgcagagtgcacgattaccgaggctcaactaggtggttacaagggaacatgatataacgattaacaaaggaaggatcagatgcaataagctaggtaggcccatcggtctgccttgcagacggggcaatcctatcaatgcataatattttgcaagcaatataattaagttcaaatataggctcaatatgttgaaaggtggcttgccttgctcgagatcttgagcttgatcctcgaaatccacgcactgcgggtcttcgggctccgaaactacacgtgaaacgggacaactcaacaaacggcgaaaataaagccctattattaacctctaagcgtaccattagatagatctcgagatttgaggaattttggaagttgaacggagtcaaacggtcatacggttgagaagatattga

SEQ ID NO: 57526 - DNA, 593 bp, Oryza sativa
gaagtctgaagatccctttttggtttcgtgtgtgtggtccaccttcgaatctcggggtcgagattcttgtaagggggggtggatctgtaacgctccgcttttcgtgagtcgttaaaaactaactccgcaaaatcctaattgcgaaaattttcgttctttgcgtgagagtctaagttgtgccaaggatcccaatttaatcccgttgttccctctcatcgaaatcaaaatcctccccctcatccaaattccccttacaattcgagtctccgaaatcaaattctgaaattcaaatccttcctttgaatcctcgccaaatacttctacgaatccagaatttttcaaatcccgcctcgaatcctttccttgactccaccctatgttcccgagaacaaatacccaagtattccttttgaatcttttccatgacttctccttgagtttcccctgatacatccctaaaccctcgagtttgaatatcaaatttgaattcgaatccaaaccctaaatctccaattctatccaaatcagttttctctgtaaaagtctactttacctccctgagttttttttggatggaccgattctcctccccc

SEQ ID NO: 57527 - DNA, 614 bp, Oryza sativa
aggcacaaccccttcatcgcgagttttcacgagtctattttgttttcaaacacaccaacgccacatgttgggttttcaaggcttctcaaacccatttcccaaattatcgacaaacaacggtgtatgtggaatagttggtatacacactcagagaacacggataccgaagtaccacaaaggtggaacgacaaggaatcagggtagaacaacctacaggaattagtgcgactactgggtaggtccgtcggtttggcacgcaaaccgaggccaagcaagttaagtgtgtgattctactaatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaataaagatcctatttagactaattagtagttccattgaatagatctcaattttatggaaatactggaagttgaacggagtcaatcagagctacggattgagagatatgaattttggaagtttaattggaatttctgg

SEQ ID NO: 57528 - DNA, 1827 bp, Oryza sativa
agtataagaaacgcaagtctacccatcagggaaattcttcccgaggggaacctcgccctcgctttggacaacccatgcaatatcaccagtcagtcactcaggctaaccgccagccaagctatgcccctcgtcctcagatgaatcgtctggcacctcagccgcagcagcgtgccccaagtggcaataccgcgccaaacagtgttacctctttcaagtcaccgccaggactatcagcagttcagtgtttccggtgcaaccagatgggtcactatgccagacagtgccctcagaatcttaccaactccaactcagggcataccaatggcagcaccgccagaactcctactcctgcagcagctcagtcccgtcctagcacgcaggcaagtggacaaggttcccgtgcttccaacaactttggtcgagaccgagtgaaccacattcaagccgagaccgctcaggacgctccagacgttgttatgggtatgttctctgtcaactccgcacccgcaatagttctgtttgattcaggagcatcccattctttcatatcgcaagcttttgtgaaaagaaatggttggaaaacccaaaatttgcgagtaccaatgatagtacattcccctggaagggatataagggcaactaaaatatgctcggaagttaaccttagaattgaggaagttgacttcctagccaaaccgatagtcctagactcgcaaagcttggacatcattcttgggatggattggttggctaagcacaaaggacagatagattgtgccgaaaggtccatcaccttgcaaggacctggaggaaagcaagttcgctttacccccaacactcttactgcaagtcggtctatcctaaccagtttgcaagccacttctttggaatcggtacccatagtctgtgaatatcccgacgtatttccaaaagaattaacggaaatgccaccaaaccgagagattgagttcgccatagaactggcactaggcaccgcaccaattgcaaaaagtccctaccgaatggcagctaatgaattagcagaagtcaaaaagcagatcgaagaattggagagtaaaggttatgtgcgacctagctcatccccttggggagccccagtgcttctggttaagaaaaaggatggctctgagagaatggtaattgactatagagccctgaatgaagtaactaaaaagaacaagtacccgttgccacggattgacgatctgttcgatcaactttaaggagcaaaagttttctctaaaattgacctaagatcagtttaccaccagttgaaaatcagatatgaagatatcccgaagaccgctttctcaacgcgctatgggctgtatgagttcacagtgatgtccttcggactcaccaatgctccagcattcttcatgaacctgatgaacaaaatcttcatggagtacctggaccagtttgttgtggtattcatcgatgacatcctgatatactccaagaatgaggaagaacatgttgaacacctgaggctgataatggagaagctaagagatcatcaattgttcgctaagttctcaaaatgcgaattctggctggaccgagtagcattccttggtcacgtgatctcctctaacggtgtcgaagtagatcccagcaaggttgaagctgtccttgcttggtatcctcccaagaatgagtcagagatccgcagtttccttggcctagctggttactatcgaagattcatcgaagggttctctaagctagccagacctatgaccgagctgttaaagaaggaaaagaagtttgaatggtcagcagcctgtgaagacagctttcaag

SEQ ID NO: 57529 - DNA, 20115 bp, Oryza sativa
atagagggcggcaagggttttcctgcaaaaaaccctccctccgtcaccgcccgtccctcccccgtttgctacgtcagcttgccgcccaagtggtgggcggcagggtctatttttgtaatttttttggccgatagattatttctgtaaatatttaaaaaaaaatctaaaaataaaaaatttcgtgagggcatgagggacagaaatagtagtgggccgaaggttgtggacatcgggcccaactggttggagctttcccctttccagtttgtataggccgtgctcgaagctatacgaatttttaggccatcacatgcatcttcgcatccaaagatttcttctagccgagtatttctacgaggatcgagcgtagcccggttggcacgttcgcagtggagcgaacggccggtcgcgggacctcacctcgacgggattttcccatctttcttcgggagtctcgggtacacacacgcgtgcgtgttcagtgggactgtacgtttcccgtgcactgagatctgaaggtctccaatcttattcctagcgtgtgttgtggtgtgagtgtgcgtcctgagttgtaactttcttaaaaaaaccaaatatttctaccttcaaagatatatatttataacactgtcattttgttgaatcattttattcttatgcgattgtaatatatatatacatatacatacacatatatacatatacatacacatatatatatacacatatacatacatatacatacatatatacatatatacatatacatacatatatacatatatacatatacatatatatatatatatatatatatacatatatatatatacatatatatatacatatatatatatatatatatatatatatatatatatatatatacatatatatatatatatatatatacatatatatatatatacatattgaaccactataatttcacttacaaactccacagctataccaaacaccaaataggatgttgatttgtatgagatcttcgtgtcttcctccaagcctacaacatgtacaagaacctgcaaggtctttgggttgtttggctgaggaaacatcgtacactgtttggctccattcttttctagctaattcaccagattatcattgtggatatttgttccactctttaaaaatatattttctcaaaatgctttactctactgtatttcatccttataacatttcgttcttaaactatttgttaatggtatttttaaaaaataattggtttattttatataatcaagtactccatttatttcaggttataagacgttttgactttggtcatagtcaaactattttaagtttaactaagtttacatacaaatatagtactaatactaaattagttccatcaaatcaataattgaatatattttcataataaacttatcttggattaaaaatgttactacttttttctacaaactttgtcaaacttaaagcagtttgactttgactatagtcaaaatgtcttataacctgaagcggagggagtaggcatgatccatggtaataataatccggttaacaatctgtcgagaaacacacaggggtcttccggctagctccataagatgatgggctagacaacctgggttcgaagcctcaccccttctaattatttgatattaagtcgttccctaatattcgcgtccggttaacaatctgtcagcaatgcaacctgcggacctcagaatctagagaattctaattatttgatattaggtcattccctaatattcgcgtccaatctgtcaacaatgcaacccgcggacctcggaatttggagaaaatgtgtggcacttgataggtctgttcgaatgatgacgcgcgcacaggggggcggagctagtatagctagggtgcccaaaaacccggttcaaaaaaaaattacctatagtttatctatttttatcatatatataccccatcaatttaaacttaggcacccgtatcaagctaaatttaattcaaaccagagtagcaagtgagtggaatccccttcattttattatagctccgccactacgtgcatgcccgtacagtctttacagatgttgcttcaggtgaggagcaaatggaacaatacggttttggtttatcttgatcagatagggttgatgtaccttttttctcccctacttctgtcacaaacattacaaaaatagtcgtttgcgagattaaacataatcttaatctgtaccacttcactgtaacgaagaaatatttacagagcaaaatgaccgggcagaaatggaatcagaaaccatgatcgtaaattcataatcgaataggcactagcagtcagtttggctgtttgggctacagatgaggttcgccttgttggccgacgggatggccgtgacgaccctgcggaagaagtcggcgtcgcaggggatgatgaggacgccctcctgcccgtaccccatctcgtcggcggcgagctccagcagcgcctccatgcacgggtcgttcagtagccccaccggcacaagaaacctcgtcgccgcctcgccgccgccgccgccgctcttcccgaccagcaccggcacgtacccggccttcatctcagctactaccccagatgaatgccccgccgccgctctcgtgatgctgccaggcaaggtgtgcttcggtaatgagaattgagaggaggcgctagccatttaaccagccgcccgagccgcgtgaactcgctgcggctgacgacccggtagtgagtctcactggctcacccagctgtaatacgatttctctcgttgaattgctcccgcgacaaggaaaagggagggaagggatcgagggggagagctttagcttgaagatttgcaacgagcacgtacgacgcctacgcgcaccgtgaccaactgaccgaagtgagggtgagaaatttaatcacgttcctaccatggactttgacacttcctgtgactgtgagtgagctcgatcctgacgtgtgattagtcgcgacatggagtcagtcgccgcggcgtgggacccggggggcagagcggctggtctttgacttccggtgagcgtgtttaacgtggagagtattttcgggggatcgaacagtgcttaggttgagattattatctgcgagtgaaaatgattgggcagtggtattgccgactgtcgagctgagctgagttgacgaaagggcaaaacaagcgaactgcgtccacattgtcattgcgtacctgagcctacgacctggtaaaacaacattttatattgagtttggtgcatgactagttctccgaaatcttaaactgataataaacggtgggcattgttctctggcaaaggcggacatggtattctttgtcagttagggtgaatggattcatgctcttgcctctcgagatcccttgaaagctcacattggttctttcacttgaaaaaaagcgctcaatttggtgaaactcaaataatctcttaaggagatatcttctcattttgcatgttacataaaaagtcatcaaaattttttaaagaatttagtatgatagatcaatatgtgatatgtcacttcacaaacatgcaaattcatattcaacttatacaagtagaaacaaaataaacaaatttgactatgaatagaacgcgtaattcacggtcaaatttattatttttgtttcgaattgtataagtcgaattttaactcacatgtttaaaaaagatatgtcatatattgatctatcttgacaaaaaaaatttaaattttttataactttttaaatgacatgcacaaaacgactgatatattgtgtgctagttcatgactctgccataataaaaggaacatcaaatttacataaaaaaaatcaagaagatgatcagaatccattcgccacacgtgcagctgccccgttcccaacacctcgcgcattagaagaagaagtattttttacacctaggtgcacctaggtgtatgcatacaatttaaatagttatataaatatttcataaaatttgataagatagtacatgataatacaagacactatgtaaacatgcaagtctaaatttgatcgatatatgaagaaacaaaaataataaattttatctgcactgtatgggtactattcactgtctgattttattatttttgtttctctagttgtagatcaaatttagtcctgcatgtttgtgtatagacttgtatcatcccaaacgatgttactaaatttttttaattttttctataactatttgagtcgcatgcaaataatagttgccacggtaattaggtgtagaaaatccttgttcgcttggaactgaattctacctgcatgccacatgctcagcaaagcaaagcccactccactccacaatccacattccttccttccttccccgtgcgagccccgagagccttctgctccccgcttcggatctcgccaccagcctccgccgcgcgcggtagcccggcccgaggccgagatcgatgacgcagactcccacccccgctgcggccgcgccggcgccggcggtggcggtgtcggaggcagggctgcccgacgccatcgcggtcgcgctgccggcggacccgtacgagcagctggaggtggcgcgcaagatcacggcggtggccgtggcggcccgggcgtcgcgcctcgagctggaggccgcgcggctccgccagaagctggccgacaaggaccgcctcgccgcggagctcgccgacagggccgcgtcgctcgagcaggcgctccgtgactccgacgcccgcctccgcgccgccctcgacgacaatgtacgttgagctcggctcggctcgatcgtgtgcagagtttggggtgtaatttcttctgttgctcgatcatcgatctcttctctgagctctgcttaattcttcttgcgtggttttttgtgaaggctaagcttgccaaggagagagactcgctcgcgcacacgtccaagaaactggccagggatctcgccaaggtgagagctgagctgagagcctgagatgatcacacagttgctgagctgcagctgcacatttgcacaaatttcctttacactgagataacgaatttcttctttttatggttatcttgattcagttggaaaccttcaagaggcatctaatgcagtcattgggtgatgataatcccccggtgaggccctttagttctctcttcattccttaaccaaattttctgtcccatgaacttattatatattatgggtagtgtaaataaataatccatttttggtctcgatgaactcatgaacagattcaggagacagtggacataagaacctgcgagcaatcggtagcgaaagcaagttcttggaaaggtattttctcttgaaaaatgttgtttcatattattgctctagagctgcactgctattgcacacacatacacactgttcatctgttcatacgaatgcacctctgcaacatttctgaagatggagtggcacatagtcgtcatcatcatcctgtctcctctcttgctgatggatccaccgaaattgaaagcgtaaaccaggaaggtatgatcagaaaaaaaaaatatagcatgtacctccaagttcgagagcaatgtaatgtgagcagctgattcttcttgctcgtgttccttctccaaacaaaacagtggcgagaccgttcgagcagaagctctccgtcacccacatctctccgcggctcacgtctgatcccgcggcgaagacgagaactgctgccacttccccgagaagatactccaccgccgtgtcgcctaagctggcagccagcgccacttcgcctcggttagaaggccacatggcgatgcagccatggctgccctccagcaagatgtcctctgctgccaactcgccgcctcgcgcccactcgatctcaggtccctcttgttccaacttccaagttcatcagcatccatcactaatccagtgacagcgatatcaattgccttacactgaatccgtatgcaataaaccattgaaaattggtttcgaactctgtttcagggcgcacgacgagagtagatggcaaggagttctttcgtcaggcaaggtaaagctagtccaacattctcaaatcgactgtatcaattaaacatgtttcttcatttcatcctgagttcctgacctgcacagtgcacgcacagcatgaattatgcatatttctttttggtgtttctccccaggaatcgtctctcctatgaacaattcgcagcttttcttgccaatatcaaggagctaaacgctcacaggcaatccagagaggttggcatttgcgacaccaagcctcagttttcaactgagtcccaaccggcccgttaatccgttcagatttcagaacatgagttctttaatctctgacaccgtttcttattgctgtgttgcaggagacactccagaaagctgacgagatcttcggttcagagaacaaggatctcttcatgtcgttccagagcttgcttagccgtagcctgtcgtaggttcgtctcgtagcgctgttgatctggacgctgcacgctgttttacagttggatcatgaacgtcagataacggatggtacagcagtgttcgcctgtacagagactaataacagtttgatcatgccaagaaatgctacagatagattattgctttttattggttttgttttactatttgattgaactcacgtcgcgtcgcatgctaaatgttaaaaaatcgaacaaaaaaacaaacaccgcgatagacttgaataccagccatttagtcgttaaattagagattagagagtagagggagcttgagcgggtcaagccacacaaggcgtcacgatcaaatgagcgctctacgcctctactagaccatccaagtcgaaatctcactaaaaatgagattatcattaactgcgccacaacaaatcaacagtcatcaagacttgctaaaacaaaatcaacaagcaaaacggcatacggatattgagcattctcagataaagttcccaaaattggatagaccatagatttgatactgaaattgctcctatctaccacggcttagctagaaatagagatttgataatttgacactttataaaatggggtttgattatttgacattttggtatattttcatcaactcggatggttgtactcacaggtagtatcaattaaagcaaaatgacaacgaaaaaaataaaatcaaaccatcaaatttctcggctgaaaatggaccgcaagggttaggaattttaattacacatgtttaaaaaaaagatttaaaaaaagctgaggaaaatgacaaaatcacccccctccatctctttctctccttcccacacgcaccttcatcttcgctctcgctttcccgtgtaagccggaggaacgggcggccggccttctctccccgcgagtccgcgaccccgcacgcgcggccggcgagcaagcccagaggcgcgtcgccgagcccgacctagcatcctcggttggcgcggcctactcgagcggcgcagggccagcgagagctcaggttcggaggggggctatgcgggaggcatctttccaccgccgacctccacctgggcggatatagatctaagggtagttgcttctcctcgtagatataggaggtggaaataagcgaatacagcttcttcaggatttcgttgatgcgtgaacctgccccccgtgcgacacgttaggtcgtcgtcccctgccgcgctgacgacttgggatgaatgtttgatcgtattgcacacatatgttggtgttcttgattccttgtatacatttttttcttgtgtggctaaaacttttgcagcaagccggagcgtctcccgttgtcggagatgttcctcatgtttattttttttttcgttttgttttgttgaatgctttatcgaacatgcaatcacatatgagtagttgattgtcaaatgcatacccacaccgcctggtgccacacggtgtgtttacagttcgtttcttggattaaagttcatgcatatgcaagtacagttgcttttcatgggttgttctgcattggatctatgctccattatgacccatgttgctttgtctgaattatatagcaacgatagccaaacatatgatcagctccaaacttttcagattcagagtcatctcgcgatgaaggatatcttaggctgtgttcagttcctgaaaaaagttgaaagtttgaggaaagttagtagtttggaaaaaaaatttaaagtttatgtgtgtaggaaagttttggatgtgatgtgatgtaatggaaagttgggaatttgggggtgaactaaacacggccttatctgcttgtctcaaattatgtctctagtacctaccaaactataggactacttcattccccttctgcaatgtgctgttgcgtgtttacaaccttcaacattgtagtttgcattcaatatctgctacatggtactacctgctttttttcaactattgagcattaaatatgaaagtggtcgagaatttatttagcttcaaagtactaattaaaacatctagtaacttgtttaataatctgccaaattatatttttgggctttcattgtttcctaatatacatttaatggtcagttggatgttatatttacccatctcttggttgcttttctttttttgatctctctcttggttgcttttctgagcatgtgggtagctggatgtctctaaattattcttagttttctgtagtactggccatttattgttcttgactctctaatttccatggctgaatctacaatgtcctacttgactcatcccttttcatcaggtcaggagtcaaggtatatcagatgatggatctgtccacgacttcagtagtggctgctaaggcctacaagtacagagcagaatcacttgttaaggactaccttcttgcagattgttatgtttcatacactgctgtgcttggtgggatcctgatgtgcaaaatggtattatttgtccctcttatctgttgatgtttactataagtctacatgtgaattgtcactttgatagttatatttagctgaatggaaaaatcggtgtaggtttgatatattttttctatgttataagcgaggactgtggagcaggtagggcccctttatatgagatgactattattataagcaggtttttctgggatcgaattaatatagccatattctcagtgtaacttggctacttgccacatcaatcttgagatatggacctatagataaaagtaattgagataagctgtgtaagtgcagatatatgtgcaattgttttcagattatttatgacttttgacttgcctgtatgcttgcagatttaaataaattttcaaattaaaattatgaaacaagtctaactgtttctttgaattataactttgtagcgtttaatcttattaggatcttttagagattattcaactcaatctacagtaaattgatctcaataatgcctcatagaaccaatcatcttatggttagtctaacacaaactaacctcagtgtgagctcctcacagaaaatacagtttccatcataagatttatatctgtgctgtaatatgatggatcaggtttagcatcctatatggaaacaaaacagcagagggagggtggggggtgggttagcatatctttacgcttaatgccctattagctgcttgaattattcagtacctagagttgtgttaattcgacctgacatatttccgcttttcctttaaaaaaaacaacattggtcaatagtgaccacagcatgttagtagtaagtatgctgcaatgctatgtaatattcataaatgatcataaactgtgccgttttgtttatttacgtattatgtaaacattaagtagttgcatgggacttgctatgactaatatctatgtaccacctcttttgaaaaatttcttcttggtcttgactacaatttatcacttgtatctcaggtctatgacatcacacacttaatcagttcattgtactacaagggttatggttctcttacgaaaatccaaaagcttgagtggaacaacaggtgaagcagtgtgtttgtagaatttatgtcctatttcacgctatatttgtcttttaacttccaccttctaactgttttaggggcatgtccactgtccatgcaatgtttatcacattaatgtcagtttacctagtattcttctccaacctattctctgatgagctggatggcccagtaacagttcggagttcaaacctctccaattttacactgggggtaacatatgtcactgtttatccgcattgaataataggttatgctgatatatacattttctccttttgccacatgttagctgaattaaatctgtttaggtttctctggggtacttcatcgctgaccttgctatgttatcctgggcttatccttcccttggcggaatggagtatgtaagtgagcatagttgatcattaccatttattttatttcaccatttgtttactttctaggttactgctattcagtgtttattcaattactgtgtgctctgctgttcatattattcatcacttgggttgaccattgtcaggttcttcaccacttgctgtcaattatttctttagtctatgctatttattctgaagaaggacagttgtacacatacatggttctcatctctgaaacaaccacacctggaatcaacctccgatggtatgcttcatgaaaaagatcatgcaccttttctttatacttattttacttcaatctatctgacctgttatgtaccttcttcatcaaaggtttcttgatactgttggaatgaaaagatcgaaagcctatcttgtcaatggtgttacaatgtttgttgcatggctggtaagtgaaagttgctacactgtaattggaggttagaagttaaaaatcatgcattgactgcaggtgatcggatagttatgtactattattagatgtactacatgcatgcacgaattataattgaatctgtatatagcgagattcaaccttgttatttgttgtgtgtacgtaagtatgagagggagggagatttggaatcgtgcttaatcaataatagttgcctaatcagttagacgctgtctctggtgctgtttaggaagttcttatatatctcaaatgtggaccaccatttgcttactacaggtggcaaggataattttgttcatctacttgttttaccacatatactttcacattgatcaggtgctatatccttctgatttgatatatgggtacatgtctacatgacaaaaatcactgaaattaaactgttcttgtttattgacaggttaagcagatgcgcacctttagctgcattctgatattcgctgtgcccacaatactattagtgatgaacacagtgtggtttgtcaaaatcttgagaggtctcaagaagacgctagccaagaggcagtgaagagtggtgaattgctcataggcgcatctacaaccatcctttcgtacagtcacatacaactacatatattttctacgttaagctttatagtgcaactcatagcgcaagcaaaagatcccttgtacacatgttggaaaaatctcctcaacattgccgaaaatttttgtccctgtacggttctacattgtacatatatatatatgcacgtctagttatggctgaggatgcttttatctgtgcactaatgattcatagtttcaattttcaacaactggagatactgccatagtggccatctcatagacatatagagaactccatgattctagatacaacttgaatgtgcaattcgtattgctctcactatgaacgtttttgtagctcgattctaactccagatttgtagttcattcccgtcatttcaagggagctggtaacactcatcatttccgttcttcaaatatcgtatttctgtctagtccagcgtcgccttaattggccttctaagtggtagatgccgtcgtcattgttgtagtagatggtgcggtcgatgccatcgtatctgtcctagatggtacattgttgtcgtagatggtgcggtcgatgccatcgtatctgtcctagatggtatggtcgatgccattgtatctgtagcgtgctgattattcccttttacagttacagaaacctctaaagcaggaacaatagtggagtagtatatatttatacataactattatctgaactagatattttattttaagttgattatatgtgatttagagctagtagcttgctgtaccattaaactactctaaatacgagaagcacagaagaagagtcgttgccacactttgggtaattacgaaggaaagatcgtgagttgcgactgtcacgagcacgcggttcgaacgcgcgcgggtgctgacttggcgttgacctgtgaaattctctcgcttcactcgagtctcttggcccttgctcgaggcagactcatcgagcagcccaaagccccaaacgactgcgcgcgagcgatagaatggcgctgcgcctcgctgccgtaccagagagcgccgccgccgacctgagcgccgccgccaataccctgccgtgcatctcctaccgcgactcgatccggagcgtcgccgccgtcgtctccggcggccgagggcctctcttccagtccgaagattccgcctccacctggtcgtcttcctcctacgcgtccgactgctccggccactcctccggcgtctccgccgccgcggccgctggcttcagggcactcacggcgcacgagctcagggaggtcgcgcgtcgcatggtcgccgacggctacgcccagcgcatggtccaagcgttcgacgacgcggcgacggtcgaggtcctcgagggggaggtggttcttcgagctcgacgtcgactgggtcctccgaatccgcgaggggcaggggttacggcagctggagaagtcggccgcctcctccccgtcgtcgtcgccgctgcaagatctggtggagagtgacagattatgtcttgtttttactatatatttttaacatctatttttgagataatagttggctgccttaggatgtaaggcactagtaattttttgagataatagttggctgccttaggatgtaaggcactagtagttttccttaggatataagccactcctaatttttaggatgtaagccactaatctataccttatggtgtaagccactggcctatatatatatatccaaccagccatagttgattgagtggagaatagaaattaaactagcctcaaaacctgtgttccttttgctaacaattggtatcagagcaaggtttatctgacttccatcgactccccatccaaaaatgtctctccactccattcgttccccctctctctcgtcccatgcctcaagcacttccagcggacgaggcagcaggcggtcggcggccgacgctgagggcgacggcgatgcgactgctgttgcgcaggaggcgcgagcggctgcgcgggaagcgcgcacgacgcatgaggaagtggaggcacggctgcaggcagccacgagggcggcacgtctcgcggcggcagaagctgaagcagcacgcaccgcggaggcggccaggcaggctgcagctgtgttgatagaaaacacgaggcctgggagatctacttaactccggtgcaggtccaaagctcgccttcgaatgtatgagcgtgccagttgatttgatcctgtaatcaacaagaaatagagacaaagaattcgtggttaaatctataaatgatagccgatcggctaggtgccgatgtcatatatgaatcgatcggcggttataaatagaaagtaaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctagcatgtatcggctaatactccgatactactttatataaagatatcaaaacaaatataatttaccaaacaaaagcttaatatacttaaatacaataagatcttgatataaagggcggatttaacatgtcattgaagcatatagatcgaatatggttaaatcagataagatcggctgaaactccgatactaccctaatcggcaaccataggacatgctagagattgatattctaagcacgacttaatagatcaaactcaactgatgcagcattaagtatgaaaagaagaacaatatctagacaatcaagccgctgggtgtttcataaagtggtagatatcttatataatctaggacaacgtcgctatttaacctaatcggctgccttctattaacagatgttagccgattgtaggttagatgacgatattgccaaagattatgtaagatatatgataacttgacgaattatatagacaaaattagagtgtcataatgatggaagcactaatctcgagaacacaagtcgtcataacaagttttacctcttgttgaagatcgaaaccgatgtagctcaacccgaaagtaagaactcgtcgaaacaaaactaaagcaaaaaggtggcgatgcgccaaaattgtattgaacatgtgtgttaaaaattacatagggctcggggtctatttatacccgagaattacaagatatgtccatactggacacgaccgctatctctaacaaactctaagataccataagtctttgcagcagacttttgcccaaacatatatctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatttggaattcagccgattattgctctgttctcggatcaatctccgccttcgactccaccttgatctaatctccttttccgactgttgttgcgcgggttgcgcaggaggcgcgagcggctgtgcgggaagcgcgcgcggcgcgtgaggaagcagaggcgcggctgcaggtagccacgagggcggcacgtctcgtggcagcagaagctgaagcagcacgcaccgcggaggccgccaggcaggctgcagctgctgctgctactttgcgagctgaggaggaggaggagcgacgtgacctggagctgacagacgcggcccgcgtgcgacgcgacgcggaccgggatcgacacataggccgacgtgatcgcgacttcagcccccatcgcagaggatcagatctccaccgcggtgaggaggagcggcgcgatccatggcgcgatcctcgaatcaaccgcgctctggagacccagcgactccgggagcaggcagcggcgattgaggcacaactggacttcgaccgggagcagggtggacgagacgttggcgcacggagccctcgcaggcagcgcgcctccccttccccggaccggcgccgtggtcgccgtggacgctccggctctcctcccgttgtgcagatcgtcgtcaaggatgttggcggcgcatggcccatgctcaccaagactaactacgccgagtgggcgatggtgatgaaggtgaagttgcaggcgcgccacatgtgggacgcggttcgatacggcgacgtcgactacggggaagatcggcgggcgttggaggtgctccttgctgctgttccgacggagatccagtcctccatcgcgagcaagcggaccgccaaggacgcctaggacgccatcgcttcggtacgcattggcagcgaccgcgcccgcaggtccacgcttcagaagctgcgtcaggattgggagaacctggccttcaagccgggttaggacatcgactactttgttctccgcctcaactccttgcaacagcggttggcgcagctcggcgacaccaccatcgatgaggagagagccgtggagaagctcctttgcgtcgtccccgagaagtacacgcagctggctctgtcgatcgagacgctgctggacttcaccgagctcacgaacgaagaggtgacaggtcgcctcaaggccgtcgacaaccgcaagcagctacctccctcagagccgatcaccattggtggcaagcttttcttcaccaaggagaagtggctcgcccgccaacaagagcggaagaagggggaggccacaagctcttcggcttcgggatcgtcgagcagccgcaagcgtcgaccacgcaagtgggagaaggcgcgtagtggcgctcttggcggcgccgatggcgagcgcaagggcagccgcaacgacacctgccacaactgcgggaagaccggccactgggccaaggactgccggcaggcgaagcacggcggtcaagcacacgtcgctcaagcgcaggagggtgatgaggtggctctgtttttcgtacacggaagcatcgagccacacttcactcccacaccggacgctaccgcgcccctccacctcgacgagctgtgggcccacgtcttcctcagcaacggatcctgcgacgacaagatcgacgggtggtgcctcgacactggtgccactcaccacatgaccgggcgacgggaattcttctccaagcttgactccagtgttcaaggctccgtcaagtttgaggacgcctcagccgtggagatcaagggcgtcggctccatcctcttcaccaccaagaccggcgagcaccggctgctcaccggtgtctactacatccccgcgctgaggaactccatcatcagtttgggacaactggatgagaacggcttgctcgtggagatagaggacggggtcttgcgggtttgggatcgccatcgtcgccttctcgtcaaggtgaacaggggtgccaaccgcctctatgttctccatgtacaggtggcgcagcccgtgtgccttgcagcccgccgcgacgatgatgcatggcggtggcacgagcgctttgggcacctcaacttcgaggccttgaagcagctcagcaacaaggagatggtgcagggcatgccacgagtcgagcacgtggagcagttttgcgacacctgcgtcctcaccaagcagcggcgactcccctttccccgccaagcaagtttctgcgccaaggagaagttggagctcgtgcacggcgacctctgcggtcccgtgactccggccacacctggaggccggcgcttcttcctgctgctcgtcgacgacgtgtcctgctacatgtgggtggtcctgctcgactccaaggcagtggctgcagacgccatcaagcaccatcaagttgctgcggagaaggagtgcggccgcaagcttcgggtgctacacaccgacaacggtggcgagttcacgacggctgagttcgcagcgtactgcgccgacgagaggatccagcgccacttctccgcgccatacaccccgcagcagaacggcgttgtggagcgccgcaaccagacagtggtggccactgcccgcgccctcctcaagcaaagagggatgccggcaatctactggggggaggcggtgatgactgccgtccatctcctcaaccgctcgcccaccaaggcccttgatggcaagacgtcgtacgaggcctggcacgggcgcaagccggtggtgagccacctccgcgtctttggctgtctcgccttcgccaaggagctcaaccacgtcggcaagctcaacgaccggagctcgccgggagtcttcatcggctatgcggagggtgtcaaggcctaccgcatcctcgacccttcgacgcagcacgtccgcatttctcgggacgtcgtgttcgacgaagggcgaggttgggcttcgtacaaggcggtggacgacggctcgacttcgactctcagagacttcgtcgtcgactacgtccactttagggcagccgggggagctagcagctcatcttcaccgagctcgtccacctcggcacccggctcgccatcagctccggcgagtcctctaccacctacaccaccagcaactcctccatcaccagctacgccccgctctcctacaccggcgcccacaccaccggtggagttcgccactccgttgtccaacgacgaggatcgtgttgatgcgtaccacgacgacgagcctctgcgctaccgcaccatggacaacatcttcggtgatcagcccgtccctggactggagacgcgcgacttcgaggccgagttgcacctggcgcatgaggacggcgagccctgctccttcgcagaggcgaatggagatgtggcatggcgcactgcgatgcagcacgagatggacgcggtcgagcggaactggacgtgggtgttggcagatcttcctgccagccaccgcgccatcacccttaagtgggtctacaagctcaagaaggatgaggccggggcggtgatcaagcacaaggcacgtctagtggcgcgcggcttcgttcagcaggagggagtcgactttgacgacgccttcgcgcccgttgcgcgaatggagtctgttcgtctgctcctcgcgctggcagcccaggaaggatggcgtgtgcaccacatggatgtcaagtccgccttcctcaacggagacctgaaggaggaggtctacgtccaccagccgccgggattcgtcatccccggcaaggagaacaaggttctccgcctgcgcaaggccctctacggcttgcggcaggccctctacgccaagctggactccactctcaagcaaatggggttccagcagaactctcacgaagctgctgtctaccagcggggcaaggacggcaatgccctgttggtaggcgtctacgtcgacgacttggtgatcaccggcaccaaggaggctgaggtggaggcgtttaaggaggagatgaaggcgactttccagatgagcgatttgggccttctctctttctacctggggatcgaggtccaccaggacagctctggcatctcccttcgccaaaccgcctacgccaagtgcatcgtcgagttgggcgggctcaccggctgcaacccagcgtacactcccatggaggaaaggttaaagctgagccgcgacagcacgctgagggaggtcgacgccacgcagtaccggcatattgtgggcagccttcgctacctcgtccacacgcggccagacttggcatttgctgttggctatgtcagccggttcatgcagcgaccgacgacagagcaccagcaggctgtcacgtcgagggcaccaccgactacggctttcactacccgaggtgtcccggtgcgcagcacttcatcgggtacagcgacagcgacctcgccggcgacagcgacacgagcaagagcaccagtggcacgctgttcttcctcggcaagtgcctgatcagctggcagtcggtcaagcaacaagtggtggccctgtctagttgcgaggcagagtacatcgctaccacaaccgcctcaactcaagctctctggttggctcggctgctgggtgatctcttgggcagaaacactgaagcagtggagctcaggatggacagcaagtccgctttggccttggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtcccttgggcgggtcaagttccaggagtttcgcgccaggattggaatggttcaaattccccaaaaggcgccacacatgacttagggggagaatgacagattaagtcttgtttttactatatgcttttaacatctatttttggaataatagttggctgccttaggatgtaaaccactagtagttttccttaggatgtaagccactcctagtttcttaggatataagccactagcctatatatatatatatatatatatatatatatatatatatatatatatatatatatctgtgtgtgtgtgtatgtatccaaccagccatagttgattgagtggagaatagaaattaaactagccccaaaatctgtgttccttttgctaacaacgagccgacgccgtcgctcgcgcggttcgggg

SEQ ID NO: 57530 - DNA, 723 bp, Oryza sativa
cattatgtggttgtttaaatccacgtagccatcacgcatgaagcttactggttaccctccatcagacaaacatatatattcgatctttctccggtcaagttctagcacaacaaaacacaagccaaaacaccatttaaccacctccaagcttcgcattccaagagaccgagcgactgttcagccagagattaatcagagaatggctggagaaggagatgatcaactgaagcttctcggattgtgggtgagcccatacactcaccgagtgaagcttgcactcagcttcaagggcctgagctacgagtacgtcgaggaggacctcagcaacaagagcgagctgcttctcagcaccaacccggtgcacaagaaggtgcccgtgctcatccacaacggcaagcccatctgcgagtcgcaggtcatcgtgcagtacctcgacgaggagttccccaactccggcgtctcgctcctcccatctgactcctacgatcgcgccattgctcgtttctgggctgcctacatcaacgacaaggtaatcgtcaaattgcctcggttaatcgatctgaatttgcatcgattgatgtgatgttgtgtgcgtgtgctcgcgtgtgtcgtcgttgcagctgatgccgtcgtggctgcagtcgtcgatgggcaagacggaggaggagagggcggaggcgctgaagcagacgttggaggcggtggcgaacctggagacggcgt

SEQ ID NO: 57531 - DNA, 599 bp, Oryza sativa
accttgtcgtcgatgtaggcggcccagaagcgagcgacggcacggtcgtaggggtcggatgggaggagaggaacgccggcgtcggggaacgcctcgtcgatgtactgcacgatgacctgcgactcgcagacgggcttgccgttgtggatgagcacgggtaccttcttgtgcaccgggttggaggtgagaagcagctcgctcttgttcttgagatcctcctcgacgtactcgtagctcaggcccttgaagctgagcgcgagcttcgctcgcagcgcgaacgggctcgcccacatccccagcagcttcagctcatctcctccaccggccattgtcttcctctctgaagctctgagatggttttggcttgagttgtcttttgctagctagctagcacttgatcggagcacaacacgaaccgtgaatatttgtatatgctatagaagactagtagtgcgtcacgagtgatgcttgattgcacaattgaaataggggtttccacaactactctttaacacgtcgaaagctcttttcagtgttcagatgtattcaaaaacatgcgatcagtaactttagtcaaaacatgtgcagataaatcaata

SEQ ID NO: 57532 - DNA, 716 bp, Oryza sativa
ctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgttatgagctttcggtgtacctttaccctcgtggaggtatacacggggctggccttcgcccacaccacttcactgtggccaggcccactctccagatcgcgtaccaggacctctcctagactgcacttcgtcgcttggcccacgactacagccaccgcctcgggggctctgcctttcggcagctcctgcgccttccttctggccgcactgacactaggtacccttgcccgtacagcgagtctcagcctgtgctgactcgcatggttgagctctctgaggctcaggccactcagcacgacctactcctcgaggcttcccgctcccttgctcgccgctacgctgctttggaggcccgtctggccgaggagggtgtcacctcagttgacactgtctcttgggacttaggccgcctctgccacgccagccgcctgtcctcccacagctctcgcggctctgcccgcactcctagtggcccgcgctcccccagctcgcg

SEQ ID NO: 57533 - DNA, 512 bp, Oryza sativa
tcttttgcaggaggataattttccagaactgctaagcggcggtttcctcaacccaaatgatatttcactcgagttcatccaagtttctatttctttttcctcttgtttgggcaaaagaagtctaacttccggccttcgcaccaattctcttccataccaatttgaatggagcttatgtatcgagcacaacgataatccgctacaacttcgttgcataggtttgagggtccgttatgaagtttatctgtatcaagacagtgaaggtcgaccaaataagttgagcatagtggttgacatccctgagaatctcagacaagttctagaattttgtgatgaaatagctgagataacattccggaagtttgggagcaattctgaatggcggcaagtgattaaggaatacgggaatcgtctagtgtacgcctaaagtgagttacattgctctctgattcttttaaaatgtaaaaataagtgccaagtgttcatgcttctgtgatttttaacaacaacaa

SEQ ID NO: 57534 - DNA, 12932 bp, Oryza sativa
gggagggggagcggcatcgtcgatgggtgagggggaaggggagcggtgccgccggtggggagaggcgctaccagtgaggtagggagagaaggagcgacggagggggataggtgccgccgacgccatcattttcagagagagagaaggggaggggaaataattttataagatcataaggcggtttggatggtggttttgcctaacgtggcgcctacgtggcgttgatgtggcacaaaaattcaaaaaaaacccaggagtatccgattaaaaataaaaaaatacaatgggaacaggggcggggttaggtttttcaacttgggtattcgaaattgtaggagagaaaattttccaacccaagatctaatagttgtataatatgcaacggtataagcatgatttcataaagtcataaatggatagaattgaccataaattgaatgcgttaaacatattagagtacattactaaactattaattgaaaaaacatatcaaatttatagaccatacaaaatggcaaaatgataagaactcttacaatatagagaagaactttccgtttcttgatattttgaaaatgattgatgatgtcttcattcttaacttgcaagaagaaatatctttcaatgaatataaccaagcaatcattcaaatattcttgccccatcttgcttcttaacttgtttttgatatagttcattgaagagaaaaccctctcaacactagcagttgcaacagggagaactaacacaaatttcagaagtttgtaaacaaggtcatagcgagaaaccttgtttgttttcacaagcatcatagacaggtctgccaaactcatcaaatttgtgaaattctcatccttactcacatcactaatatagcggttcagttgaaaggtgagttggttcatttcttcaacatcaaaatcattaggatagaacttggcaagcttaactaagttgtcaacattaaaatcagagaaggatttagctgggctaaatgatgacatgcatctaagtaactctgggtttacctcatcaaatttgttattgagctcttgaagttgcctatcaatgacacccaaaaacatatcggcatggaatcgatggtaattaatagcattttgaagaacttcttcgacctttgtataggcttataattcccatccttgtcaacaactttaactttgtgcttcacacaaaaagaagtgaccctcttaagaaagtcttgccatccagaatcttctctcaaaacattaagttctacctttgtgaatctttttacaagacatcccaaggacattcaacaaatatgcaagttgcccaaagaaccatgcacaatcagtattctccttagcaataactacaagggttagttgaagttgatgagcaaaacaatgtacatagtaagctcagggggactcatccataattagtttcttcaaaccattaatatgacccttcatgttactagcaccatcatatccttgtccacgtacctggattttccggatggcacttaataagcaaggacttaattgcctccttaagagtcaatgatgtagtatcttcaacatggacaagaccaagaaaccattcaactagttgccccgtcttattgacaaaccgcaagcaaagagccaattgttcttgttggtaggcatcactaggctcatcagcaagaattgcataacactcatcatgaagttcctctatgacaagtttagttgtttcatgagcacaagaactaatgagttgtttctgaatcttgtggcctatcatctgacaactagttggagcatttcctagaaccaccttattaacttcttcaaagttcccagctatccattgcacaagttccctaaaatttcctttgttgttagaatcctgactcatcatgaccacaaaaagccaacccctgccgcaaaagatagcttatgcacttgagtgaccatgtcaagtgagctaaatattgagcctaaacctctgcggagtttgatgcgaaggactcacgaattgatgtcttaggttgtatgaacaaattgtatttttcttcagcttcacaatatgcactattgacagcaccagcatgtttactaaatctaattttcatgttctaatttctatgccttcattagcaaaagcatctccaccatgattgctagtgctatctttgaacaaataacaaacaaagcactatgcagcatctctgtgcacactatactcaagccacttaaactcagaaaaccactttggcaggaagcgacgcatacctccacactcatgctgcggaaaatcctccttcttcatctttggttgacaagggcccaatgcaatatactcccttctaactgaatcttggtcattgacatcatattgtgatataggaatcctcaatccaggatcatgctttatgtcatatgcaccaccattattgtcttcatcacttgatgactcatcatttggccctcctccaatatcatcggtctctacatcaggcggtactgtgcttggactgctttccccactagcactctcattctcaggctaaccttgatatatcactacttgcacctgactctcaatacacgaaggttgacttggaccaatggaagaaggttgacttggaccagttggttcttgcttttttgttttgcagcagcattttctaaaaattaacaatgggacccttttttctcttcatgtttcaaacctacaaacaacaatatcaaagagcaattgagcaaagcagcactggttcagtggttcctaaatcctaatctagttagtcattcacaaacaatgaagctaaaataatcaacacacttcagttcaccgactcggcgactcaccgttgcaaccgcttgctatcttgctgactattgccgaggtctcgaggacgggaggcggcgaggcgcgcaggcggccgccgggcgcggggcgccgccgcgctggctaggcgcgaggcgcggaggcagcgagccggcgagggggctgtggcctgtgggcgaccggcggggcgacgccgcgaccggcgactgcgaggcgcgcatgcacaggcggctgggcaacgagttaggcgacggcgaggcgcgcgcatgcaggcggctgagctagcacggcgacggcgcgtgtgtaagcctggagggctggcgacagctggcgtgcaggcatgggcgtggcacctgggatgggaaggaaggtgaggagaagagatagggttagagaggtagtgggcttttctttgctattgggccaatgggcctgaaatagtgggtggtgggagggttcagtttgggcttcttttgagttttgaatgggtataagcatttttccttttttcctatatatacatatggaatatatacttcatatatgcatttttttttcaaaaatcttgggtattcatttgaatacccatgaattgaagtgggcccgcccctgaatgggaacgcgtcatcactcatcaccccctccctttttcttcttctctcccttcctcgtctctctcccatgggggtcgcataaaaggtaggcaatctcgaatagtctaatcccaaaccgaagaaccataaaaaaatcatctgtaagtccgaccgagcgacgacctgcgtccccgcacgcgtgatgtgttcgtcacatacgccgcccaaagggaaaaaaaattagagatcaaatcaaaatcctaatcacgtacagcggacaaatcccaaaatcaaatatcgattaaaaacccaattgtggcaaataacatccagagtcatcaaataacacaaaaaaaaaccaaaccaaaattaagaagtttaatgtatagtgatccagacattttttttctggttggtataaaaaaaggtatatatataggacatttagatggatgtagagaatttattccaagtgagaccgctcattagagcaagtttaatagtgtagccaactatgggctgcaaatcattcataatctattatatactaaaagtccattaaacttcttacaaatgctcctaaactgccacgtggcgctcctacaaacgctcctaaaccgacacgtggcaatttcaatctaaccgtcggttttcacttaaatttatgggtccgttattttaaaccattagattagatctatttaaaaggtcccgcttcagattattatcagatatatacaagatatttttacgagaaaaattggcatgtatttcgatcagatataaaccctgttcgcttaaggaaaacaaatcaacatatgtacgtacagctgtagagcgaaaacaaaaatactacaccgtatgttgatagaacctataatagacagtctctaaaaataagattttctatacatggcactttctaatctaaccgtcgattttaacttaatttggtagctccgttattttaaacattagattagatctatttaaaaggttctgcttcacctcattgtcaagtatataccagatattttttttagagaaaaattgacctatttcgatcggatataaaccctgttcgcttaaagaaaaataaatcaaaattcgtacgtacagctatagagcccaaaaaaaaaatacaccctgcatggatacaaccattaaataatagatggtctctataaaaatattttttatactataaaataaaacttattacttcacaaatatatacggttaaactagattaatataatatatcaaatcaatcgtctttaaatatccatttttaaaattatttttgaaatatatatctaacttataatctgttgtattcctttaattaaataaactattgatcacatataatagttatattatagtgctaaatacatggggccgacatataatatttcacgtcataattatttttaaataacttagccaatatataataattaatgtcattataatcttttttaaatagtttcacatgatagaaaggatcaacatggtctcaaatatagcttgacaaataacactaattcaaatccacatgcagggagagtggaacaacattgtggtttttcaattagatttgatttaattttagtcaatgtgagattaagattctcattttttttataactttttagaataatttgattggaatttccaaactatgatcttgccataatacaaccccttaatccatcacgggaattatggtcatatatatcttttctttgccaaatagatatggtaacaaatcaacaatcctattcattcaacttttatcatatattttcttatagtagatgatctataccatacaccctaccaaagtgactataagtgcactctaacgaatcaattacttcaaataattttggaaaaaataaatactcattctttggcattagcaaagatgtctgtcgcgatcatatatctgttgtagtctataactttttagtgatcagcctcgctcatttcaaaagcagaacattgtatctatatcataaaaaattaagcagtactgattaacaccgtaaacgattgtgtctacacaaaattaaaagaaacaatttttcattggaaaaatactttcatcacgtaccttctctctttttattccttgaaggtcaccaagcatgctatgcaaaataaacccatttctatacttttatatgctcatatttttttaacaaatactacgaatatattgaaaaaaaaaacaagtagaagcggatagatctttttttaagtagaagccgatagatcttaataaatcaataaagctcttaactgagacatattaaacttataaagcacaaacaaaagataatggtaatattgtttcaccaaatttacttaatgcgatggacctattattttataccatcttaagaactcaaaaccatttatctatgttaaaaaacaaactcccttcacccaacccaaccatatggatcctctccactgctattatatgtgcatgtactctctccgattcaacttcttcctcttcctttctctaactaacaacttgtaaacataaaaacaatcaataacgagaaagctgaaaaatcataattattaatcctttagtttgtttgaactattgatttatttataatcaaataaataatttaagatccatattaatcatattttttactttataaaaaattaaaatatatcatttgaacatagacccctgtcctttgtatgccaaccaaataataacaacattaatgaaacaacataaataaataaaatgacagcatgcatcccgtgcatcataggaactagaaaacatagattctttatctttcgtatacttaggattattattgttgtaatttactttttggtttggatagttttcgcaactattatatctatttacacaaatcactctaaatcctttgcagcgctcttaactcaccacgtgtcaagtactaaaaattagaacaaaaaaaattccaagggaaaaaaacatttgacaatgggttttcacttaagtcagtggattcattattttcaaccattaggtcttcctttagaaaaaatcttaagccgctatgtgtcacgtcttcaaaattagaaaaatcttagaaactataagaaaaaagcaaaacatatgatcattggttttagttaaattatttagaaaaataaagtccccaatgcatcgcccttcccagaacatgcattcacacaacactgaacgcccccttcccccttggctcacactctccactctccactactccccccttctaattttaagctatcaaactaaaacacaaactattaataataattgcaaagatcgtattcttaagctataaatctaatttttaatttaattgttgctcttttaaataatcaaaccaaaaatacatgatccataatgtctgtatttttaacctaaaatgtctgtattcataagtagaaaaatgtcaatagggattgaattaaatcaattggacaaaatataaaaaatttgtaaaacaaatagttattacttttcaaaaactggataaccattgtacaatgttcgattgccataaccatctttaagtgcttagatgttaatggccttccatccatcctacaccatggcattacgagtttctcaatgtattattgcatatacaagacacattaaggtagcagtgcgtagaagtacgtagttgtggttaaaaagttatgcattgctactattaactttaaatttaggactcatattggctagatattttttttagaaaacgctatagatcacatatataatagggaagcgaggtatacaatatgtatatctcctatgtatttattgacacgttctttccagaaaatgaagaattattgacaattgcttgtagtaatgaattaaatattatatagttcaaatcttacaaaaatattgtaaaaattatctaagcaatgtagatggagaaaatttatgaagaaattaaacttttcaagcgtgacaggtgtcatccggtagatattccaccttacaagttagtcaagcgtatcctattttacgtgcccgcgcgaatgcgcgggctaccttcctagttaatttaatagccaattcatacaattgcctattatctggtcccacatgtcatgcacacatgtatattggagtccgtgctgaagctagctacaaatctatagtccgcagctcttctcttcctctttttatctccttaaaatatgtttgtagctgatttataccctgtacttgcttttagagcaagtttaatagtattccaattcatttatagccaatctaatagccaattcataccatagttgcttactatactactaatatatggtctcacctgtcatacacacattgcgttttggagtccgcgctgcagctggctacagatctgtagcccgctgtttttctctctcattttttatctcataaaaatatgattatagctagctaatagtgcgtcccacgcaaaagcacacgcacaaacaaaaaaaaaaagaaagcacacgcataaacaaactacacacacaaaaaaaaaaaaaaaagcacacgccgttatattctccaccaactaaacgccgtggtcgtcgtcgcttcgtattccatttttccgctttcctctctcccccgaatccccaattcgccctaaaccctgctagaacagcggcgagcagtgtcctgccatggccaccgccgcctgcggcgagagcccttcgcggttgggctccgcctccgccatcgtcgccgacacggagaccaggtaccacctcctcaagatcggctgctactcgcgcaccaaggcgacgacccccaccggctccttcctcagttccggccagttcaccgtcggcggccaccgctggcgcatcaattactaccccaatggggaaagcgccgactccgcggattacatatcgctttacctcttgctagacgacaaggccaccaatagcagtgtgaaggtgcaggcacagttcaagttccagattagttccaccgaccaggtgaagaacacaccttcattggcatccacgaatgtaaatacatatggtgaggattctagctggtcttggggtcacagaaagttcatcaaacgggaagatttcgagaagtccaatgatctcagggacgactccttcaccatccggtgcgacgtagcggttatcggagagatccgaactgagaagacgaccgagatcccatcagccacaacattcgtcactgtacccccgtctgacctgaaccagcagctcgtcgacctgctggagaccgagaagggcgccgacgtggtgtttgaggtcagcggtgagacgttcgcggcgcacagatgcttgctagcagcccggtcgccggtattcagcgcggagctctacggcttgatgaaggagggcgacaccgccggagtcgtgcgtatcgaagacatggaggcgcaggtgttcaagctgttgctccgcttcatgtacaccgactcgttaccaaagatggaggaggaagacgtcatgtggcaacatctgcttgtcgcggcagatcggcatgatctacagaggctcaagctgatctgcgaggacaggttgtgcaactacattggcgtcagcacggtgttgaacatcctggtgcttgctgatcagcatcactgcgacgggctgaagaaggcgtgttttagttttcttggctcactggagaacctgagtgctgttgtcaccggcgatggcttggagcatctgagcaggagctacccctctcttatgaaagaactatttgttgtgatggcacttccaccgaatcatggttaatattcttgtgctctagcaatgatagttgttggtttctcaatctgaagttctgaacctttctcatcaggtagatatgttatcttcttttagcacgcaggcatggtgctgtactccctgtgtatatatgcttttgttatcaggtatactatgaaaaccaaaacttcaatgttttactgcttttgatcaagaatagtgacttgactggagttaatttgaagaaaacaggctggcagggcccgtcacttgtgtctgaatatgatgtatcatattcttcaggtgccctgttagctgctgcagtttatgtttgttggactactagctatgcttttaagttcagttggctacctttaagtgtgccaattttgtcaggatcctggctagcttcttttctgaaacatgataaactggttattgttatcaacttgtcatgcattcatgctaactagttctgagggagcttaagctgagcattattttttttctccctgctgtatgagggttcagaaacttttggatgcttattaattatgtaaccgtcacctatcttatgttggctatgaatacacgatgctaagggttatccctcccctgtttccttacaaaagttctttactattgttcatgttaattcaagaaatatttttgctagtcgtcagataaatttttgatagctcattgcatttcaacaagtcctgaaattcttgttgcatatactccatatgcatcaaaacttgaaatttacgcaaagttagtactcctaactgctgttgttgcccctggaagctaaatctggcaacatataaacaatggacaatatcagtgtgcattgttcagcgaacatgtgacttagatcatgaatagtggaagtttctcactatcctcagcctacaacctgttcttcctggcgcgcacgcattctttgtgtggcgagctgatctggcagacgagggcgccttctctagtgaagtttttcatgtggtcggcgacaaagggaagatgtatcacggcggataatttgcagaagcgtggttggcctcaccattctagttgctccttgtgccaggggatccaggaaaattgccaccaatcgagcgtgtgactgtggagaatgctcaaggggtggatcactgccccgtttcagcttccggcagagagtggtgctcagcttgtggactggtggctgatggcaaggttggtcttttgagcgagctacaggaattaaagctctcgtttcactcttcgtgatggtttattggatgatttggaaggagcgtaatgcccggatcttcgagcagagatcgcgcacagcaggtcagctatttagtggcatcagagagatcatgatctggaaggaggctggaatttttcggcaatgtgattagctgctaatttttctttctctttcttccttttggggcggcaccgcggcagccatttgtgttgttgcctgaatcggcagcctaatttagaacttgtaaggttcctaccaaactctgttaaccatttaatctttaagtgtccccctgctcttttcctttggtgctgtgtgagggatgcgttaggctggaaagtagctccttgttcttgtgaggaggtgcaaaatttgattctagacaatgttgtcacgataggaagtaatcttactgtgattgcagctggaatgtgggcgatttggaaagttaggaatgactgggtgtttaggaatgttttgatgaataatgtgatacatttgccttagaagatgctttcgtttttaaaatagtggagtcctttggtacccgagaaacgaaggatctgctggaggaaatcaggggcttgctcgatgccaaaatccggcaatccacgtagaagcagatggatgatggcgatgaagaggatgaagactggaggctttgcactgaacctggattgactatagtgcctggaatgtttaggcttttcggtcttttgtgtgttgaacttgggcttttctgtttcaagctggtgttcccagcatctgtatcgagcctattaagcttttgagtaaagccgggctcccagagccttttctctaaaaaatttagaacttgtaaactttgtaactatctattattcttaataaaatttggtcggccgacctggcaaaatcatgaatcaagtcaaactgcactctgataacagcagcatttgattcttcagtagatgacatattgacaagtaccctgttcttttctccaacaagagttggataaagattatgattttcgtggcacacttttcacactgctaaacggtgtgtttcgtgcgaaaactttatatatgaaagttgctctaaaatatcatattaatctatttttcaagtttgtaataattaaaactcaatcaatcatatgttaataccacctcgttttgcgtaaaaaacttaatctgcatctttatcttcaggagaaaagaacaccaaaagaagtgtgtgtgtatatatatatagagagaggctctattatacacccttctcttagaataactattctacacccccctcccaccttccatccgtccccacctccctcccgcgctccctctccctctccctctcgcgcctccccccaatctctccttttcttcttttttttcttctctccctccttctatcttttttagaaaaaataaatttgcgtaaaaaacttaatctgcatctttatcttcaggagaaaagaacaccaaaagaagtgtgtgtgtatatatatagagagagagagaggctctattatacactcttctcttagaataactattctacacccccctcccaccttccatccgggcccacctccctcccgcgctcgctctccctctcgcgcctccccccaatctctccttttcttctttttttcttctctccctccttctatcttttttagaaaaaataggaataaattggtggattcaagacttgatcccatgatctcatggtttatggtgagcacttctaaccaaatcaccatatgatgatttgtgaacaaatcagttatgtacctataacaatcataccttgttactatgattcggctgtaacattatcccagaagggtagtaacattatatgttactgcaaaaatgtataggttgttactgcactttttacagtaacaatatgatgaaatttgcagtaacagagaacatgcatagtaacagtggccctatagtagtaatgttttttagatctagagtattttaaatctcaatctttagagagtactaacgtacatgtgtcatgtcttatttttctaacccatttgcatcatggcgttcgtaaaaaaaagtgcttaatgaaactagaaccataataactattttttaacgttgttactgtgaaaagcagacgtgttactgcatattagccgtcgtgttaatacgctgttccagtgagacgaggactaaaaaataggtaaatctcaatctttagagagcaatatctctcacattatatcttgtatttccaaatcgtttgcaccatgaagatcataaaaaaacgcttaacgaaactagatccatcatggctactttttgacgttgttactgcgataatgttgtcctgttactgcacgatgaccgtcctgttactgcacgattcctacaagacaagagcagcaaagtggtaggtgggggaaggagtggtgggcgggtttgaccggcgggaggacgctttgaccgagg

SEQ ID NO: 57535 - DNA, 16971 bp, Oryza sativa
tattaacgtatgattgattgagttttaattattacaaacttaaaaaatagattaatatgatattttagagcaactttcatatagaaagttttctcacgaaatgcaccgtttagcagtttgaaaaacgtgccacaaaaatctttatcttcatccaactcttaaaagaaatgaacggaacgatagtcaatgtccctttgacaggattgttttgcttcctttatacagtttccccttgtttgatggagaccaggcagtaatcaagaacggccgatcagtttgagtcctgaatcttcacatattcctaaccacgcaagtcaaccaagattagtactaattcgttataaaataagtaatatggtttaacaagcaaaattgggattcttatgggactccaaagatcagtactaatcctattctagtaattattaatgcagtaattttgttaagtacatcccttcgtctctttgctccgtgctgtccgccctaaacctatacacaagagcatcgacaagctcgccatcaaaacattgtcctgcctgccatgtcctgttccgccattgtggccgacggggtgaccgggtaccacctcctcaagatcgacggctactcgttaaccaagggcacccccactggcacggccatcaaatccaacccgttcactgtcggcggctaccgctggtgcatcactactatcccaatggggagttcgtcggctccgctgattacatatcgttctttctctctctagacgaacggactaacccaattttgaaggtgcaagccaagttccagattagtttcgctgacaaagtgaattaattacaagcaacaacataacataatgtccacgacagtaaggacttttggtagtgactagtgagtatacgacttggggttttcccaagttcatcaaaaccgaggatttcgagaagtccgactacctcaggcacgactcgttcaccgtccggtgtgacatggtcgttgtccgcaagatccgtgccgagaaggggaagactgacccacctcgccgagaccttcgtgtccgtgcccccgtccgacatgaaccggcagctcggcgacctgctggagaccgagaagggcgccgacgtggtgttcgaggtcgccggcgagaggttcgccgcgcaccggtgcgtgctcgcggcgcggtcgccggtcttcggcgcggagctgtacggcctgatgaaggagggcgacgccgccgtggtcgtgtgcatcgaggacatggaggcgcgggtgttcaagctgctgctccgcttcatgtacaccgactcgttgccggagatgaagaataaggacgcaggcgtcatgtgccagcatctgctcgtcgcggcggatcggtacaacctggagaggctgaagctgatatgcgaggagaagctgtgcaagcacattagcatgggcacggtgtcgaacatgttggtgctcgctgatcagcaccactgcgccgggctgaagaaaacgtgctgcaattttctcggctcatcggcgaacctgagtcctatcagcaggggctgcctctctgttatgaaagagcttgtgttaggatgctggtgcatccactgaattagtgtgttctagcatttggtttaacctttctctcatcacgtagttctcttctcctgttttatcatgaagacttgcagttgtacacactgtttgaaaataaaaaaagaaaaataggagaaaaaaatatgacagaaaagaaaaataggagagaaaaaaaaaaccgagagaagcaaaaattactttcgagggtttagttatggaagccctacccaacggaattttccacgttcgccgagagaatgacaccatcatcctgggctatatttcaggaaagatccggtctagttctatacgaatactgatgggggatagggtcaaaattgaagtaggtcgttatgattcaagctcttttgtgctaggtatatccgtatatgatgttcgtaattccataaaatttatatgagttactccctccgtcccatgaaaggatttcgactttttacttacactatttgaccattcattttatttaaaaaatttgtgcaaatataaaaaataaaaagttgtgcttaaagtaatttggaaataaagtaagtaaaaaaataaaaaaaatttcaaatttttttaataagacgaatgatcaaacagtgtaaacaaaaaatcaaaatctcttatattagggacggaaccggctcctgtgacatagagaattctacgtcagagggatgttggacttccgatcgccgtcgcttgcgcatccaatggctcctgtccgcgtgtgatgatagccttctcgttcggcccataagcccattcgtcgccatcagattgctctagcatcgtctgccggagccgcgatagcgtgacggtgagcttgggcacacagctgagcaactggacgcagccctcccatgcgctgtccttgatgggctccgtcttggccaacaggtcccctgacgacgcggacgatgagcacctgcggttcggcagcgccgagagaagcgccaggtgtaagtgtcgcccgatgaacacgatgatgtgttagagtttgtgtcgaatatgtgtacgtagtcggttacagtttagaacttggagttgtaataggtattaggattagagtatgagtcggactctatcctaggatctctcataaatagaggggcgtgcctgttgtaaccgcatggtgacttagcatagcgagagggagcggctgccggcgtctaccggccgtgagtcgttgtaattctgatacgctgtatatggtggatcggggaggagcgcccgtaatcagtgccccggagatgtaggctacggctgaactccgttaccaaatatcgtgtctcggtgtcgtcatcgttttggatctcctatggcgttttcttccgcgtttagctaccgatgttgatttcggggctggttttgtaacaagtggtttcagagtctgcaggaggtccatggtagaggcgcgatagaggtgctccacacctcgtagcctgctgtaatgcccagggaggggcattggcgcaaggtggagcacgccggcgatcaacggagtcttgattggtggatcgaacacttctggcggcggccggaaccgtcgatggctgctttcaacagggagatgactagacgtggtgctcgggatgatggcggcggaagcgattggcaaatcaatcggtgggtcggacacttcgggcgggtggctcggactttccggtgagctactctcgacagggagacatgcggccacacgctcgggttgattgaagctggaggcgatcggcgttcttgatcagtggattcgaacactctgggcggggtggcccgggcctttcgatgagttgcgttcgacagggagacgtctagacgtagcgctcgggtcgttcagcggctgggaagacagcatgcgacttgtcggcttcggctcgcgactagattgatggcgatcaatcggaagtcggagcaggtggatcctataggctgttttggaggtgttgacgaggtatttgcacgatggaattgcttcaaaggcggcgtattttgtggcatatggctgaacaaagcctagggcgaatagaccggcatccagtagcggttcaaccctggagaggcattggttcaacctgtttttccctctagcagacaagaagaaaaccacacgggctgtagatcaatgacaacagttgttggtggagtcatcggtggtgcttggcattggtgctagatgttgtcagagatatgaagaagcccaggaggttagggtcacggcggtgtgcgcgtcctgcgtcaaagccgagccggcgacagagatcagggcgatgccgaggagctggctagggtttagctaggtcgtgcagggttcggtcttaagggtttgtggtgtggaagacacggacatggaatcgtctccggttcgggcatggcacggacacaattgaagacaaacagtggataccaagtttcaacacgaaggggaatcggacgaggacttcgattcgttcaggaatcagactcaatttttcccagataaaagtagcagaggaccatgggattgcaacaacgcaatcgaaacaaatcacctagcagagggcgagagtcgtacccgattttcgcagaggcggaggtggtttgggcggcgaggtcacgggcagctggagacacgtcattgcaggtggcgcgcggcggcgtggtactcggcggcattcgtcggagctcgggcaggagcttgcggcagcggctgcggtggttcccggcgaggaaccggcgcaggtcttcggtggaggcggctcccaggcgggttcccaaggccggcgacccctcggctcctcgtggggtcggcacaggcgcgcgacggcggagggaggcgacggttcccgaggcgggcagacgatgctgagattccttgcgggggccggcggcggcgtgaggagcagggcgcaaagtggcggcgcatcagaaagaagcgccgcaggcacggtttctaggaggagcgaggaggccgaatgaggaggaaaggagatcggtttctatctgattccctttgaccgctgttgactggcttattgactagaaaagaaaaccgaccggttttttggaggaaaaaaaagggttggttttgtccggctggtgactgtgcaagtttagtcggtgggtcaattaatcagagcagatcaatttaacagggcaacagctgttgagttgattatcgtcgatggcggcaacagcggtttccaaatttgaggtggtgaagttcgatggcaccgggaatttcgttctctggcagatgaggctgaaggatctgttggctcaacaggggatatccaaggcacttcaggagacgatgccggaaaagattgatgctgacaagtggaatgagatgaaggcacaggcagctgcaacaatacgcttgagtctctcggattctgtcatgtaccaggtcatggatgaaaaatcgccgaaggaaatttgggacaagttggcaagcctacatatgtccaagtcgctgacgagtaagttgtatctcaaacagcagctgtatggtttgcaggtgcaagaggagtcagatcttaggaagcacgtggacgtcttcaatcagttggttgtggatctaagtaagttagatgtgaaactggatgatgaagacaaggccataattcttctgtgctcgcttccactgtcgtatgaacatgtggtgactaccctgacgcacggcaaggatactgtcaaaactgaggagataatttcgtcgttacttgcacgagacttgagaagatcaaagaaaaacgaggcaacgaaagcttctcagggtaagagtttgctggtcaaggataagcatgatcatgaagcgggggtgtcgaagagcaaggagaagggggcacggtgctataagtgtcatgagtttggacatataaggaggaattgcccgttactgaagaagaggaaaggtggcattgcaagtttagcagctcgtggtgatgattcagatagcggtagtcatgagattctcacagtgtctgacgagatgtctggagaagcgtggatgttggactcagctagttcctatcatgtgacatcgaagcgggagtggttctcttcatacaaatctggtgattttggtgttgtttacttaggcgatggcacgagttatcgtgttgttggagtgggcgatgtcaatttcaagatgtatgatggaaacgaggtgctactttcagatgtgagacacgtgccgggattaaggaagagtttgtttcgcttgggagcctacatgagacaggttggttgtatcaggtggattctgataggaagaccatgaatatcatgaaggacggcaagactgttatgactggtgagaggacaagctcatgtttgtacaagttacaagggagtgctgttacaggtggagtcatggaagatgggtatgttggtgttgctgtgcatgatcctgaaggcggcgagcctggcgtaggctcgtcgggtggctcggcgtgagctgcggcagaaccaactcaagtcctggtacatggaggttcgagcaagtaacagattcaagttggcatggcatattcgccaaggtggagtttgttagagtttgtgtcgaatatgtggacgtagtcggttacagttaggacttggacttgtaataggtattagtactagagtatgagtcggactctatcctagaatctctcataaatataggggcgtgcctgttgtaactgcatggcgacttagcatagcgagagggagcggctgccggcgtctaccggccatgagtcattgtaactctgatacgctgtatatgttggatcggggaggagcccccataatcagtgccccggagatgtaggctacggctgaactccgttaccaaatatcgtgtctcggtgtcgtcatcgttttggatctcctatggcgttttcttccgcgtttagctaccgatgtcgatttcggggctggttttataacatgatgtacctgctgccggacaagcacaggatgtgcggcgcactcgaggtgtctgtgctcgcgcacttcgccgcacgagaccgcgtcaatgccctcctctgcctgggaaaccagattcggagagatcgccgtcctttgacagccccaatcgatgacttggctcacaaactctagattgtctggaggaagaagatgaacagtgcactcacaaggtgtttgacagagggagttttggtgctgtgtaagtgtcactggctcactgaagctttttattttctcatccttttatttgcagaatacaaaaactcaccatgcatcgtggcctcctggatgcgcgccctcacctcgctgccattgccgcgaatgtgttccatcccacacaagcgaagcggagcgcacgacgcggacgcgccgcgacatgaactaagcacgtccgaaggaatgcgatgccaatagaaattgaaacctgatgcaatctactctaggatgctgctaaaaacaaggacacacacatgaccactgtcggctacggcgacttcgtcccgccagcgacgctgccaagctgctcgcctgcaccttcgtcttcctaggcgaacggagcttaattctcgtcggccgtcgctaggctatggctcgagcgacggctccggcggctggtgcttccctttggcgtgagctcccggctgcgattctgcgaatgggcaccgtacggaaaggctatacatcgggcacgcgcggaccggagccgttggatgcgcaagcgacggctatcgggagtcgaacgtccctctgacgtacaattctctacgtcagaggagccggttcctcagagggagtatgacttatgagcatatatccttaggaggagtcgtgaggaggtcaaaatatttcagattcatataagttttttgattcttcaatagatgacacattgactacttcctccatttcatacgagtcggtttgaatttttttttcttaggactaaatttatagaaaaatttagcaacatctagaaaagaaaattagttatttgttttgtgttgaaaatactactacatttttatataacttagttaaactttactagaaaaaaattaaacgacttataatgtaaaacggaggggtatttttccgtaaacttagtctacattaaaaagtttgattagataaaagtttaattaggaaaaagtttaaaacaatttataatatgaagtgaataaagaaacagttctttattcttcaatagagacgtattgatagttaatgtcattacttattgagctattgacttattgagcttccatgtggaacatgcccccggtagaatccaagcgaaccataagtggcgccgtctagaaaaaccgggcgaccagcgccgggccatcgcccgcacgggaaaatgcattatcccgtgcgggcgtcttaatccgaccgcacagcataatggggaatattatcccgtgcggctccgtaacatgactgcacagaaaaatcgattttcacgtgcaagcatattaagtggaccgcacgcgaaaatacctctccctctcactcactaccaaattttcacacattctctcccttcctatccttttttattttcactcctctctctctcactttcctcctctctatcccttttttgatctctttctcttctcctctcctctcctctccgcgggaagcggccggctcggcggcaccaacaacgaggcagcggccgagaacgggcgggaggcgacacagcggcgggcgacgaggcagcgaccgggtgggcacggcggcgagcggcttggtggacggcggtggtgaacaactcgggcgcggcggcgaggagcgacggcaaccggccctcgcccggatccgcaggcggcggccgtcccctgcctggatctggccgctgtggtagtcccctcctcggatccgtgtgatcgggcggcgggcaggttcgacggcggcagcggcggcatgaagaccgcaacgacgacgggcaggcgtgacgaccgcgtcgatgacgggcgggctcgacgacaagtggcggcaaccgggagcggcggcggtggccgggtggggagccggcgcgacgacggcgacgacgacgggagcggcggtggccgggtgcagtggtcggcgattctagggttagggttagggtttttctacttttatttttttgtgttttttttttgcgtgcgggcggtataacttgaccgcggtccacttaacacgaccgcacgggataatcgattatcccgtgcggttgggccgcccgcatacgaaaatattgattttcgcaaacccctgaatgcagacgggcgctacctcccgtacggaaaaaatgcagacgggcgctacctcccgtacggaaaaatcgattttgaccgcagaaaaaaatgaattctgtactagtgttcttcccgtacagtttccctttgttcgctggagactggccagtaaccaagaatgggcgccggccagtttcggagtcctgcatcttcacaaatcccacacaaccaagccgccgtccgttgtaaactaatacggtttaaccatcaatgttgggaattcgtttgggactccaggtgaacattgacaagaaggttagtgtactgatcctaatctaattcttaataatatactactaatttcgatcgtcccttaattttcttctcatcgtcctctgcggctctgcccttcccctacttctcctaatacgccagcaattagtgcccctgcctgccatgtcctcttccgccgccggcaactcgtcgcggtcggcctccacctccaccatcgtggctgacacggagaccgggtaccacctcctcaagatcgacggctactcgcgcaccaagggcacccccaatggcacggccatcgcatccagccagttcatcgtcggcggccaccgctggcgcatctactactatcccaacggggaccacaccgacaatgcagattacatgtcgttttacctcttgctcgacgaaaagaaaaacaccaagaccaagagcgtgaaggtgtggacgctgtttcagatttgtttcgcagaccaggcaaaggcgctgcctacactaacatccaaaacagtgagaacttttggtgatggttcttcttggtcttggggctattcgaagttcatcaaaagggaagatttcgagaagtccaaggatctccgagacgactctttcacaatccggtgcgacattgccatcgtccgcgagttccttgttgagacgaccgaggtgctcccgcccaaatcgttcgtatccgtgcccccacccgacatgaacctgcagctcggcgagctgctggagaccgagaagggcgccgacgtggtgttcgaggtcgccggcgagaggttcgccgcgcaccggtgcgtgctcgcggcgcggtcgccggtcttcggcgcggagctctacggcctgatgaaggagggcaacgccgccgtggtcgtgcgcgtcgaggacatggaagcgcgggtgttcaagctgctgctccgcttcgtgtacaccgactcgttgccggagatgaagaagaaggacgaaggcatcatgtgccagcatctgctcgtcgcggcggatcggtacaacctggagaggctgaagctgatctgcgaggagaagctgtgcaagcacattagcacgggcacggtgtcgaacatgctgttgctggctgatcagcaccactgctccgggctgcagaaagcgtgctgcaattttctcggctcatcggcgaacctgagtcctgtcagcaggggctggctctttgttatgaaacagcttgtgttaggatgctggtgcctccactgagttatgcttaattagtactatgttctagcatgtggtttagagacctttgtcatcacatagttctcttctatatattttagcaatgcatggagacttgctgttgtacaccctgtctcggtgtcttggcttgtactatcactatcaggcagagctgcagaggtatatgaccttagtaattccatgaaatttacgagtcatgaacatcatcctaaggaggtaaaagtaattccagtttgaccgtgtgttgttactaccactgtaactttacatgaaaaaattacttcttgatttggatttggatgactggttgagttatgtaagcacctgtgctatattctcactactggaaagatgcttttcccagaaggccaaattgaatttttgggttctttcttataaaaaattgaatttttgtaggcacgtggagcaatcgcctgagcataggtgtatgtgaaaatctgagattttcctagatggacaaaacaactgcatgtgaaaaaggattttcataggcaggcatgttatgctgcccgactgcaaaagttttttggtgaaacaaataaaaattctaaaaagaatattccaacaactctaactctaatatacagtgaataattgtctccatggttgtccccgcaaatggacgccgctgaccatactggcattatctccgattccctcgacactggatctgtcgtctccgacctccccagtacctaatccacacctcctgatcagtccctaccgcgacctctggcggcggattcgcggtatccgaggccaccgccgtcaacgagaagggaaagaggagctgatgcggcatcatcggtgctgagcagtcgagaggaacgagaaggagagccgaggaggggactgcgtccttttaatttaactagtaaaagtatccgtgcgttgtaacgggaagcgtacagatcagaaaaatatgcaattaattaaaatacaaattcgctgaaatatttggaatttttaagtaggtatttgtataattaaataaatttacaagtaaagcaagtgtgagaaataaaataacatggttaaatttaattttattaaattctccatgattagtaacgctctttggaatttttttgtaattttcacagcttaattgctaattttaataatacaaacatcatttaacaattatttaattggaaaaagaaagaaaatctccttttaggtttgcttcgaaataaatacattacattcaataactataattataaatgcttctgaaaaaatgaagtactaaaaatgaactttttctctttttcttcggcccgagggacctaaaatagacttctttccggcccttgccggtcggcccatggccttttgcgcatgggcgggcgcactttccctccccaggccgcaacctgggcttaggccggaaaagtggcatcgctctcgatccctcttgggccgagaggagcttcgttttttaaaaggagggtcaaataattaattgcccctaaaaataaagatgtgacggcgaaattggttttttaagtgtttatctccttgttttgagttaatttatgttatctccatgataactttgttgttagataccttttctcatgtgtttttgcttgatgattcagcgtttcagataagtggaacaacattcaaggttcagtcctcgactccttttgtgctggtccataaaaatgagtcttgttatcatccgttttaaatctatctgaaagccaaatttattttaagatttaaagtgttcttaatgtctcttgatcaagaataattaatgtctggactagagataatttgaggaaaatgcatcttttggtggttctaaagatgtgaagagtatatgaatagtttgttcttcagcgtcacgttgaagtttgtacctactatttccaaacttgtcaggatgttggttagctagtttcttttccgaaacataaaaaactggttacttgttgtctgtgcaacagttttctgggtcaaacagaacatacaaaacaagttatttgttcccggagaaaactagttattgtttgtcatgctcatgctaactagtttagggagctcaaattggagcatcagctcagatttataggcttacagcaaacccatgattaagtcatgtgtcatgaaaccaatgattaagtgatgaatcaaatcaataggcagtctttaattcttcggtcgaggttcatatatatactgagaatggaaaatatccctaacaactgtgagcatgaattgtggaacatggggtgcagggtgctatattttttcctcttcttcctttttttttttgaaacaaggcaattttgctcctgaaaattgaattgagttgctaattcaaccgcatcgtcgatattgtagagctttttgtccagctgctgcaagctgcataacattgagggcgaccacaacgtgggaatagagggggtcttaagcctcctcactagtctatatacatcgtgggagtgatctttatagaggtcttttggttgagctacccatatggctaatgcctggccataaggaataaaaaaataattttcatctctctcctagcacactcttggtagttgagatggtagaaggtgggacccatcttaacaccccctcctagccatatacattgtgagaggggtgctatatctcaatgggacccacctggggcccacttgagcattatacattgctcatgccctgatcaacgccagcggtcattggtgacgctggccggccgtccttgtatagatgaacagggttttacatttcgggaagcaagataatttcagcggccatcaaaattccgaaatttcggatactttgaacggttttttttaaaaaaaattaacatatttttactgaatttgaacaaattatgaccaaattcataaatatttgaaaaaaaatctagaaaattcgctcgaaatatttgcttgccggtggggaggggggaggggggatttcggcaatttccaaaatttccatccctgtagatgattggaattggattaccgatccacattccagggctcccatcagttgccattttacctaaaatggcttatttggcttattagaaaattaaaattaatttataagtaaaacttttgtagatttgttcgtagcgacttaaaagccaaaattaacaaaaattacgttaaaagcatttcaaaatcaacttcaaaattaagttcaaaaattcaaattttggcttattctttggctgtttaggccaaacgatggggctgcaggtcatgtacgctgggctataaacccaattcgactactattaatttcggatttttctttacatgttctttttcatcgatcttttgagaaaacaagggaagaccggaagagtacgtgaaaacactttccccggtctaaaccctacaggaccagctagcgtgctgccatgtcccccgccgtaggccgtggcaacccgccgtcgcggtcagcctcctcctccaccatcgtggccgagacggcgaccgggtatcacctcctcaagatcaacggctactccctcaccaaggccaccacccccaccggctcgtttctcccttcgagcccgttcaccgtcggcggccaccgctggaacatcaaatactaccccaatggagatgacgtcaagaccgccgattacatatctttctttctcgtactagaagaagaagagaccaacatgggtttgacggtgcaggccaagttcaagtttagtttcgctaaccaggtgaagaagcaaccttcgctgaaatacaggcccataaagacatttaatctcgaggattcttgtggttggggctatgtggagttcatcaaaagggtagatctcgagaagtccgatgatcttagggacgattctttcaccatccggtgcgacattgtcgtcgtccgtgagatccgcaccgaggagacgaccgagatactccccgtcgaatcctttgtacccgtgcccccgtccgacatggaccagcagttcggcgacctgctggagaccgagaagggcgcggatgtggtgtttgaggtcggcggccagacgttcgccgcgcaccggtgcgtgctcgcggcgcggtcgccggtgttcagggcggcgctctacggctcgatgaaggagggcgacactgatggagtcgtgcacattgaagacatggaggcgcaggtgttcaagctgttgctccgcttcgtgtacaccgactcgttgccggagatggagacggaggaagacgtcgtatgccagcatctgctcgtcacggcggatcgatacgacctgcacaggctcaagctgatgtgcgagaacaggttatgcaagtacattggtgtaagcacggtgtcgaacatcctggcactagctgatcagcaccactgcgacgggctgaagaaggcgtgcttcagttttcttggctcaccggcgaacctgagtgctgtcgtcgccagcgacggcttcaagcatctgagcaggagctgcccctctcttatggaagaactggtcgttatgcttgcacttccgcctagtcatgcttagtgttcgtgtgctctttttttagataactagttatcgtgcacgtgtaaggcacgttttgacattatatacacagaagtagaataataaatgctacttttttatgcaacactccatataaattcttcacgtaaaaattgagtttcatagaccatatggagctttggaatttctgttaataaagacggatggtgcattgcatcttatattgtcactctaggaatgctcccgaggacaaaaagataactacacagaaatatttcactaatataaaaacagaaacaactttgaagtatctttgtctgagagtcactatgctcactacttatgtgagattgctagcatctctaactggaaaaaaagtgatctgctagcatctcatttttctcatttgtagaattgcattgcagagtaatactatagcctattatcagatagatctaatggttaaaaataatggctctaccagattaaatgaaaatcaatggctagatgtttgttttatagaattcctagtgccacatggcgacctagtagtgtttgtagaagtgtcacatggtaacttatgagcatttgtaggaagtttaatagatttttaatatataatagatagatatactcactccatcccaagagttagccatatttcatattttagtttttctaaataatttgttcctatttgtagtttctatgcaagaaaactgaaatagagaggtaaattaaatctttgattagaacccaaggagcaatattaatattcagtagctgcatacgtgtatacgctccttaatttttgttatatgcatgattaattaagttcttcttggtcatggtgataaaagtaataggtgtaactttagtggatggagggagtctatgtaactaaatatacaattacattgacatcatgtaatccttgctttatataattaactttcaccacattggatatagaaaacaatttggttatacagctctaatgtccttacacgttcatgtttattcagttgatacagtgacacattgcacgtgcattaccccttgacatgcatatacttaattaaaatagcacaatagagtattcatttgaaaaacattcaataaatgggagtgatataatcttccaacttcaaattagaactgtacattaccatagctgcatttaacaaataccgattgtagtgacacaaattaaattcaaaaccaaatatcagtacagccgaaaattgataatcatgcccaaaccatgtgtaagaacaaaccagatttcatgtcattctcgatgatattgttttccaaaatctcagtgcccttaccttagtcaaatcatttttaaaattgaaaaagattgaagcagtggtaaccaaataagaattggaacaattattcataaatacacagatatgtagaaataaattaaaaaacaggagcctggttgacttcttgagaattggataaatgaatgctcacaagaagaatgtagttgtgcaatacaatcataaagaaggtcacatgcaagaaacaatatgctaaaagtacatgtggaaaaccatcaagattgaaatcaatgactgaataggtatcgatcggtgaaaaacgactgaaaacacttaataacagtaccagtagcacttttcgcccacaaattcttcttcagttcgatttgtcgtcaactcagtcctaacaagcaaacaacaaaccaataagataaccgaggagcctaggaagaaaacaagattagattcattcaacttctgaggcaattgcaaggattaaatagaaagcatatgaattaggtacgggaagggaaaaggactgcatttgcctccattgccgaatcaaatcttcattgtcatatgtcattactgcacctgtgctagcattgcgaacaattgagagttaaactcatgattaattcttgaaaatatgcctcatggtaagttttataggggagtttatagcgctgaaccgatgacaattaaggattctcaattcacacaccatcatctcctagtagttgtaaacaaaatcacaattgttaggcaatcatccaggtcttgaagagcctcatcaatagtctctgttcaaccaaaagatagtttgctgaataatgctagagagtatgta

SEQ ID NO: 57536 - DNA, 8764 bp, Oryza sativa
catagatacaagaccaaaaaaaaaaaatcagagaatgtggattctattcaagaaacagagttcagaaaggaccaagaagccagtccgtgaacggatcacaaccgatgcagacaaccacattcacaacaggcatgagatccctggggccgaagaggtagttcatgccgtgatgccagaactcgcgcacacggaggggaatcggagcaggcagcatgcgactcaccctcttcctcctctcctctccacgcgcttattcatcttctctgtctccggtgagcgagtttgagagaaggggccgggcttctccggtgaacttcgacgggttagggaaggggaaccaccacggcgcctgcaggggcacacgatgcggtggcgtgcggcggggactcacgaggaggcgcgcagcgattgaggtggtccggcggtggaggcgcggtagcggcggcgctggtccaacgatggactgcgacgggcattcacacggctgagaggaggagggaggaggagcgaggagggggtggctggtccggcagtggactgcagcggcattggggaatcaggcggagcgaggcggcggggattcctcgctcggctgaggaggagggggcggctggtctggcggcagcggggaatagggtggagcgagtgaggcggcggggattcgcgtggatgagatgagaggagggaggatgcgtggagcggagagggggcggagattggtgcggcggactcatcgtgcgctcgggggcggaatcatctcgtttcggaggtcgaatcgctggtattggcacaacgattgagaatagattagattagatcagatggtgaatggacggatagattagatgagatgatggacggacggatgagatgggataggatgatttcaccagtaggattgtaagggggcaactcctcctttttatattagtatagattagtgttcgtgtactctagcaatggtaattgttggtttctgaaactttacccagaaaagcaggagcggatctagaaaagattaacaggagggtctgaacaaactatacaaaattataacccctcttctaatagatgtatgacaaaaaaaaaatagtgaggtcttcatgggatctcccatggttacaatatggttagtggggtttagagaccccatggtggatccgtcactacccaaaaagcaggtgatgctgcagtactccttgtgtgtagatttcggtttagctaaaatcatttttttttcagcaacttgatcctctgatctgcaaatcgtgcaggagcagcgttaagctggctagctaattaaagctagctaggtagacagttatttatatattcatacgaatttatacacatcatacttacacaccacttacgtagtaaaacccacttgcacgtcacttacatatgtaattagtatgtaattttaggatttacatatgtaattttaggacttacatatgtaatatttagagttacattgtaaatacaatgaaattgtatatgtaatttaagaacttacaatataaatatataccgattattttttagtgaaaaaaaaatatagcgccataaatatagctactctctccaactgattttgctataaggtacatgacattggccatccacaatgtagtataaaaccagtccataagcaataaaatattctattcaaccacctaacaacattgtggaactagtacatagcaagaaaatagcaaaagccacccataagcatatgggctgcccatagaggataaaatatgttatttatctctatttcctctctcctcctaatactagttgctatccatatacattgtgaagataacaatagttatagtctatatgtgtgggtcccatctatatggactacttttgctatatacattgttgttgccctatactgagcaggagttagcgattgttactgcttaatttgtctttttttttatgctatctctgcaactgcacttttagatttcgaaggattgtcacttcttacctggtgttaaacttccacgtggcatgtttgatttagaggatttggcatagtcacaaagttcccagatcaatgggttcaaggattaggatcgaggaacgtggtacgctacttgcaaagaggtttttataatgtgaggacaaaaatgtccccatgtggaagtaaatgagttcgactgagggatgagagtgtgagagagtgaaagtgtgccagtggtcactccggccgcagcggccactccggcgccggcggccacttcccctgtctcgctcgagccaacatgtcgcatttgaggaggttgtcgtggagtgatcaggttgtcgccaggcagccgacatccgaggaagaggacgtggatgcgggtgggcgttggacggaggttcggcgcaaggtcagaccgcattcatggtggtcgagcaacgccccaaccaccaacgcttggggcgcattcacggcgccaaggacggtgccccgctggctccaaggatgttgcttcaagtgcttgggcctaaggggtgatgctaattggcgcgtacgcgcacttgctcccacgcgactcgctcttcccgcatgggacgcactttccgagcctgctgctaatgtctgtgttagtgctaatttttagcggtttgcacaaattgatttttttaataaaatgataaataaaatagttgggttgaaaattttaaaatacgaattgaatgttttgaaagtttagttgaaattttttgaatttgagttgaaagttttcaaatcatgacttgaaagttttcgaatttgagttgaaagtttccaaatttcaattgaaagtttccaaattcgagttgaaaattttcaaatcttgactgagttttcaaatttaaattgaaagcttcaaatttgagttgaaaatttttaaatcttgacttgaaagttttgaaattagagttgaaagtattaaattttcagtagaaatttcattctaatttcatttttttcatacactgtgtatataaatgatgtgaacttaatcacgtgaaagatagagaagagatgctaactgcacctgctagaaaagttaatcatcgtgggtcgggtgatgctaattgacgcgtacacatgctagtatcccgtcaaacacgttgctacacttgcgaaaattttttgaaaaaatactattcatcgatctttctttcataaatataccggatgtggtttgattagcataaatataccatcgaaatcgcgtttagaaagcgcgataccgaggttcgctacgggaaagcgcgatatcgccacggtatcgcattaccaatgcgcgagagcgtgacggtctcgcgcatcgaatgggcgaggagatttaagctggcggtgtcgctggttggttatgcgatatcgacgcggtatcgcatttccacggagcgagagcgccacgttgtaccgatttgggtgcgacgcaggtggagtgacgccatcggtctcgcttattggcagcgctggcccgcggtctcgcacccccgaatcgcgagagcggcatcggtatcgctctttcagagcacgatagcggttgtggagtgggccccacggaatttttttgctgggagatcaggcagccgtggtatcgcaaaggcggttgtggagtgggccccacggaatttttttgctgggagatcaggcagctgtggtatcgcaaagtgggagtgcgatgttgcgcatgggggcccgcagtctcgcacgttggttttgtgagaccgaaggcaatgtgacgtatcggtgctagagcctacggtgtcgcacaaacaatgtgcgagaccgcacggcatggctgccacagggccagtgattaatgtgttaatcaccttgattagcaactaattgatcattaataatcattaaataatcactaattatggtaattaatcactaattaccgctctcgtgttcctgtagcgtgagactgcttgggttgcagtcgccggccccagggctctcgcatctctcttgcgtgagaccagcgctctcgctttcctctcgtgcgagatcgcgcatcgcagcagttccgggacccaccgacttgctctcgcacttttagggtgcgttcgttcctgggggattgggtgagaaagcccatcgtattccgcgcgcatgcttcccaaactactcaacggtgcatttttttaaaaaaattctattagaaagttgctttaaaaaattatattaatctatttttaaaattttaaataattaatactcaattaatcatgcgctaatggctcacctcgttttgcgtatcttcctaatcttcttaatcttcttctcctcaaactcacccttagagtgcgacaccgtgcgctctccctaattagcaaagcgatattatatgaccgcctaggccatcgtgtgcgctccgtcctcgcagaccgaacgagcgataccgctctcgttctcgcgcctcgatcttgtgagaccgtggtctcgctcaatgaaaccgcgacggcggtatatttttgcaaatcttcacgcgttcagtattttcttgcaaattctacagaaaatgcgtatatttctaaaattttttcctacacttgctagtatcctgggagtagattttaatcctcgaggggatgtcccttcgttatttgcacgtcacttaaatagttatgaaaaaaattatgaagatgtattaacatatgatatatcactccacaaacatttaagttcaattcaactttcacatcaagctaattactataaataacatgtagatggagggagtattaaacataaataacatgtaatgacatttaaatagaaagagtaattagagtcgcgcgaatgcgattaataggttagtttggttgattgagcattgacaatatcagcgttacaggcttacagtagcaaacccatgattaaaattataaaccacagtccgaaaaagttttgaggcagtgttacatagggttttcttttttaaaacaaatttatacgaaagttgctttgaaatactacctctgttctaaattaattgtagttttacgttgttatcatatattaaggtttgaaaaaaaaaactataatacccgtagcaatggtttatattaagagtggagggttgttgagggtaaaatagagataaatttggatgagaggtgattaatgctatccttagtattctattgtgacaattattttggaacaaaatcaaatattagaaatacaattattatgggatatcatattaactcattttttattttttaagcctatactatatgctagccaagtaaatatgcaaccttttattctccagtcgaggccttttctcctgaaaattgaggcatatggaaactactcaccttttgctgcagcaagaataactgcgcagatcagttgctaatttaaccgcatcatcatcacgtatgtggtaaagctggcataacgttgatcgacaattcgccatagcaagcatgggccgtccgtccattggaccgaatttctcggcccatatacacgggtgagcccacaatagccctataaataggtgggcccaaggaaaaacgcaatgctctctcgcttcgtctcttccgcgtcgtctcccgactctcccctttcttccccaaatccgcgctaaaccctacctgcctacccgagcggcgcggcgagcagtttccggccatgccgcccgccgcccgccgcccgccgcctgagcccgccgcggtcggactccacctccaccatcgtggccggcacggcggccgggtcccacctcctcaagatcgacgggtactcgctcaccaaggggacccccaatggctcgttccttatctccagccagttcaccgtcggcggccaccgctggcgcatcaggtactatcccaacgggttctcatccagctccgccgatttcatttcgcttttcctcgtgctagacgagaaggtgaaggtgcaggcgaagtcggacttccagatcagttacaccggccaggtggatgagccaccgtggttggcaaccatgaaagcggatactttcgatggtgcgggctttcggtctttcggctatgaaaagttcgtcagaaggtgtgactttgagaagctcatcagggacgactctttcaccatccgttgcgacattgttgtcatcgacgagatccgcgccgaggagtcgaccgagatcaccaccaccacagccgccgtcgtcaccgtgcccccgtctgacctgaaccagcagctcggcgacctgctggagagcgagaagggcgcggatgtggtgttcgaggtcggcggccagacgctcgcggcgcaccggtgcgtgctcgcggcgcggtcgccggtcttcaaggcggagctctatggcttgatgaaggagggtggcaccgccgccggagccgtgcacatcgaggacattgagccgcgcgtgttcaaggtgctgctccgcttcatgtacaccgactcgctcccggagatggaggaggaagacgtcatgtgccagcatctgctcgtcgcggcggaccggtacaacctcgagaggctcaagctgatctgcgaggagaagttgtgcaggcacattagcgtcggcacggtatggaacatcctgccgctggctgatcagcaccactgtgacgggctgaagaaagcgtgcttcgatttcctcggctcactggcaaacctgagtgctgtcgtcgccagtgatggcttcaagcatctttgcaggagttgcccctctcttatggaagagctggttgtcacgctggcacttccagggagtcatgcttagtgacttactgttcatgtgttcttgcaatggccagtggtagtttttgttgctgagtttgaacctttgtcatcaggtagtttaatttgcttatcttcttttagcacactgatatgcgggtgaattccccgtgtttaggccttttaccatctatcctaagcagaagttagaaatcgtctcagttttttttactatccctacagcttcactattaaatctctatggattgtcacttgttacctggtattaaacttaactagatgctggggcgcgccaatggcgcgccgcctacacatagattggttgattactgtagactaatcatttgttttctggctgaatcaatgattatgtaaggagaaaacccacgaatacatttgcaggggatgctgttgatgagtaattttgcatacatcgttgtacagattctgctgagaacaaaactcttacacattacaatctaaagatgaagcaccaatgcatataaaaaatgaaaataaagttttacataatgatcggaataatgtgtccatggtgatggtacaactatatttgatcatacaaatctaccagtcaaaagaagacattgtggcaataacattctccgctgaaaggttcacatctggagtactaattgcaatggacctgttcaagcacaatccatcagcattcaatgagttttaaaaaaaatgtttcggaggatattttcaaatcagtatcaatggaagctcataagacacttgttaattggatttaggaagcgtggcaacataatatttccattttacttctcaatacagatagttatatcaagtggtacagcacgatactacagatttgtgtttatcacatggaaatgcagtgagagcaaaagaactctagaatagattgatatggaattaagcatgaagggtaagaaatttacaggataatcaactaataattatccttcactttttcctacactaaggcaaaaaaaatgtgtaaatcaaattgactgtcactgagaagatgatattctgtcagtcaaaaacgctaaaaaaaatacaatagcaatgcaaaagtaaacacctttcatcgcttgagttgcctgaagctgaaagccattcaagatccagaaagtttgaatcaccagaatgaatgcaactttcagtttcaacacctagaacatgatgtatctgaggtaccatgggagtatacctgtagcgaattttgagagaggaatgttagtactccactatttaaaacaccatgctttttcatgattttctaggaaaatacttgtatgagaagaatgaaggtcaaaaccctgaatgaatagaaaccaaccttaagtttgatacctcactttcagaggtcaatgaaatttcattgccatgtactgaattagattccaacactggaaattgtgacccacttttaacatcaagcaatactgcattcaacagctccttgtctccattatggcaaccactacatccagatatggatgtgttgctttcacaaagaatgttgccatatgatctcactctttttactgtattgtggaattaaagaaaacagtataagaaccccttactgttttacaatgtgcatatttcaataaggattatttttgttttcttcgaacgtaatcagcagggaagctacaaaaggtaatacatggctaaaagctctagtttaaataggaacatcctgctacagttcaaacacgttttggaatagcaaatcaacataacatgcaactcctaactatgttttcactactgcgtaccattgacgcctgtaccatgatttttttttgctacttactgttttttaacaatgcttcagatgacctctctttgcagagaatattttcagaaaaagatcacggtacagataaattagacgaatgtccatctaaaatgagaaatataacaccatatgaagtcaagcaaaagggcaaatatattctatactgaagttaagtccatagaacagcagtgcagaatccaccaatgtccttg

SEQ ID NO: 57537 - DNA, 26246 bp, Oryza sativa
aactcacctcacttaatgaacatttcttaaaatgatagcgtgacttgaccatagaatctaatggtgcacaacactccccttcttgaatattgtcatcgattttcaaaacagggttaggtaaatttatccgaatagcatcaacgttgtacgatccatttagtttctcacatttttccatatttaaaggagtattcacatctaagcatatataaacacgatgcaccatataatctcctctattattatatttaccaatgacatgataattattccaagaaaaacatggaaaatcgtaaaatttcttctctaaggtatttagatcacaaggagcatcaaattagatataacctaaagtacataaagaagacaataatttcagctcttcttggtcatcagcgataacatagacatgtttattttgagtggaaaccaaatattcagaaatagaagtaatgtgttctttcactagttgtggcatgtatataagtgaagcattgcacaactctctcattacaagcattatcaatatcaacacaatctgaatttttagcttgtgataaaggcaaattagaaatctgttccactagaggttgctctaacatagcataattagtggacaattgtagcatatcgcaatctttcttaccttggtccagttgaccatcagttaaattacttgaaacactctcttcacctaatttaggttcttcattctccttttcttcaaaattgtttttaccttcctgcacgatgttagatacaatagaaggcacaaaaatattctcatttatcataggcatttttgtttctttctcaatctgactttcaatatcgcaagcaagcaaaagtaactgaaaaagatggctatgtgttttattttcaagcctattctgaatttttaaatcaagcccatgtaaaaaccttgtaattgtatcttctctagactcccctgtaccaccgtaaaacatataaattttaaactcccggtggtactctttcacggttctattcccttgtttcaaattttgtaatttcttttgtaaatcacgaatataataatcgggtacaaatctagctctcatcattgtttttaagtcattccaagaacccggtttcttactgacgagacaaatatcactccaccaaagagatgcaaaagtaaaagaactggtggcaactttaatcttttattcctcagaccattcataatattcaagttcatcttccacttctaactcccaatcaatatagttcttagtattaaacttaccaacaaatggaggcaacgatatcttatttttacaaacctcatcatgtacctcttcttgatgtgaaagccaatgttttatatgttcaatcccgttctctttgtacgctcctgtcattgttagtaaccaaaagaaactcacaagaaagtgttagttcctaacaatttatagatatttggagcttttgaaggcactcaacactcaagcatataccaattcttataatgttctcaaagaatgcaaaaacaggtcaatcaccatggctggttcatggcacaatgacacgcttgatgagtgaagcgattgtaaagccggacctataaaggttagtagtatgtggatcttggtagacctaactatatcacaaggaatagcaaaaatcaaatagatttgtgaaattgaataatagtccaaagtactagtcaaagttgctggcctagtctagactcaatccttgttcaagcaagcaaatgatcaacactcggactagaaacaactcgactttatcacatagtaagcaagtctctccaagattccaacaaaacaaatttccacactttcttttttttttctgatttgtttgctcttttctcttttttttctgattttttttgtgcggctcttttttttgcacctttttttttgccttttttttttgctttaacaagtggcaagtgcgtgcgcgcgcatgcacaaatacaagcagctgctagctattactgggagagaagatcacgtgcatgtatggaacttgcatgcatggctaaacaaaggaaatacaccaaggtaattacggagattaactactgaaacaaagaaaccgaaaagcaaggagactgaacttgtatgcacgagataaacaaagggcccacccaatttatgtgttgcgctgcacacagtaggagggaaacaaaagagataatctcccccaactaaaaggaaactgactgaataatttagaggaaacagatccttataatttcttgcgcaagcaacaaacttaatcatgaatcgatcaatctgctaattttcttcaacctataacgaacatgcagtgcacaaccgagatgcaaaactcaaaccaaggtgatactaggactaaaatcagcactccgacatgacgatggaccaaaaactcaacaaagcaaaactgaataaaaattgcacggctcaaaactagggttcggtaaagggaaaagtggtacggcaatttgtagatgataggtaggaaaaataaatatatacaactgaaatcctcactaggtaaccgaagctctgataccaactgataacaatccggcccaggtggggttggccgaggcccaataacttaaggttgctcggaccccaacaagctttggcacagctactcggggaaatgtccaatctccctaaaagactagtccaataggggaagggtggctctcccttttaaggtggctttctcctcccaagctaagcaaggtgggattattcagagcctcacacggtcgccgcccgactttagcgtctctaccagcgggtaatagtggagaatgtcctcatcattcccacccccttaaacaagggcacagctctgataccaactgatgacgctctctctcgtggcccgatcttctggtgaggggataactctcgttttgatcgagtgcgatgtttgcgacgtggctaccaaccagaacaagtccaggacgccgtgcaatcgctacaccacaaacgatgtcgtaccaaccgtgacgcgcggttgatgatccctacaatgcaaacgagagaacactgcaagaataagataagatgcaatctaaatattacgaataggtgattaagcacaaaggaatagttgcgattgaagtagtagatctaatcgacccggtaaatcgacacaccaactattgggggctctgaatctatagtcgccgactaatcgagcgaggactagagacaaggtgaatggcacatggcaaaattcatctaaacaaaacccaaatgtttttgaggatgtacaaagctatttataaaggaaaataaagctagggttaagtgctaattcgtggaggtggagggagatacttccgagatgggcctagtctattacaaggcccaaggcccaagttcggtttcagcaacagtactgtcttgttttggcgattcccgttgactcgggatgaatttggacatgagaccagacgcgtttgaaaggtagcgagataagctttccacaaagtccaagatcacccaaatcggagttggcatgaaggctctaggtccatttttgaagtcagtgctgtctccggaggccgaattagattccaaaactcattggactttaatatcttgtatatccaccattcatctgatgtattatttggaaatgttttatatttctcatgcttggtggtatgcatatacatgatggtcacatcaactcttctgatggccccccccccagctcaagtgcgcctgtggtcacccaattggatccttcacatcacctataccctagaatcatggtagacattttatcaaatgtgcataaaactggttcactatcatcatttttgcatcgcaggcaaatccccctagcatgtatttgttgcttaacgtgactttgacctgcaaggtggatgcaaagtttgaatttgggaagatctccttcatgaatatgtcgatgatatggttgagtactacaacaatggcgccatacattgccacgatgaagccatattagtcttttgaagcatgagttggaagagaagacgacccaaatgcaacagattgaagaagataacgagaagtgccttgcatagcttaaagagaacattgctaagttgaaggacaatgaagacatcagaagggtcctcaaagaattggacagcttgctaatttctaaaaaggatcgaacagctacaggggtaggggatgcgtttagtttggggacaaggtgcgatgggttagactcatccctgtttttaggatgggatgatcctatctgtttggaagaggggatgggatgatccaacttttgaaggaatgacccacatgtcagcgagagaaaaaagtgggttggattggtatgccgatttttgagggacaataccaacccgatcttcgaggaatattccctgtcagggaccatcctatcccacatgtccccaaactaaacacactgaaaaatgggttgaatccaacctaacccacccaaccgtttaatcaaaatcctcctccatggaagaccaaaagtaaagcaactatatataccagactattggatatatatagttgaaccaaaaattatttttctaaaaaaattatgtatatatgtatgaacatcgcaaatcaccctatgattacgctatatttcaggacacacatttgggcattagatagctaggatatcgaccttttcattatcattctgtaaatgaatgtgtcgattactgcctcaaaattaaagctataagatgaaatgtgatggggaaaaatcaatttgattattttttcactaatataaatcaatttatttttcacatattttcgcagcatacaaatgtatatgtgaaggatagtttatttttttcatggaaaatggccacaacacaaatacacatcaaataaagtaatgaggacacgactagctcggatatgaccatgactatcttatatcttatgtattcatcaaacaatggtgcatatgttctatatttggattttagatgcagaaaaaacaacaaacaccgaagcatcatatgcagattaaatgaagacgagcatgtgtaccttaagtactactaattcgtctctagcagatatttttcccatatacaagcagtacaaattttgctcatgtccagcaccagctggatgtattctctcgatcgaaaagagaattgaaggatcgatggaaaaaagacaagtcatatctatctctttgttgtcaacagactagctagtactccccccgtcccaaaataactgcagttttacactattcacattcaacgtttgatcattcatcttatttgaaaaatttttatgattagtatttttattgctattagatgataaaacataaatagtactttatgtgtgactaaatattttcaaatttttcacaattttttcaaataagatggacggtcaaacgttgggtacggatatccacgactgcacttattttgggacggaggtagtacattaaatttatttgaaaattttttatgattagtatttttattgctattagatgataaaacataaatagtactttatgtgtgactaaatattttcaaatttttcacaaatttttcaaataagatggacggtcaaacgttgggtacggatatccacgactgcacttattttgggacggaggtagtacattaaattttgatatgactatagctagggtccaaatatactgatatcaaaccattgcacagcctgaaatgtataattcaaatatttgtcatcattctatgccttaaatattagtaaatattctttcaggaaaagatggactgttgctgatacaattcttactcaaatctgaaactataaatgtggaactacataaaacccaacaagaacttggagtgtgctgcttcttgaactgtatgcaagcacatacatataggaagtcatagactaagagctgtagctattatttgaacattggcttgcacataataattttgtaataaaaaaaaacaacggaccaaactaattaaagaccagaactatcatgagggcatataagcctgtatagtgatcctagataccactaaactataagttggctaaattgatacaagaacatttgtaattctgcaaaataaattgctgctaaatttccatgcaaaaaaatagttgctgaattacgcagcacatcaaccaaaaaaacacaagtaagcacttcttgcattcaattcctagagcatgaaatggttgatttcctaagaatcatgaacgatcaaaaccaacagtagtgatttattttttgtttctcattatgatgtatatagaaatgcattctaaacgtactacggtctgcaatccagaaatttgcatgaacaaaatgcagatcattgtgtaaatttttgtatataattatacttgtgctggttatggttaaacttttctagcaattctcatgtccctgtagcctgtagggaccgacaacctagcacatatatatatacacctaacagattcactggcaacaataactgcaaacaaaaacataaatcagcaactctatggtaactgaagtacatcgatcagatcaatcgaactttctggtttataaattaaaaacctgtctattctattatattgttcttcgcgtatttatttgtagagccttcttatttgtaattatctttttagttcagaaagaaattaaacaaagaataatatatatacaacggtagatttttttttatggggagcacagagatcatttgagtctcgatcatatatatatacatacacggataacagtactataaccagaaacagggtaaaaatatcaagcgattttagatgcaacaaacaacaaaatatcatatgcaaattaaaagaagatcgacacgcatgtaagtaccactaattcatctctaccagagttctttttttcccaagtacaagcagtagtactttagcatatgcccagcatctggtgtataattctctgcaatgtagttctcgaaggggaaaaaaagattcatatctatcttgtattgactagctagtgcatcaaattttcatgactatatatggtccaaatgctgatcaaaccattgacccaagtaccccaaccttatatcatgcatcattcaaatatatgtgtcatcatcctaccctaaatgctgtgattctttctagaacaattaaactgctgcttaacacaattcttacttaaatctggcattaaggaactaataaaaaaacccaagatttagagtgtgtgctacttcttgaactgtatgcaagtgcatatatgtttatctggtctaattaatttgatactctcagaataggagaaggcgtataactaagttccagtgagctataatatgggaacactgatttataccctaattttagagaaaaaacaacggaccataagtccagaaactatcatgaataaacataagcccgcaaaaaataatgttatattagattctaattaaactaagttggctaatttaaggctatagacaaacatatatataattatgcaaaacacatttattggctgccgaaatttcctgcaaaaagaatcgcgctgctaaattacatgagtgtacacatcaaccaaaaacacacatgtgagcacatattgcattaattcgtcctagagcatgagatggttgatttcctatgaatcatgcatgatcaaaagacacagtgatcgatatatttttgtttttcatatgactagagctaatactgatatcactgtggatcacaatatggctgctggcgatcgatgctgacaggacagggagactggaatacactttcttctacaagccgatgctaatcgaagaccaaaagaaagctggttggacagtatattgtttatggcacagtgacatatatgctggaaagttgctactagctatgaagttttgtctgtcttggctcttttgtatttggctgtcagtttggaatttgctcagcccagacttgcctgtttttagtgttgttcatgttactgagcattgcaggatatgatggtattatatggcatcataacctggcaatttagttgggataatgtagttcagttctaatcttttaaatatgtaacctatgccactgattttttgcatttctgatcatatctgggagaggatatttctcatctatctcaaaataaaaaaagatattgatcatcagaagaccgcaccccggataaaatcagactactacgtatacatacaaactcaagataacagttttgtgatccctactggcacaagatataaaccagagtaccagaccacataataatatttcttataaaaaaaaacgtgccgaaggtctgactcatttcattgatactttgatagagaagagaaatgcaaaaccaacctaagaaaagattcgccctgaaaacaccaagctacaagcaccatacctcaagaacaccacaaataattaaagttatacactaaaacacctgctgcaaaagcaattcagcagtcagcacctgtagcatactagaacacaaaacataagcaacccacagatgccacgaaaccaacataagccctgctttgtagcccagaaaacgcttcaccacaaaatctcaaatggcagtatagcacacgcacaccacatcataaaaaaaaaacattgtttcaacttcttgttcgatcaacagaaaattaaagtctgacagcatactgataaaaactcaaatgacagtagcacaaggataataactagttgagttgatcaacatgaacgataaatcactactaaagcagtccaaaatgaaagttttaaatccagagagatcacataggatcatgatgatgccgaatccccttccttcacgcaatagtatggatcaatccatttgtcagatgatcacctcatccgacccaccacattgccgccttgtccttgacctgaaccagaggcgttctgtgacgccgacgacgatccatggccaccattatcggctgctgccacagctgccggagcagtagccgtcgccatggacgccaccggaaccggcaccatggatccgaagagctagaagtttgtcatccgcatggcagcggtggtggtggcggcggcggcttgccctaccatcggctcggaggtgtttgcggcggacggcgtcgacgacgagcccttctccattgcagctaaataaatctgatcaaaaaagagagcaagtgtcacgtacacaatcttgataagagctagcgagtgagataattaaataagtgtcacatacacaatcttgaggtgaaaagtggggaacacatttatttaagcagatgggagaaaaagattattataaacactgaaaaaacacacataaaccctagctatacttttatcctatttgcatggagacactatacgtttcctcatgaaatttttctacctgagcagatctattgaagaaaaataaaagagaatggttgtacatgtcgttgctcgcttaccttaacacagatctgcaatgaggagaaaccctgccaaaagacaaaagattatctatccggtagagaactagcacacaacagatccagatttgttttttcaaccaaaaaaacagtgaagaaatcagcatgaattaatcagacccaatgctttttcaatcaaaacatacagaaaatccctctccataaaaaaagacacaaaaatcaatctgaatcaccccagcacatatcagatctatataaacatcttgatatattcacatatggcagagaaaagaacaaatcccatgtagataccctagctacctcaagtcctcgatatatagtatcagaggacgaacagagatgctcctgatacatataaatcaatcttaaaacctattatattaattacctcccattcaaatttattcccattttatccccaactacctttttaacatccaaccatcccttatctaattagggatatcaaagtcttttctcctcaacattaatacgtgcaatgcttgcagagtatatggaatgttatgggtgcatatatggttttcctttatatgcatccataacagcttatattggtgttgattaattgcacccccaacatttgatcgagaggttcaaacattttctccattgggtatatctttttatttatatcgtacatctaatacaaatttcaattaaattttattcataactcaaattggaggtgtgaaattagtccaaattaattatcacgagtatgtggtttattttatgtgcatttgtgttgtggccattttccatgaaaaaaagagactatccttcacatatacatttctatgctgagaaaatatgtgaaaaataaattcatttatattagtgaaaaaataatcaaattgatttttccctataacatttcatcttatagctttaatttcgaggaagtaatcaacacattcatgtacaaaatgataatttaaagatcgatatcctagctatctaataccaaaatgtgtatcttaaaatgtagcgttatcatagggtgatttgcgatgttcatacatattatcatggttatagataccacatacccaatagtaattgactaagctcggtgaggcctaccatataccaagtcttatacataatcatatctcgtatatagaaggagttccggataaggaaggacaagaagagttatataaggaaactataagaactacccggattgtatccatatcgctctccctagttctacttggacaaggggagaggagggacagatcgacactgttaacgccaaaatttggtaaacccgaagttatcatcagcctagagtcaatatcggcttcagagtcctggaatcggccaatgggaattatcaagtcgccaatagccaaatttttgctatatttggtaaaggaaattaatctattaaagaaagtttatctagaagtgactgagttcaaggaggatgcggcatgacggtttatctattaattaggcagtatttgttagtttccttttatctttaggaaagtgtgtttagtgtccgataaggactttatgttttccttttatctttaggaaagtttctttcttgtcctaaaaggactactttctacccatggcgttgagccgagcggcctcagttgcaaggacaagaacatgttgccaccttgtccttgacctgaaccagaggcgttctgtgacgccgacgaggatccatgtccaccattatcggctgctgccatagctgccggagcaatagccgtcgccatggaagccaccggaaccagcaccgtggatccgaagagctggaagtttgtcatcggcacggcggtggtggcggcgatggcggcttgccctagcatcggctcggaggtgttcgcggcggacggcgtcgaggacgaacccttctccattacagctactgatctgataaaaaaaaggagagctgaaattaaacaagtgtcacgtacacaatcttgataagagctagttagtgagataaataagtgtcacatacacaatcttgaggtgaaaaatggagaacacatttatttaagcagatgggagaaattaaaagattgattattacaaacactgaagaaacacataaaccctagctacttttatcctatgcatgcatttcctgctcgtgaaatctacaatgaagaagcacctaaattaaccctagctacttgtatatatcttgtggactataggtttcctcctgaaatttttcctgctagggaatctacaatggagaaacacattaaccttatctacttgtatatatcctgtatggactatacgctttctcctgaaatttttcctgctagggaaaaatctacaatggatcagaaacacataaaccctagctagctacttgtatatggactatacatttcctcctgaaatttttctacctgagcagatctatatatcgaagaaaattttaaaagaacggttgtacatattgctgctcgcttaccttaacacagatctgcaacgaggagagagaaaccctgccaaaagacaaaagattctgcaaccgttagagaactagcataaaacagatccagatttgttttttcaaccaaagaaaacagcgaagaaatcagcatgaattaatctgacccaacgctttcaatcaaaacatacaatccctctccaaaaaaaagatacacagaaatcaatctgaatcaccccgtcacatatcaaatctatataaacatatcttgatatatggagttattcacatggcggagaaattacaaatcccatgtatatatgctctaggtacctcaagtcctcaacacagatatatagtatcagaggacgaatagagatgctccttacacatataaatcaatctgaaaccctattaggtctatacatctaagatatataaacagatttgtttcacagataagcagagaaagaacacaaatctcgcatatgctcttgcctctctatctctgtctacctcaacacagacagaaatcagaggacgaacagagatagatcgatagctagagattctagcttttgctggcttagctaggagaatatcgagacgagcagaaatcagaagaagagctcttgcgtcgaaatggctggagctttgcagatgagtttgggagagaggacgtgaggtgtgggtgcctatttgtagaggagggaaatcaatgcatgacaaatttgcaaaaaagagtatttgaaatttggagaaattttgtgggcgcgggctgcagttcacacatgcgcctaattcgaacgttaggggtgtatagatggtcttcctttttaagcatccatccatgaataatgacagcttccaagctattagctagcagcattgccacgtttgagggaaggttcaagctagcattcctttttctacttgctagttaaatatttttatattccaattttttcgtcctaaaaaaatatgtaagaagttcgttcaattttttcatcctaagagaaatttgaattcaaaaaatgctttgctcacaaaatacaaattggaggtgtaaaatgtatatttttgggctgcacatttttaccagggaagcttcaaatatactgcacgaaaaggagatgtgtgaaaaataaatcgatttatattagcggggcatgtcaatttgatttgttccagtcacgtttcatctcatattatgcttttaacttagagagaaaagatcgatatggtactacccaaatatgttcatttgcaacatggtaaggaaaagatcgatatgctactacccaagtatgtacctgatctgaagtaggagtagtactctagctagctagcagcttgtaccataaatatcttccttatttaggccatgtttagttcgttggccaaaattttttttaagtatacggacacatttgaagtattaaatgtagagtaataacaaaacaaattacagattaagcctaattaatctgtcattagtaaatgtttactctagcatcacattgtcaaatcatggcgcaattaggctcaaaagatttgtctcgtaatttatatgcaaattgcgcaattggttttttttcgtccacatttcaagctccatgcatgtgtccaaacatttgatgtgacatttttggccaaaaatttttgggatctaaacacacccttatcctttctcgactgcattggactagggtcttttagcaatcgccataaaagctagagagttgacaaaagggtgattcagaatgttagtacatataaggatttatagagtattacttgtcctattaattacctctcattcaaatttattcccattttatccttagctacctttttaacatccaaccatcgcttatctaattagggatatcaaagtcttttctcctgaacaataatacgtgcaatgcttgcagaggagtatatatatggaacgttatgggtgcatatatggttttcctttttatgcatccataacagcttatattggtggtgattaattgcaccccccaacatttgatcgagaggttcaaacattttctccattgggtaaaccttttatttatatcgtacatctaatacaaatttcaattatttttatttgtaactcaaattggaggtgtgaaattagtccaaattaatcatcacgagtatgtggtttattttatgtgtatttgtgttgtggccattttccatgaaaacaaaagagactatccttcacgtatacatttgtatgctgcgaaaatatgtgaaaataaattgatttatattagtgaaaaaataatcaaattgatttttttcctataacatttcatcttatagctttaatttcgagggagtaatcgacaaattcgtttacaaaatgataatgaaaagatcgatatcctagatatctaataccaaaatgtgtatcttaaaatgtagcgttatcatagggtgatttgcgatgttcatacatattatcatggttatggataccatatacccaatagtaattgactaaactcggcgaggcccaccatataccaagtcttatacggaatcatacctcgtatttctggataagaaaggacaagaagagttctatatggaaactataagggctactcagattgtatttatatcggtctccctagttctatttggataaggggacatctatgtgtatgaatagaagcccccctagggggagagaaaggacagatcgacacacaagttagaatagacaccaacacacgctgccaaacatcgacattagagataagcctagacagacccaatatggtgcatgaggaggccgacaagagggatctagcgccatctctgatctcgatgagttcgtactcgaggaggaagactactatatcgtcgactacgtgttggttatctatgctgccaagtcgacgccagctagataggttatcccaaatattgtacttgtgtgatctagatgaataaagagcaacatcggctacggccaacaggagtagggctattacctgtcagataaggggcccaaacctgtataaaaatcattttctccatcttttttacctcaatctcgcatatactctggtaccaacgatctccataccattcaaaaaccatagtcgtgacctcaaacgtcgacatatatatacataatatttttagaaaaataattttcagttcaacccctcgaatagtctgatatatatagttgctcacttcccctaaggggatatccccctacccccatagttgtctgatcctttttggagattaacaagttgtccgattctttaaggtcccttcggatgtcttcattgaccttcaatttatattagcaacgtactcttcaagctatgcatggcacttcttattatcttcttcaatctgttgcatctggttgtcttctcttccaactcgtactttagaagactaatggcttcatcgtggcaatgtgtggcgccattgttgcagtacccaaccatatcatccgacatattcatgaaggagatcttcccaaatccaaactttgcatccaccctgctggtcaaagtcctgtaagcaacaaatgcatgctagggggatttgcctgcgatgcaaaaatgatgatagtgaacatgttttacacatttgagaaaacacctgccaggattccagggtgtatgtgatgtgaaggatctaatcgggtgaccacaggcgcacttgagctgtggggggaagaccatcagaagaggggaggacagcactacatggagtatttcggttgatggaggaagaagatgaactctgcatcgccatggatcctaagaggaaagtgaaaatgcttaggtgtggacagagagcaatgtggcctggagacttcgatctgtattaattgagaggaggagaaaagcacttgtagaggatcagagctgaatccattgaataatatagttttggtacatacgtgggccaaatgaaatgacattttgttccatatacgggcgttagaaaatgagtggaatagcaaaataaaatggaatacctttgaggtgtgggatgaatggcatgaatctcgcgaagggcgatgaacggagatggttgtagggggacatacccttaataaggatcagaagagtttgccttattttcactagaaatactcttgaggttgtcgatttgcacctctagtgtttagtggcatggcattaatattaacaccgtagatagtaagtttatcaatcatgcaaatatatttacactatgcccttcgcaatgcagtagtgagcctacgacacctggtctgactagcaattctaactatacattgatctaattcaaaactcctatagtctaagccgacttattaaatgtggactaacatcggtctggctatgcctcaaaatggtttgactgcctatatcgcttgtttgaccagccttttgatacgtatgaccgacagtaccgaaaatataccttgacctctcaagatactagaccactaccatcaacatcgtagctgatttttgttaatcatagtataatcatcaccatgttttcatagccccaacctaatatgtatcattcaaagttttggcatccaactctaaatattactatatgattcttcttagaacaattaaactggtgttggataaattcttacttaaatttgatagattcttacttaaatttggcattaaggaactaggaatatatatctagagtgtgcttccagctagattagttatatatgcaagcacgtagtatatatgtttatctgatctatttttttgaatgaaattatctagtctaattaattagaaagtctttagaacaagagcaaatgtaaccaagttcaatgctatatagtcatatgtatatgggaacagtgtgttgcatagcttgcagctaatttttgaaaaaataacggaccaaattaaagtccaaaagttaccatgagagaacatataagccttataagcctgtaaaattaataatgatattagatactaaattaattttgctgaagtcataattataaacatttataattctgcaaaacattccgctgctaattaaattacactactatatcaaacaaactaaaaaaacttagcgtatagaattaataagaacaaaacaagcttaattcaatggaagctatctcggaaattttgactcctacctaattctctagaaaacaaaaatataactatattctaaatgtgtcttcatcaattgcagtagcgcgcttaattaaaacaacaatcatacatatgttatattaagcctactttgctaacattgtatgcaagtctgttcattctctcccaatgagaacaagtcagataaaccaaaaacacctagcatatcctgttgatctagaacatgaatgtgatgttgatctgccatgagcatgatcaaagtgtacacctcaaggatctcagatctcacaaattagtgcctcatattatgatgtatatgcaagacttcatacttttatatgaaatacatgcgctaaataattacaattcagaaatttagtgttttttttataatgggtagcaattaatccagtctctcttatatatcgatccacatgtgggtatacacagcaattcagaaatttagttacctaagcaaatgcatatcacactgtttgaaatatctgccaatgtgcatacatatactagatatatagatcaatatggtcctggttatttttttgacgcgagaagatagagccgactctaccagcttatagagccattacattgatagaaatgaagaggtacaaagtttttaaggttacaaaatgaaagaggaaaagtataaaaagagagagggagggaaggatttaaaggttacaaagtgaaagaggaaaagtataaaaagagagagaggggaagggagaagaaggtaaggaggtgaggaaatatacaagggagatatatacagtagtctgaggcgggtctcatccccacctcggaggagtgaacagctacaaattctacaggagttcatgcccacctcggaggcagctgaaacaagggagttcctatacccggattctacaattaatttccgctgcaaatgcatatcacttgctaacatatcatgaatccctttggaaacctgcggaatacacctggatcagaatagtccccaataattgtaaaattttcctttggttggcctttaaaaacaaactaaacaccaaggctaatatatatgcaagcacgtagtatatatgtttatctggtctatttttttgaattaaattatctggtctaattaattagaaagtcattagaacaaagagcaatgtatctaagttcaatgctatatagtcatatatatggaaacattcacttgcatagtttgcagctaatttttgaaaaaataacggaccaaaactaaagtccaatattaaagttatcgtcatgagagaacatataagccttataagcatgtaaaattaataatgatcttagacactaaattaatttttgcgaagtcataattatatataaacatatataattctgcaaaacattccgctgctaattaaatcacactacatcaaacaaactgaaaaaacctagcccaacaactagattatctacctggtctatagaattaataagaacaagacaagcttcaatggcagctatctccgaaattttgacaccgacctaattctagaaaacaaaaatataactatattctaaatgtgtcttcatcatatcaattggagtagcgcgcttaattaaaataataatcataaatatgttaagcttactttgctaaaattgtataaaagtatattcatttcccaaaagaagtcagagaaaccaaaaaaaaaaacacctgcgagagctagcttatcctgttgatctagagcatgcatgtaatgttgatctgctttgagcatgatcaaagtgcacaccttaatggatctcacaaattagtgcctcatatattatgatgtatatgcaagacttcatatacttttatctgaaaaatgcatgctaattaaattacaattcagaagtttagtattttttgtataatgggtagaaatctggcctctatatcgatccacaggtgggttaaaacagcaattcagaaatttacttacttaaccaaatgcatatcactgtttgaaatctctgaaactctgatgatgtgcatacatatatagatatatagatatatatacttggtgcgggttatggttgaatttttcaaggtgtatattctcatgacttgtagccgacaacctagctagcacatatatacagctagttagcagattttgagtggcatatgcagacaaaatcataaatcagcaacgatgatcaatatcttgatgatttatgaattagacaagcctattctattgttccttatgtatctacatatacacatgaaaattaaacaaatgcttttgtaatcatttttttagttcagaaagaaacagaatagtatacagtggtagacttttcagggggagcatagatctattaaggtggtgtttggatccggggattaaattttatagtccctgtcacatcgatcggatgtttggacactaactaaatgtattaaacttagattaataataaaactaattgcataaatgagagccaattcgcgagataaattttttaagcctaattaatccataattagcacatgtttactgtagcatcacatatgctaatcatggattaattaggctcaatagattcgtctcgcgaattagtgcagggttatggaatagcttttgtcattagtctacatttaatacttctaattagtgtccaaacatctgatgtgacaggactaatatttagtctccctggatccaaaaatagggtctagatttcatgcaaacgataacagtgctaattaccagaagtatgcaggatgaaattaaaaatccaagggattttaattagatgaaaaaaacaacaaacaccgaagtatcatatgcagattaaatgaagacgtgcatgtaccttaagtactactaattcatctctagcagatatttttttcccatatacaagcagtactaattttgctgatgtccagcaccagctgggtgtattctctcgattgaaaagagaaggaactccgtgccataaagttctcgaaggaaaaaagacaagccatatctatctctgtgttgtcaacacactagctagtacattaaattttgatatgattatctagggtccaaatgctgatatcaaaccatagctcagcctgaaatgtactataattcaaagatttgtcatcattctataccttaaatattactagtatatattctttcaggaaaaattggactggtgctgacacaattattactcaaacctggcactataaatttggaactaaaacccaagaactggagtgttctacttcttgaattgtatgtgtaatgtttatttggagtaattagaaagtctcagaataagagctgtacctattatatgaacattgggttgcacataattttgtaaaaaaaaaaaaacaacgaccaaactaattaaagaccagaactatcatgagggcatataagcctgtataatgatcctagaaccactaaactaatttgtctaaattgatagaagaacatacataattctgcaaaaataaattgctgctaaatttccctgcaaaaaaatcttgctgatgaattacgcagcacatcaatcaaaaaacacatgtgagcacatcttgcattcaattcctagaccatgaaatggttgatttcctaagaatcatgaacgatcaaaaccaacagtgattcattttttgtttctcatatgatgtatatataaatgcatgctaaacatactacggtctgcaaatccagaaatttacacctgaacaaaatgcagataattgtttgtcgatgtgcatacatataataatacttgtgctgcttatggttaaatttttctagcaattctcatggccctgtatctagggaccgacaatctagcacatatatactcctaacagattcagtggcaccaactgcaaacaaaaacataaatcagcaactctatgctaagtgaagtctcagatcaatcgaacttttctggtttataattaaaaacctgcctattctattgttcttcgcgtatttatttgcagagccctctcttatttgtaattatcttttttagttcagaaagaaattaaacagagaataatatatatacaacggtagaatttttttttatagggagcgcagagatcatttgagcctataaaaggataaaaatatcactacaaccagaaacagggtaaaaatatcaagggattttagatgcaaaaaacaacgaaatatcatatgcaaattaaaagaagatcaacacacaccttataataagtaccactaattcatctctaccagagtttttttcccatgtacaagcagtagtactttagcatatgcccagcaccagctagctggtgtataattctctacattgaaaagatcgaaggtactctgcagtgtagctctcgaaggggaaaaaaagatccatatatatatatatatatatatatatatatatatatatatatatatatatatgtggtccaaatgctgatcaaatcattgacccaagtacctgatatgtatcatgcatcattcaaagatatgtcatcatcctcctaaatgttgtagctagatattcttcctagaacaaataaactggtgctgaacaaaattcttacttagatctggcattaaggaactaataaaaaacccaagatctagagtgtgtgcgtgctactccttgaactgtatgcaagtgaatttatatggtctaatttgggagtctcagaataggagaaggcgcgcgtaactaagtaggagtaagttccagtgagctattatatgggaacactggtttatacataattttagagataaaaaaaacaacgggccataaatccagaaactatcccgaagaaatataagcccacaaaataatgttatattagattctaattaaactaagtagggtaaggctatagacaaacatatatataattctgcgaaacattttattgtctgctgaaatttcctgcaaaaagaatcgcgctgctaaatattacatgagtatacacatcaacgtaaccataattataacacatgtgagcacatctttcattcgtccgaaatggttgatttcctattaatcatgcatgattaaaagacacagtggtcaatatatttttgtttttcatatgactagagctagggtccaaatactgatatcactatatatagatctcaatatggctgctggagatcgatgcagacaggacagggaaactggaatataatgcactttcttctggacggtatattgtttctggagatcgatgctaattaatcgaagaccaaaatagagctggttggacggtatattgtttctggcacggcgcgacgacatatatcctggaaacttgctagctatgaagttttgtctgtcttggcttttttatttcttttgtattttggctgtcaatttggaatttgctcagcccagacttgcctgtttttagtattgttcatgttacggagcattgcaggatatatgatggtattatatggcatcataattaacctggcaatttagttcggataatgtagttcagttctagcctttaatttaaatatgtaatgccactgatttgaatttctgatcatttctgggagaggatatttctctcctgtctcaaaaaataaaataatgatcatcagaacacaacaccccggataaaatcagactaccatgcatacatatacaaactaaagatagcagtttgtgatcttactggcacaagatataaaccagagtaccagaccacataataatattttgtttataaaaaaaattgcgcggaaggtctgactcatttcattgatactttgatagagaatacaaatgcaaaaccaattacctaagaaaagattcgccctgaaaacaccaaactaacatatttgatcaacatgaacgataaatcactgctaaatagtccaaaatgaaagttttaaatcgcgcaacatatttgatgatgccgatcatctccttccttcacgcaatagttatatggatcaattaatcctttcgtcagatgatttcacctctcatccgacccaccacattgccgccgacgagctcgccgtcgatgggccgtcgccgccgtagcctgagcccgatggaccagcaccaccagccgccgccggtggccacagcggtggcgccggcacaaggaccctcctcgcggtccacgtcgagaccgagaagacgggcacgtcgcaccagcagatcacggggaagcacccgccgccgtgcgccgccctgagcaccccggcgccggcaccgcccccgcccgccgccaccatttgctgcgcgagcgtctccgtgctcgccagcgccctggccgccgtcacgggggagaagccggcggcgaccatccgctccgcccagcgccccagcgtctcgtgcctctcccgccgccccgtgccctcacggacgacgatgtccttgatctcctcgccgagcacccaccgctcgacgcacgcgcgttcgtgcggcggcacggccgccggcggggtggagctcgcctccagggcgtcgaacagcgccgcgtagtagttgagcgcgttccagacgcgcgccccgagctccgcgacgttgtggtcggcctcgttctccgtcaggaccaccagcttcgggttcaggtcgcggatggcgcggaggagcgcgtccgccttcgtcttcgtcgccgtcgtcatcgtatgctggctggatccggattgctccgccgccggcctcctgctcgcgacgccgtccacgtagtcggggaaggcgaggaggcggtggatctggaggttggcgacgacggcgaggggctggccggggatgacgacgaggcgggatccgattgatccggtggcggtggcggagagctcctcgatgctggatagcaccggatggaactggaggctgaggtcgaggcgctgggcctccgcggcgacgtacgcggcgacggcggagaggaagtcctccgactcgttgacgacggtcaggcggagcaggcccggcgggccgccggggcgcgcggcgacgaggcggacgagctccacccactggttggcgtcgacgccgccgccgaggtcgacgacgtggacgaccgcccgctcggcctccatcacctcggcgatggacaggttggccgcggcggcggcgaggcggacgaacgggcacatcgcgcggaacccctggcgcgcggcggagacggccggcggcggcggggcccgcgtgaggtggagcgagcggcacaccccgtcgcacggcaggatgaagcgcagcgcgagcgcctcggcgaacgcggacgccagccgctgcgccgacctcccctcgccgacgccgccgccgtcggcgtccccgccggcgaggtcgacgacgcagctcagcccgtcgttgacctgcatctggcacgtcccgtcggccaggaacgccgcgatggaacgcaggaagctcaccatcagaacgtcccgctccccgtcgccggcggggtactccgccgggccacctagggcgaacgcgtcgggctggatccccgccgccgccgccgccgccatggccgccaaggaggacccgaacccgagcccgaccaccgggcgcttccccgcgttggtggccgccggcgccgaatcctccccggccgccggtagccgctctcctcccgctccccctcctcctccacccagggctagcctcgggatctccaccgccatggtgaggttgcccgaagtaccctgcgccgccgccagattaagttggtccgaaggctaaagacactcgcgcagaaggacacactcacacacgacacgggggtccttttatatagcggcgggcgatggctaagggagactggtcagggactcagggcgtcaggcccacttggttgccctagtagcttcctcgttgagtaccgtagtttgtttcaagaaaaaggaggaaaaaggttgggccgtcggaagaaatgattagtttctttaaagtcaatttgttttttttataaccccatttcgaccaccgtctttcaaccaaaaaaaatgggtaaaataaccttcactgcatcgatttgaattagagtaagggggtgtttggatccagagactgaactttagtccctgtcatatcggataaatttggagtattaaacatagcctacttataaaactcattatataaatgagagctaattcgcgtgacaaattttttaagactaattaatccataattagcgcatgtttactgtagcatcacataagctaatcatggattaattaggctcaatagattcgtctcgcgaattagtccagggttatagaatgggttttattaatagtctacgtttaatatttataattagtgtccaaatatccgatgtgatagggactaaaaaaagttttaatcccatctaaacaaggtcaatatatttccactagtttatgtcgtgtcttagctattttctaggtatcaataaaataaagtaaaatccaaaacttttgaacacatttggtaccgatcgactaggcaagaggacctagctagttactcaagaagtgaccggccggccaccaagctaattgaagccacgtgaggctaagcttgggtggccaaccattctggtcaatccagttggccacctagcctgaccgctgcggggcaccaggctagtcagcatcaccgacttagcctaaaggcgaattgacctagcaagaagcccaactaaccaccaagtacactctgacaagccgatcggcttggcgtaggatgtacccgcctatcgaccgatcacttcataaagaaatgcgagggacaaaatcacctcctagtagaaatctcagacatcgcagaaactagacagtgccacattgcataggggagggggataacatcgatcatgggagggttatagccccccaactcaattcacacaccaccacatttcacacccaccatagcagctccattttgttatttttagtcactagagtatcctaaggctgtgttcgctccttcaggttgggaacccatctcctccacacgaaaaccggagcgatccattagcgcgttattaattaagtattagcaaaaaaatttcaaaaatagattaatttgattttttaaaagcaacattcgtatataaatttttttacaaaaaaacgcatcgtttaacagtttaaaaagcgtgcgcgcgaaaaacaggagatgtgagttgggaaagtgg

SEQ ID NO: 57538 - DNA, 2056 bp, Oryza sativa
aagatgatcacctcatccgacccaccacattgccgccgacaagctcgccgtcgccgccgtagcgtgagcccgatgcactagcaccaccagcaccagccaccggcagcggccacagcggtggcgtcggtgcaaggaccctactagtggtccaccccatcacacagaaggatgaaccgcagcgcgagcgcctcggcgaaggtggatgccagccgcagcgccgacctctccccaccgacgccgctggcgaggtcgacgacgcaactcagcccatcgttgacctgcatctggcacgtcccgtcggccaggaaggcggcgatggaccgcaggaaccacaccatgagaaggtcgcgttccccgtcgccggcagggtactccgctggcctacctagggcaaaagcgtccggctggatccccgcagatgccgccaccatggccgccaaggaggacccaaccacctggcacttccccgtgttcgtggctgccgccgaatcctccccggctgccggtagccgctctcccgctccccctccgcctcctagggcaagcctcgggatctccgccactatggtgagcttgcccgaaccctgcgccgccagattaagttggtccgaaggaattgaagctaaagacactctcacacagacacactcacactaaacggggtccttttatataacggcgatggctaaggaagactggtcggtaaggcccactttgtttccctagcttcctcgttgactactactccagtttgtttcaaggaaaaaggaggaacaatctaggttggaccgttagaggaaatgattagtttatttcaactcaatttgtttttttttgtaaaacccactattggccttttagaaaatggtaggcatttgtgtgtgtgtgtgtgggcgctcgcgcatgtgggtgtgggacgggcactattggtcaaaaggcacttatgaggcaaatgcctatgcctattaagaaaatgtgtctacaaggtatttttgttgtgaaaaaaatttgctacaggatactcaaaaagtgtggtctttactggtagacagtggacgcattaaaatacattatcaacccaattgataagagagaacccacgtaaaaggtcagtgtttccctcatctttttctctcttctctcggttttcctcctatctttttccttttgtccttttctaggactcattgaccaccaagcgcttccttgtgctcgtggccgccggtgaatcctcctccgctgcagccatcggtggcaccggtagtcgctctccccctccccctcctcctcctagggcaagcctcgggatctccgccgccatggtgaccttgccggagccctgcgcagccagatttgttaggtccgaaaaaacgaggaagctaaagacacacacagtccttttatatatgccgattgctaagggaaaccggtcagtaagaccacttccttgttgactacaagtttgtttcaagtaatagaggaaataattcaaagtactttctttcaagtcaatttgttttatgtaaaaccccattttgaccatcatctttctatgaaaaaaattgggtaaaacaacgttcaatgcattgatttgaattagactaatatatttccactagttttgtcgtgccttagctattttgcatgtatcaatcaaataaagtaaaatgcaaaaccacaaaatctcatggcagtatagcacaccacatcataaaaaaaaacattgtttcaactacttgttcgatcaacagaaaattaaagtctgagtgcatgcatactgataaaaactcaaatgacagtagcacaaggataataactagttgagttgatcaacatgaacgataaatcactactaaagtttttaatcaaaaatgaaagtttttaatccagagatcacataggatcacgatgatgccgaatccccccttccttcacacaatagtatgaggccaatcacacacgaagacacacatcaggaatcatgcatcaatccatgcgtcagatgatcacctcatccgacccaccacattgccgccgacaagctcgccgtcgccgc

SEQ ID NO: 57539 - DNA, 8478 bp, Oryza sativa
cattagactagaagtctatggtgtccctcgaccacgtggcgcgtgaagaggacccccacggcggcgttgaagtcggggtgtggagatggtgatgtaggttgcgatggagaggtgggcagcagccgctacagtgatggtagggatggctagggaggagagtgaggcaaggatgagatagggagcgaggccagtgccgcggtggcacccaccttctagccctccggaggggattgtcctccctagatcgatggtcagaagcctcctcgtcagttgccattatataggaaaaagggagatgccgggggcagagagaataggtggagagagaaacacaagagaggagagagagagaaaagaaagaaaaggataaagctgaggcatgacatgtggaaagatatctaaatagtccaatgctgtgcatctacactaattgctatagatatctaaattttcaaaagaaaaataaagcatgagtttattggttgcttatattaatggtggtgggagattatgtagtacgtggagggcatgttgcaacatagcgagtgataggcattatgacgggtgggctacggttgcctaggaaacaatatggcgggggcactattggccttttagaaaatggtagtaggcatttgtgtgtgtgtgggggcgcgcgcgtgtgggtgtggggcgggcattattggtcaaaaggcacttatgaggcaaatgcctatgcctattaagaaaatgtgtctacaaggtatttttgttgtgaaaaaaaattgctacaggatactcaaaaagtatagtctttactggtagacatcacaaaaacgtgaatttgtccgaggacactggacgcattaaaatacattatcgagccaattgatgagagataatccacgtaaaaggtcagtgtttccctcatcttcttctctcgtctctcggtcttcctcttatctttttccttttgtccttttctaggactcattgaccaccaggcgcttccttgtgctcgtggccgccggcgaatcctcctccgctgcagccatcggtggcaccggtagtcgctctccccctccccctcctcctcctagggcaagcctcgggacctccgccaccatggtgaccttgccggagccctgcgcagccagatttgttaggtccgaaaaaacgagaaagctaaagacacacacacagtccttttatatatgccgattgctaagggaaaccggtcagtaagaccacttccttgttgactacaagtttgtttcaagtaatagaggaaataattcaaagtactttctttcaagtcaatttgttttatgtaaaaccccattttgaccatcatctttcaacgaaaaaaattgggtaaaacaacgttcaatgcattgatttgaattagactaatatatttccactagttttgtcgtgccttagctattttgcatgtatcaatcaaataaattaaaatgcaaaaccacaaaatctcaaatggcagtataacacaccacatcataaaaaaaacattgtttcaacttcttgttcgatcaacagaaaattaaagtctgagtgcatactgataaaaactcaaatgacagtagcacaaggataataactagttgagttgatcaacatgaacgataaatcactactaaagtttttaatccagagatcacatacggtcatgatgatgccgaatccccttccttcacacaatagtatgaggccaagaacacacgaagacacacatcaggaatcatcaatccatgcgtcagatgatcacctcatccgacccaccacattgcctccgacgagctcgccgtcgccgccgtagcgtgagcccgatgcgctagcaccaccagcaccagccgccgccgacggccacagcggtggcgccggtgcaaggaccctcctagtggtccaccccgtcgcacagaaggatgaaccgcagtgcgagcgcctcggtgaaggcggatgccagctgctgcgcagacctccccccaccgacgccgccggcgaggtcgacgatgcaactcagcccatcgttgacctgcatctggcacgtcccgtcggccaggaaggcggcaatggaccgcaggaacctcaccacgagaaggtcccgttccccgttcccggccggatactccaccagcccacctagggcaaacgcgtcgggctggatccccgccgccgccaccaccatggctgccaaggaggacccgaccaccgggcgcttccccgtgtttgtggctgctgccgaatcctccccggctgccggtagctgctctcccactccccctcctcctcctagggcaagcctcgggatctccgccaccatggtgagcttgctcgaaccctgcgccgccagattaagttggtccgaaggaattgaagctaaagacactctcacacagacacactcacactacacggggtccttttatatagcggtggctaaggaagactggtcgataaggcccactttgtttccctagcttcctcgttgactactactccagtttgtttcaaggaaaaaggaggaaaaaactaggttggaccgttggaggaaatgattagtttatttcaattaaatttctttttttttgtaaaacccactattggccttttagaaaatggtagtcatttgtgtgtgtgggggctcccgcgtacgccgtgcgcgtgtgtgtgggtggtcggtgtggggtgggcacttttggttaaaaggcaattatgatgcaaatgcctatgtctattcagaacatgtgtctatgaggtattttttgttgtggcaaagtttgctacaaggcgctcaaaaagtgtggtcttcgctagtagacatcacaagaacttgaaaccacgtaaaatactttttccacccaattgatgagagagaaaccacgtaaaaggtctcagtttttccttcatcttcttctctcttctctcagtcttcctcctatatttttccttttgtccttttctaggactcattgaccaccaggcgcttcctggtgttcgtggccgctggcgaatcctccaccgctgcggccatcagttgtgccggtagtcgctctcccctccccctcctcctagggcaaacctcgggatctccgccaccatggtggccttgccggaaccctgtgcagcctaatttgtatggtctgaataaaagaggaagctagagacactcacgcagtccctttatatatgtcgagtgctaagggaaactggtcagttaggccactttgtttcccttccttgttgactacaagtttgtttcaagtaatggaggaaaaaggttggaggaaataaaaatgtctagttaaaattattttcaaattcaggcaaaaattgttgaaaaccttcacaacttcacaatttatttaaatcaagaaacaacaccttttctttgggcccctttcttttctttctccttcttttctccgatccaaggaataagtccacttcgattccctcaaatattctaccaatatgattcgtatcccttaaccgcaataccaagtatcttggccccatatatatatatatatatatatatatatatatatatatatatatatatatatataattgaaaaagtttcatactcatttgaattgggtatatactcaatttcaacaatggtgcccgggcaccatggagcaccaaacaaatttactatatatatatatatatatacatatatatatatatatatatatatatatatatatatatataacaagcttctgaggctgtctaagtaggattcgccaccctgcaaagatcctaaagttaaaaaattctctcgaagtgaacagtattgaacagtaaactgaataggaatcagtcgaataaatagtgtttttgaacagtgtatattgtctgaagtataaagctcatattcattaattctttcttcagactcaagattaggtacttctaagttgtcgagtttaggggaggttccaccacgctttcgtacctctgagatatatggaacattattcagaacattttctaagttctgtattttcgttaaattcagaacttgagctgtcaacttaaattcagaacaaataaaaaaggcaaaattaatataataaacccagagtattcccctgttctcgtgaatccacagtagcttgttgtcatctcgaaatgttagtcttctgaagtataagtggtatcagagccagtcatcatagagaaatcaaattcagaagctaatattggaaaggtaattactaccaaagataatctgaatataaggtgtacactaaatcacattgaagaccatagttggcactctaacaatagtcaattaaatttaattgttgatctgatatataatttttatataaattgggataaaaagcaggaagatttagagcgaaggattgaagatttgtttaaagaacaaaagcaatctgaagaacaatatttgcttgtcagtaataaattaaattcagtgccaaaagagctagaggaatataagataaggcagaataagatattacaaaacagtgactatatcaaagaattacccattaaaacgactataaaagaagaagggtattctaaaaaacccacatacaaggaatgcctaacaaaaggagtggatccattagatggggaatatattgattggaaaataatagaaaaatttgtagaagcctccccacaattaaagaaggaattaaaggaagaaatacttaaagaattaaaacaagaaatggatcagaaatttgaacaaataaaaaaggcagtaaatgagaaattagaagtttctttttctgatctggacactatggatcttggtggtcatgggcaaccagatgaatagaattctttaagctaaatatgtttttcaatatatattgataatagaatatcaacaatttgggcgtggaagaagaataaacgaagatttcagaagactactcaagaaggaatccagaagaaggaatccagaaggacaccctataaagcataaaggaacaatatagggtgcggtgaatgacatatccctgtgaagaatataattttcagcaactttcggcggtgaatgacatatccctgtgaagaataaaactttaggcaggaaaggcatcaactttagcctgctctcgtgaatccacagtagcgaagagataagcaggaggcacaagcgacgccacccctgacctctataaaaggaggggcctgcccagctgagggaagaacaacaacgaagacaccattcagagcaaagcttccaagcgcactctcaccctccattccaccgtttttagtagtagtgactttagcctaccttgcatagtatattgaagcaaggagttctgttataacgctgtgtgaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctatagaagaaacctcttcggtttgttctcgtttttagcctgcatcttgcataggcgtttggagaatcggtatccgtagagaagtgttcccttcgggtggaactgcttagggagacgataaactcttagctagaacaagtgtgatttggaatatctttttaagttgcttttaaaaagacagataggtgaggcatacggtgagtaccgagtaggactttacatcatctgaaacaagcttctgaggctgtctaagtaggattcgccaccctgcaaagatcctaaagttaaaatatctctcgaagtgaacagtattgaacaataatttgaacagtaatcagccgaataaacagtaaactgaatagtaatcagccgaataaaaatcagccgaataaatagtgtttttgaacagtgtatattgtctgaagtataagtggtatcagagctagtcatcatagagaaatcaaattcagaagctaatattggaaaggtaattactaccaaagataatctgaatataaggtgtagactaaatcacattgaagaccatagttggcactctaacaatagtcaattaaatttaattgttgatctgatatataatttttatataaattgggataaaaagcaggaagatttagagcgaaggattgaagatttgtttaaagaacaaaagcaatctgaagaacaatatttgcttgtcagtaataaattaaattcagtgctaaaagagctagaggaatataagataaggcagaataagatattacaaaacagtgactatatcaaagaattactagaaataataaattctagtaaaggaaaagagatagttttggcttcaacatgcataattacctcgtctcaagctattaattcagaaaaatggacctatctaggagtttgtttagaagaatagcaagcagagacgataaatctttaagttgtattgataaacaaaaaggtaaaattgaagacatagatgagcttgaagatattcagaagtagacaaacagctcgaaagatatcaaagagatactctgagggcaataagacctcaacaaatatattgcatgggattttttgagaataaaaatgggttatacagaatatctacagaagtagagttaagcgttttaacaaagccagttgagttaaaaattgtagccaaggaatttgaaaatggattaaagtattcagggtataaatatattcaccaaggtatgtatataataggaatcacaggtatgacaagaaagaaattaggagctaaagttttaataactctgttagataaaaggtgggacacaatagataaagcagcattaggatttttagaaagtgatatgaatgagaatatgttgataacatatatagccccagatctaatgatgcctataaaagaatttatagataaaatgagttttggttttcaaacaaagggatacgaagaatttaaaggaacaaatttgctagtaagcatagaatttataggaagattaactaatagaagtgcctccaaatacaaaataaatgtaaatgacgtgattgaaaatatgcactctaagggaataactttcatgagccctttaaaaataagttctgaagaaagggcaggagaagaatggaaaattagtgatttaattgaaagcaaaactttgaatcagcctgaaaattatataagttatcaaaacagtaaaggaaataccagcattagatttataaattacaaacccagaaccacagatgacttagaaacagaagcatctgatagaaatataatagataaaagaagacatagtatttcagagtttatggaaaagttagatcaagaaagtgagataaaatattacgaaaataaattaaaggaaataaatgaagaatataataactctatgaagtgtgagtggcctaaaataagagataaagaactttatttctatagagaattagctagagtaaagaaagtaaagaagaacgaagatatggcagtagaaatttttaaaaaccaagaaaccaagatagaacagataaagaggatagagcaagataagcatggcaaagaagagcaaaatcttggtaaaattttaagtgaagaagagcaatgggcagagaatgaaagattatttcttgaaagttatgaagaagaaattaatctaataaatgagatggagaatatagaaaatgaaatagacaatgcagaacaatataatgattttataaacacattagatgaagtagggttacataatcttgataatgcaatggaagctatggaagtggacttaggaacatgaaagagaaaaagatatggagaaggtactgtgaaaaacgaaggagaaagagaaagaccagctagggcagcaggaaaatggccccctgataaagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacctacatagaaacatttttaggtgaatctgctaaggttctatgggaacaatgggttgaaaagaatcctaataattatgaagaattgaaaagagctggtagcaattcgcataattttgcaaatgttatatctaacattattatagctgaagatccggaattaggttatacaactttgcagaatgaaaggttaaaagaaatagaaaaattaacgttaacaagttggaaaggcataaaagaattctcccaacattatttatataatgctacaactgctaaacaaggatataacaggggaatagttgaacgttatttcaataaattacctgacccactaggaagtatgatatttgaagaatataaaaaggaaactgaagga

SEQ ID NO: 57540 - DNA, 1969 bp, Oryza sativa
tagcctacaccttatattcagattatctttggtagtaattacctttccaatattagcttctgaatttgatttctctatgatgactggctctgataccacttatacttcggacaatatacttgttcaaaaacactatttattcggctgattactattcaataaacgaagatttcagaagactactcaagaaggaatccagaagaaggaatccagaaggacaccctatgaagcataaaggaataatatagggtgcggtgaatgacatatccctgtgaagaataaaactttcggcaggaaaggcctcaactttagcctgctctcgtgaatccacagtagtgaagagataagcaggaggcacaggcgacgccacccctgacctctataaaaggaggggcctgcccagctgaggggagaaaaaaacaacaacaacaaagacaccattcagagcaaagcttccaagcacgctctcaccctccattccaccgttcttagtagtagtgactttagcttaccttgcatagtatattgaagcaaggagttgtgttataacgctgtgtaaggtaagaacagcttgcttgtacctaccttcgggtttatatatatatatacacacacacatatatatatatatacatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatacatatatatctatatatatatacatatatatgtatatatatatacatatatatgtatatatatatacatatacatatatatgtatatatatatatatgtatatatatatacatatatatatatatatatatacatatatatatatatacatatatatatgtatatgtatatgtatattggagggtgagacacttatttgaagcataagtgtggtatacactaattaccaatatatgttaccaatatatgttacgtaacacttatataatcaaattcagaaatcaaattcagaagcataatatgttacatatatttatataccaatatagtgtttttttaagtgtatgttacacttaaagaaaaaaactttcgtacctctgagatatatggaacattattttgatatgggataaaagtaattccttgctcatgtattactgtggtttgtactgattgttgaaggaaccttaggccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttatgaaatatttgtcatgaataatattctttgtacacccggtgtctactagtgctaatattttataagatacttttggtgtcaattttattttaacagggattcttatacctaatatttctttgaaaggcaatcttactatatatttatttccaaaattagttatggcctctcttagttgaattattttagcagtattactgtcttttaatgttat

SEQ ID NO: 57541 - DNA, 10040 bp, Oryza sativa
ctttcgtacctctgagatatatggaacattattttgatatgggataaaagtaattccttgctcatgtattactgtggtttgtactgattgttgaaggaaccttatgccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttatgaaatatttgtcatgaataatattctttgtacacccggtgtctactagtgctaatattttataagatacttttggtgtcaattttattttaacagggattcttatacctaatatttctttgaaaggcaatcttactatatatttatttccaaaattagttatggcctctcttagttgaattattttagcagtattactgtcttttaatgttatcaattgctctttaaattcggtgttttgtatgtccttattctctggtagtgccttaatatcgcaattattttttaggttctctaattctacttctagtttatttagtctattttctaacactcgtactctactagatagtcttttcatctgattctaattctatttcttttctccatttttgtttatttgcttttatacattcagcacaagcttgttttagacatatactacaagtcactctattttcttgacttgggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacatactaatatgttttcgtttacgctatctataattagaaccctctcttgttcttcatatttactagaatatctcttttgatctttatttgggcatgttctacttaaatgatctggcgagttgcatataaaacatctgcatattttgtcataggttttctttggattatatcttcttacatttcttttatgtaagaagggtgctctattatctgatcttcttaagaaataccttttctttgttctaatattattgttgtttctattttgatgtttataaatccttttacttctaggcttgtcttctccatatgacaagggtatttgaactattttattgcagaaattgtaatccgagtgtttcatagatctttgggcttggatacccgtgcatatttttcttagttgcttaaacacaaaagttatggcttgagagatgttgatttcagctccttcagtttcctttttatattcttcaaatatcatacttcctagtgggtcaggtaatttattgaaataacgttcaactatacccctgttatatccttgtttagcagttgtagcattatataaataatgttgggagaattcttttatgcctttccaacttgttaacgttaatttttctcatgtctgacactatacactattgtatagtgttttttacacactatacactgtccataaatattaaactatacactatacataagtgtgtatattatataaatattagcactagtagacaccgggtgtacaaagaatattattcatgacaaatatttcataagatgtcctgaaatagttcacacaattgacgacaataaggcagaagtttccacagacatgtccggaataaagaaaattcataatcagttagcttataatatggaggtttacattaatgcaactaaatatataatagatgagattacaataagagatttgtcaatgattaatgatgacatgataattggcctaaggttccttcaacaatcagtacaaaccacagtaatacatgagcaaggaattacttttatcccaaatcaaaataatgttccatatatctcagaggtacgaaagcgtggtggagtctcccccaaactccccaaactcgacaacttagaagtacccaatcttgagcctgaagaaataattaatgaatatgagcttagtgagaatatagacaactattatatatcaaattccaacatagagtgcataggattacaagcatttgcaccaaatcggtatagagatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacatagaagaatttaagatgcatatagaagaactgttgaaactaggagccataagagaaagcagaagtccatataggtctgcagcgttcatagtaagaaatcatgcagaagaagttagaggtaaatctaggatggtcataaattataaaagactaaatgataatactatagaagatgcctataatatcccaaataagcaagaatggattaatagaatacaaggtagtaaatatttctcaaaatttgacttgaaaggtggattctggcaagtaaagatggcagaagaatctatagaatggactgcatttacatgtcctcaaggacattatgaatggcttgttatgccattaggattaaaaaatgcaccagcaatttttcaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttagaatttcctgatgctatgaatgataaaaagaaattacagcaattcttaggacttgtaaattatgctagaaatcacatcaataatttagcaaagttagcaggaccgttatatgctaaattaagaaaaaatggtcagagatattttaattctgaagacatcaaattagtaagattaataaaagagaaggtgaaagaattaaaacctctagaattaccattagaagagagttactttattattgaaactgatgcatcgcagcttggttgggttgctgtattaaaacaaaggcctactaaatattcatctaagtcagaagaaaaagtttgtaggtatgcttctggaagctataaattaaaaaccgtaggcaatacagatagagaaatacttgcaataatcaatgcgataaatgcctttaggttatatctagggttcaaagaatttacggttagaacagattgcgaagctatatgtagatattataatcagcttaatagcaagaagagttccactaggaggtggattttatttgaagatatcattactggcaacggatataaagttatatttgaacatattaagggaaaagataatcatttacctgatctactctcgcgattgcctattttgcaggaatgaagaagtccatgaattataatggagttgagttcttcacgtttggagaagacaataagctcaaagtattcccacagaatacctataagtttaagccaaaaacccacataatattagatgaagtccaagaatgcattttagataatttctggtatcaatacaataataagagggaagaaaaaggctatatgctatcaatattaaacagtcttgctgaatatttccatctaatgaatgatataatgccaacatcagaaaataatgaagtaatacagcaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcctaaaaacctacgtataaggaatgcttgactaagggagtagatcctttggatggcgaatatatcgattggaaaataattgaaaaatttgaagaagcatccccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgtgggaagactatatttgcgaatgaccaaagtatgaattgaatttgaatcaatccaaaatgcaaggacagtgaatgacatttgactgttaaaaatactgtggagaatattactttcggcggaaaagaaaggcgcaggtacagaggtgtctccaccttggccaattcaaggacaaagtaagccaaaaagaagataagcatctccatggtgcgagccagctcgtgaaaatacagtatctagaagataagcttgaagcacagtcgagcctcccgagctcctataaaaggaggggtttgctcagctgagaagaacaacgaagacaccattcagagcaaagcttccaagcgtgctctcaccctccattccaccgttcttagtagtagtgactttagcctaccttgcatagtatattgaagcaaggaggtgtgttataacgctgtgtaaggtaagaacagcttgcttgtacctaccttcgggtttcccgaaagtgaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatacgtagagaagtgttcccttcgggtggaactgcctagggagacgataaactcttagctagaacaagtgtggcttggaatatctttttaagttgcttctaaaaagacagataggtgaggcatacggtgagtaccgagtaggactttacatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaaactgaatagtattcagccgaataaatagtgtttttgaacagtgtatactatctgaagcataagtgtggacagtgtatattgtctgaagctatacactaattacctcgtctaaatacagcaatgctatttaaataattacgcttaaaaataattagtgtatattgtatatacactaattatttatatagtgttagtgttagtgtatagtgtggacagtgtatgctaattagtgtattctatttatattgcttgtataattacactaattaccaatacagtttcaccactacagtgtccacagtgtatatgtatatagtatatatatatacatacatatatacatacatatatatatacatatatatatacatatatatatacatatatatatacatacatatatatatacatatatatatacatacatatatatacatacatatatatatatatacatatatatacatacatatatatatatatacatatatatacatacatatatatacatatatatatatatatatacatatatatatatatatatatacatatatatatatatacatatatatatatatatatatacctaagtaattgaaaaagtttcatactcatttgaattgggtatatactcaatttcaacaatggtgcccgggcaccatggagcaccaaacaaatttactatatatatatatatatatatatatatatatacatacatatatatatatatacatatatacatatacatacatatatatacatatagatacatatacacatatacatacatatatatacatatacatacatacatatatatatacatatatatatatatatatagaaaccgttgcaatctgactcccatggcagtattggtagtagtatttgctgatgcgatgtccacgtggaatcccagacttcaaagaaaataaaaaagtgtaggacccatcagtcctactcccctcactctccctccttccttccctatcccactctctctccctcgttttcttagtggcaggcgagagcaggaggacaatggcaactaaaggcgtaggccttccacttcaagcggtgccccgacgaggagctgtaggcctgagcacctccttgttcatggcacgattctaacattagagacgatgatggagtggtggaaggcatcagggggagatggggagcgtgctccatgccatcgctccttgtccctgcttggcggcatcagtccagttggtgtcgattagatctatatgggtatgtgtagcacagcgttggaatagctcgtgagcacgtatgtggagattggttgcgtgtgtgtctaaccccttgggtttccccagcgccgggtcaccgggtgaatatggtacggtatccctcataatccatgtacctaccatctatttagatatgataggattgattatcttatccttaatccctttcttaaattacaagtaagccgcatggacctagggcactcggcccactgttggtatttcttaaccttacaaataaaatccgcaagcgcatggaaaatactgatgtagcacttcacccgagagtattctcagttatcgatttacacagggaacatgtgtgtgaactctaaatcgggttcatccaaggacacgaagctacagataggcaatggatagagaggattcactggtgagaaacagtgtctatagaaagctcaactttaatctaacgcgatacttcgggcactggccagctcgctgttcccagatatcgctctactgcgcacccgaacatgaaggacttcagtgataatgagggctatcaccacctctacacccacctcacacctactgtgggatgcggagcaaacaccgaaaattaaccacctagacacagcgtctaagcagactaagtacttactttaatgtttctcttagtaaatcattatattttagtttattatagtgaacgatgatcccgtatggtaattaggaactaaccaagaaataaatctcactaagcaaaactaaattactcgaaagatatttctattataatcagagtaattaatagagcaaaagaaataataaggggattatcgacaactccggaactcctccgacttcttctactctactgtctccctattctagtatacaataaagtacgatagagcctcttataattcagctcaagcttggagcgtatgttcaagttagtgaagtgagatctttatatagtggcaggtatgacggttgcacgatgcgaattgtcagttttgccctccaaccgccatcaggagctcatccggaccgtccacgccaaaacgtggatcgaacggttgtggaagtggttcggccgaacccatgtctggcccaacaggccccaactttggcctattgctccttctctgtctcctctatccatttctgcgaatgaaggcccttggagtctttttgagtgtagttcctagcccactctttgtatgaataggatttcacattcacttaagtctatttttggtccaactttgacagtttattacctgcatacaaatatacaccaacactcatggaatatgtcagaattaaccctatcactatgttggatgttttatttctttgattgatgcaggtattggtggcataaaatttgtcaataacagtcgccaacacccaccccttactatccggcataaaggcccaacatgagataattgcgtaccatgtaccctacacaaggacaacaacctaatataaactagctagatatatgattcctatgtcttctaattaattacttaagttaaagataaagctctatcgaatacttcgggcactggccctaagtttgctaggatgagtctagccttgagctctatgatgtacccgaacatggagggatacgaaggacggacagagctatcaccacatgccacctacctcactttccgtggagcacccaacaaacgagggtaatttatgacctagatatcacgcctaagttattaattactactctagccttgcacgagaacttccttctttatccagagtcctagtactagagcactcggttgcacactaagtgactaacccgcaccgatgagaatatatctcacttaaataaataattaaagaacataaagaaactcgaatgcttacataaataaagaaagcatccgctgaggtacaaacgagagaagaaggccgacaatctcggctttctctgaaactccgttggaagaatgccaacaccccggcactcctctgtaaaaattctcggaggaacctcgatatttcggggcactccttccagagcttcccctcactctctactaagccaacatactaaaaatgatactacaagtgagttgtactctacttgagctcaagagttgtgtgttgtgaagtgtgaaggcatcctccttttatagcttggaatgacggttgtatggcaattgtggaggtcggtgcgcccttaaccgtcattggggagctatcagggacgtccacgtggaaggccaagatcagagatgccagtggtggttcggccaaacccctagtttggccaacccctaggccccacttcctggcctaacctttggccaagagcctgattggtggggcccttatgacggttaggatggttcggtcccattttaagccagtttccactgacttgtgggccctccaatcctgtactcacacatgattggtcggatgttcattttcatcgcatgtcaagtatattttctccttaattaacctgtatacatatatttaccaaaactggtggaagtggttagtagtaaactcctaccaataagttttgataagaaaattgaatatcttttatgcagaagttgacgattaaagtttgcacttaactaccgtcaacactcatggagaaggatagtcacaagttttggtggttgggagcagaagttccaaagcgaatgtaacttccgtttcaagtgtttaatttctatgaacgcctattcaccacctcctcccctaggttcagaccaagtcctttcagaaagggttttctccatcgatgccctctatcgactttaccgggttcctctagtaatctcctccccgatagctcttttcatttcgctaccatcccgtggccttgtgctcttcattgcttcctcatttattgcctatcatcctaactactagaaacttctccactacctcccctccaaattctagcaatcgacttaaaatgtgttcactacacttatttgccttgtgtccgccgccaacccacccctccaaacacacacatgcacacacaatctctaataccacccccgcctcccccacccacaccccacatcaacacgcacacatacacacatggccacaccaaccattttctccatggtccatagtgccatttttcttgattccttggatgattggtcactgctagtcaatgcctggaagaaaggacaaacgaggaagcaatttacatatgaggaagcaatttacatatgttgcaatcctggtggctgatattaatattatttcagatatcaaaattttggaaactgg

SEQ ID NO: 57542 - DNA, 1463 bp, Oryza sativa
tcccgtccaacaaaaagtacctcgaggtaccggtaccaaatcgtttaagatcgttggatttgtaagttagatccaacgaacgaaaacaatttggtatcgtgagataccgatacctcgaagtactttttgttgaaccagagcaaatctcttatttggtatacgaggaaataaatgaagggtgaaacttcgccatgcttcttaacatgtgaatatttttattatctaactatatattacctatccacagcacatcgcactactcgtgctctttctcccatcaccacattctgatgagtttttccatgttggtaccacatggtggccttgcgctcttcactcatcctatcttcctatatagttggtacccactaaagagcatttactcctataaagcaaaacatgcaagaagccacatcgtcaataattttaagccatcagatcatatatatactttctatatagttggtacccactaacaattattagaagctaaagctcaacatgcaagcatgccacattatcacccactagcaattactattctagcccatttaaaatcccatgcaagtgtgacatcccggcccagggcttaataggattgatagaatactcatatcaacaagttgcaacttcttttccggaagccgatctcgaaagaactatgaggttaagcgtgcttggcctggaccgaccgggaaattcttcccgggtgcgcacgagtgaggacaaagtgtgcagaaaaggctagtgttggtctgtgagggtagtctatgtcctaggatagctgccagatgtaagagcgaccgggaaattcttcccgggtacacacgagtgaggacaaagtgtgcagaaaagactagtgttgatctgtgagggtagtctatgccctaggatagctgccagatgtaagagggctcggcctcgaagagtgtggggcgttacagatggtatcagagccgacccttgcagctatacgtatatatgaacatgtacgcggcatacggtgcatacgggatgatccacgaagtggtcgtatggcatgacgtatgtgcgccgaaaattgtctgtatatacgtggtgctaataggggacgttcctggcctggattgaccgacgattacgttggtatcttaagggggtgagaatgtgacatcccggcccagggcttaataggattaatagaatactcatatcaacaagttataatttcctttccgaaagccaatctcgaaagaactctgagaggttaagcgtgcttgtcttggagcaattcccggatgggtgaccgaccgggaaattcttctcgggtgtgcacgagtgagaacaaagtgtgcagaaaagactagtgttggccagatgtaagagggctcggcctcggagagtgtggggcgtcacagcaagcatgccacatcttcactgtgtggggcatcacagcaagcatgccacatcttcactcactagca

SEQ ID NO: 57543 - DNA, 2366 bp, Oryza sativa
cgttctgctcgccattaattgcgcggcgcctcatttctcttgcctcaccgcccgttctcggctctcaagtaaaggttgcagtactcgcgtgcatgcttgcctgctcccttcctctccgcagcacgctctcgcctcccttcgtctcctccagcacgctcatcgccagcatttagggttcacgcacctgcctcgccacccggcacgcttgcgctatggagtcagtagaggcgcagcactccgtcgacgcgttggactcggaggccatggagtccatcgagtcgcaggaatccatcttcggcgtgctgctggactcagtcgtggccatggagtccgtcaaggcataggactccatctctggcgtggtgctggactcgatcgtggccatggagtccgtcgaggcgctcgactccatcgtcaacacgctggactcggatgtggttccggactctatcgacatggtgccgaactacgtcgacatggtaccggactccatcgaggtgttgccagacaccgtcgacatggtgctggactccgtcgaggttgtgcagtgtgtgctctctgcggcacgttccacgctagtggcgtcttcggagaagcctgctaccaagctcgccgcgaagctcgcaggtatgcatgttgcagtcttgtacgtagcgattacgatctcacatcatggttgctttatgacatagaaaagtttgattgtgagctctacatccctgatatggagatgcttgaaatgaatggtgacacaataattctacccgatcacgttcaaatgaagttggacgagatctacaatatgaagaagttggaagatgcaaagctgaagcaagatgcaaagaaagaacatgtcttcttctaatttgctactaatatgcttgcatcttgcttcgactagcatgctgcaaagagaagaggcttggcatcttctaacattctatgactaatgggctgcaggaaggctagcaattgcttcggctagcaaggaagcttcacaagagatttgcaatggcagccgatcttctttctctagttttgcttttcgcatgtgaggaatcttgaacttgttgcatcctttcaccttcatagcttccatcaaaatactttgtagtgttagaaacattcagtttgctttgtgtgccgcatactctatgaatgcctacaaaacaagtgtgcaagaaatgaatcaatgagcaaatttgttgttgaagaaacaatgaaacatgtgtgaacaatttttttttactaaaagtactgccagtgctttgcccagtagtttaaattttataaaataaaaatatgtacaaagttacaaagggaaagaaaaacaaatatgctacaaagtttgtatccaatcagaaatggactgcttgagtggatctttcattctacacttatgcagaagaacttctatgacaaacatagatttccatgactgaagtgatggctggacagattgaaacattaacccattcctttgcttccaaatatgccatgctaccatgaaaaaaacttcaaggaaaccctttcgagcaaatctgattctcgccaagacaagcatttggaaaaactccatattacaattccaggaaatgcccatctgctgccaacaagccacactaaagggacatgtaaaaaagagatgaagcctagtctctctttgatgtgtgttgcacaaggcacatgtgagatcatcatcctcttttgcacaatgtcttctgtcaagcatgtcccttgtgttgagtctatcacaaaataatagccatgcaaagacctttatcttcatgacacatttggtcttccacagccaaatcatgggcctgggaggatgtagtgtggagaaattaagattataaaatcttttcgctgtataagcatttgatccccaaatgaagctccaagcatcacctcttcctggctgaagctgtgatcaaattacctcttgcactgctggaactagagcttctattgtttttcattcttcttgtattgaattgcttgaatagctcgaaaaaaaccaagtaaagaatgttgaaatccggagaattgggtggtttacaaattaggcgaatattgaatccttcttacttagcagcctcacaaaaaaccggatcatccaattttaaatgggaaggtgcattatcctgttgaatgaagattggtttgcccacatcttctcttggccatttggctcaaatggcaggtaacactttgttgatcatgaaatctctaatcacatctcttgtgatcgaagttatgggcttcataaccaggtctccacgaacaaggtcggttctctcattacctcttctagccggttcataagtaacaagtggaaaacaaccaatcctaccatcaaaaat

SEQ ID NO: 57544 - DNA, 8834 bp, Oryza sativa
aatatttctcagatttttgatagaggtagaaccatttttcatcaatgaacacaaagtcaaacaaatccttaaactttggatcatcaaccaaatcttgctcaatcatatcaacacaccacttcaacctagccttcttgttaaaatctgtgaggtatggtttgatgctactagagtggcgtctaagcaatcctttttttgaaatacctttgtatcctagctttgcttataccaactttactagacacatcttctatggtcattctttgcctgagaggaatgttgtgcaattgttccaaatcaagagggactgccttacaaccacttctacccttctttcgactagcaaccacaaccggaatgttatgagcaagttggattttacctcgcttccataagcgctggactgtccgaatgtgcactccaaagtccaaattgatcagcaacaattcttgtatcattcttgtgtagtatcccattcttgcttttagccaacaatgcttgataaacttgtttcctgacgtcttctgtcatgtattttctttgatggtttgcttcaatgggatcaacatgttctagtaaaacaaaaaaaagaatcatttgttagccacggcttacaatacaaatagtatatacagcatgcacacggcgcatgttaaaaaaaagcatgcacggtagatgttgtatgaaaatagtagaaacggcatgcaggtttaccaggtaggttttgtacgaagtgaaaatcaaccgctccatattgatctaatggaaagttcaaatcgattccagtccaaaaagtaaacaacaaactaagaaaggatggaatttgaaggaaataacaaactcaaacaaggaatcacattaccattctcgtcatcttctaaggcaatgttcagatcaaagccattgtcattatcttctaagcgaacgtttagatcaaagccgttgtcagcaattacatgcgatacatggaaagagaagagagggaaagtgaagagatggagcacggtaatggaaagagaagaggccgggggaaacacccccatttaaataggcacggtgaaacgttgcgcgctaaaaatacggcgccattgcaaaaatcacgtgccaatcaaaaacgaatgaaaaatggcgcgccaaaacatgtccaagcgcgcgctacgcccagccgatgcgaaaacgcgagcacaggcgcgccatgtagggcccaaacattcccatgtaaaatgaagcaaccagcaaaataaaagtggccaccgggaattgaacccaggtactcgcaacacatggctcgctccaagagccaactgagctttagttctttctcgtatgaaatgcacccacaatcctatttaataggggtagacagggaaaatacctcctagttaatcactccttggtaagcacaatcctatcctaaacgacatattttacgagtatggagggagtacaaagataaaaattgttggatcaagaaactacttattcatccaattcaatcatttattagttatccattcacctcctttgctccacctcatagtcacacatagcactgttacatattttgtgcataacaccatgttttccaaatacaactcaatttttgtttaatatgtgtgttttgtttttattatacatgataagatagcatataattattagatatcgttacctgaatctattttcagaaaaaacttcagtgaagtagagagatgcaaactgtctaactacaacgatacccatattgtacatgaaaataatattcatatattatagcaatacacactgacacttggaaaaataaagcatgaattgtattgtaataacataaggcatatataaatccacattattatatattttatatagagagagagttgcacctaaccatttaaaactataattttgtttgacgataaaactagaaaacacgtgacaaagacgcagggtgccaactagtttactgtttcttggttcaaaattttgccaaatagcttaagtggtcactacaactcccttcccaaaaaaagaggaaaaaggaaaaagtaaacatgcgcgcacacatggtcacaccaaccatgttgtcacacagccagtagatccaccatcctaacctgtttcctgcctggattgagatcctctgactttagggggttaaagtcagaggtgaacagtatcgtgactttgagctgcttttagccatccgatttgtagggaacggatgagatcgattgctatagtgatttgtgaatagtgactatgctcggtacatctcactgttttgcactgtagcaacatactcatttcactgtgcgtctctgcctttttcccctaaaggcggaggatccggatccttctcacccaccacatactaccctctcaagtgcagttaacattaatcatattatttgagttttattattaatttgaaataccatacaacaatactaaccatatttaagtttaattaattagttatgtgtggagaaggtactacgcacccatttgcttgtttgtaataatatcattcttcagtataatgttcaacattcagaactaattgattgggtgcattatatgaatcttacaagcttttaacacttccccaagtcctcttagcactctcgttcatttcaattcttagctttttgaggcttactttgtgacttgcatgtcccatcgtaaataagtactcacggaggtctataccgatatttgctgacaactatctagaaaaggatccagttcctccacatgcagagggccactgttgttgtgaggagaactgtaaataaatatagtgaatagtaccacttcaccattactacaaaattcttcttttgcatagtggtcatcgggatcgaagaagatgccatctttatggtagcagttgcggtggatgaagtggcacatatccaattgtatgttttcaatgcttttaccatctatgtggcggtcattttcaattctaggcctccgcatcagcagcatgagaagaaaatacttgttaatattattagtcttaccatcaattgaagaaaatccttcctcaaatctcacatatttttgggtcattggatgcgctttgtgattcatgcttcatgtgcttctcctccaacttcggcgacctcctctttttcttcggcgccgacaacaacccaaactctagcagacaacctacaacttagggtctcgggttgggcgagggtttaaggggtgggaaagggagggataagaagcgggtggttgatagacttagagggatggccatggaatacgacgacttgaagttagacggtggaacggctagtgttggtgacgggggcaatgtggagcaacccattaggagacgacggccaatggtggcggatccggttgtggggagctgtcagagacaaggaagacaacagcgtgggggctcctcactgccgttcgatagagggggagtagagggaagaggcctgactagggagaagggactcgccagcatcgttaatgcctcccagcgacgctgggcgatggtgagaagccagcaccatttcggacgtgcgggcgttaaggggaaaaggaaaacgaatctcgaagccatccaacggctcaaaaattgtaagattttgagggaatgattcatgtgaaatgtgtaatagacagtcccttctttattttggtttattatagttagtgcatctttgatttttttccccttcctttttttagctaaagcatcgtcggtatgtataccttagaaactaggtgattccccacgctttgttgtgggattactaagcaattctcagtatattttttcaatatgttgataagtatatgttaaatactataaaaatgatagttctatttgttaaaacattgttcaaatgacatgaggggtgatgattggatatacttgcatattgatttgtagaattaaatatattgtagatgatgattttgttaacagtgaaatttggttttttcgcgtcaacggatgtatgcttgcataaggctaaatatataatattgctagtgggtgatgatgtggcatggttgcatgttgagctttatacttagtgggttataattttatagaaagtaggaataagttcatctgaggtccctgaacttgtcagcggatccaattttcgtccttcaaccggaaaaccagatacaacgggtccttcaactatcaaaaacagtgcaacataaatcccaaagtggtttagaaggcagtttggcagttttgactgacgtggcgcatatatggctcctttgactaggtcttcgtcctacgtggcaattcatctcgaaaaaataataaaacccatgggacccacatgtcagctaccacacaatataataaaaaatagtagggcccatgtggccccatagatcatccttactactcccatcctatctatcttctctatcctctctctcccagcaagaaggtgggcagagcgacaggacggagcagccggccggggcgcgaagcgagccagtgaagcgaagcagggagaagggcggcaaccgctccactcctctctctcccttcccctttcagcatgtgggcggcagagggcgcagagcggcagcggccagagtaggccagtggagtggagcggggcgagcggcggccgacagcaggtagggtgaagcatcggcaggcgatagagagatgggcgcggcgaggccaatgggcgaaggaaggatgacgagttgtgggccttccccttctcctttccctccctagccacggctgccagcggtgaatccttgtgcgcatggaggaggaagaagaagggatcaggtcttcaccgctgcgccgcctggtcacggggtccactgcacgccgcatgaccaccatcgtcacgggagtcgtcttctcactatcctcctcatcgtcgtccccttcggcgccgtcctcccactcggcatcgcgggcccaatctggcgaggtggtggtgagaggactgggcgaaggggtggaagaaaatgtggttgtcgaggaaggcgtggaaagagtcatcgggaagcgtgcaatgggcatagaaggcgaggaggtggtaggcaatgaagccgatgagcgcgtgggagagggcagtgatgggccacgaaggctatagggaggagcaggccgaggatgtggtcggttatgacggcgggcgatggcaatccaccaactccacttcatccccgccaacatccaaatccgccatcccgagctcctggcgttgggatcctctttggcatcctctgcggtccgttcagtgccgcctccatgtacctcgtgtggtccatcatcgccggggctggcgccgcaaggtagaggaggtgaggggacatgtgggtcccactattttatcttcttgactacttcctccttttcacaatgtaagtcattctagcatttcccacattcatattgatattaatgaatctagatatatataacatcaatatgaatatgggaaatgctagaatatcttacattgtgaaacggatgaagtacctgtatattttgttttaatttttaattttaccacttttatttttggatcaaattgccacgctagcgctatgtcaatatcacgtaggacaaagacctagtaaaaggagccacgtaggcgccacgtcatccaaaaccagggaacaatactgccgagggaccttatttacacggttttgtaagttgggagatacgttatatccgtttttgcgttcagggatgaatttcggactcggcgacacattgagggacctaaaatgaacttattcctagaaaatatagatttgcccatgaagttgggctccaaccggcccatcaacccatctcgctgggccagatgggccggacttgtcagggctagtcctaccagcccggaccagcgaggcttcgtccacgtcgccattcacctctccgcacgcacccacccacccaccaaccgagcaaggaggaatggcgatggcggcggcgaggagggccctcctgagccacctgcgcgtgccggtgctggctcgtcccgccgcggcggcgggaagcgtccccgccgcgcggctcctgtcgtcggcgacggaggaggggtccaagggctcgttcctcgacaagggcgaggtcgccgaccgcatcgtctccgtcgtcaagaacttccagaaggtcgagccctccaaggtgagcacggtcgccgacgcgcaccgcacggcggattcggatctaggcgtgctcgggctgtgtagtgtattttttattcgcgtcgcattccttttgcttcctggaatggagaggattttcttcttccgaaaagagattctgtatatgcgtaagaagttgcaaagttttggtcttggtggatcaattggagccgagcctgaaacattaggggataggagtaggacaagaaacaaatcttgcactttgttagaagattagattgtatactagttacgaaaatttgattgaggaacatatgtcattcgtgattgatttggtccgtcctaggctgtcaatggatgataacactcttgtgatgacctagctccattaatccttgtgtgtagacaaattttgacattttggtgcctctagtgcggtttcacttgcactactagacgccacataccaaatttgaatagtttacccagtggccccatcttgattagaagcgatgtgttgcattgagtgggaatatgttttctttgtctcgtttttggctgctaaagataacatatagtattgtgttgtattttaattttctgcttttgttagcaaaatctggaagtagtgaacctcttgttggatgcactttcatctgatcgctgaagttggcaaatggttaatttactagaaaaagtcatcggtattagacttatctgtttgcacaatttgaaagtggggcaatatattatcaataaattttgtttacctctccacttgcatcaagatgttatgtttgatgaaacagttgttgtgactctgttccagatcaaaataattaatttaatttggataacaattataatcctttttttattaatagtctccataatatgcttaatgtatgtttgttagtcatcagtggcggatccaccatggggtctctggggtctcgagaccctactacccgtattgtaaccaagggagaccccatgaagaccccactaaaattttctgtgatacatctattaaaagaggggactataattttatatagtttgttcagaccctcctgttaatctttcctggatccgcccctgttagtcatgttagcatcatttgtttgatttgtcctgctactgtgttgctcttatttcaacctgttttgagtgtgttctgctactgcttgttttgatatttcttccatttgattaaattacatttccaaattctgtggactatttctaagggatataggtccttccatgcctaagatatgttagtctcaatgagcagctaaaaattgcgatgaagaggttacttgcatatgccttaatagccttaatagaaaccctgctgtggttcgtggatgttacttgtaccaggctccctgatacactggtacaacaaagaagtttgttcttaccttcaagaatttttagacagcaattcatgcagttgtatacttgcatacctgcattttctgttcaatatggcaaggcacgtgcagtttttaaaacactgagaattatctagcagccaaacaaatgggggaagtttttatcgttgttgggttatagtggtactattgtagtctgtctatattttctgttattcgctagacactgaactttcaatggcatggaatgatatttctctgttagtttagggaatgttggttcatatttgtagatgttgccactgtcgataataatcatttgtttatccaataaatgttgcaggtgacaccaaatgctcatttccagaaggacctcggacttgatagcttggatacagttgagattgtcatggcctttgaggaagaatttggcttcgagatcccagataacgaggcagagaagattgactccatcaaaacggcagttgacttcgttgcctctcatcctcaagcaaaataaggatcttgagaattctcagttactgattccattagatctttttttttttgttgcacgaaccaatctgtgtcaacagaggaccagttttcttgtgtttatctgcataacctttattctgaggttatgcttcttacacaacttgaataggaaatcagtttttttattaatattattggatgcgtgaataagttcgcaccattcggctgtttgtggttttatgatgcgatttgcatctaaactgatgctgcactgctggttgtagccattattgttgtgcaaacaaaggtgaatcgatagacccccccccccccctcccaaggggccttttcttttctggtcctttccagcctctcaacactgtataggaagcagagttggcgatatcatatcacttgccttcacatgaatcttgctaggcatttttttttttttggaattcatcctggtttttttactgacgcaccaaatcggtcatttcgcacgatgatgaactttcggatcacatgctagcaaagtgacagtttattggcttggctaatctattctgcacacattcgattcactggaaccgaacagatgatgtcgatggattgtcattttggtccatctctgctgctctcatggtctggacgagggttgtacattctgcaagatgcagagaactgagacacgggtggccgcagcgagtgacccgtgcatgcaacccaacttagatgctgtttcggagagtttctaccggctgtaacttttttcaaaatctttaactt

SEQ ID NO: 57545 - DNA, 21034 bp, Oryza sativa
gcctccccctgtactcctccctcttctctcccttcctcctccccttcttctctttttactacagtacacacaatttttttaaaaaaacaaaagttagaaaaatttatgtatagaaatactatatataaaaaatatttgaattcaaattcaaatttgaatcgggtatgtaaacttttgacttataaactttgggtctataaactttaggtgtataaattttagatgtatagaaatactatatatagaaaatatttgaattcaaattcaaatttgaatcggatataattcagattcaaatttgaatcgggtatgtaaacttttgatttataaactttggatctataaactttagatgtatagaaatactatatatagaaaatatttgaattcaaattcaaatttaaaacagtatataaacttttgacttataaactttagatctataaactttagttctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaataggaaagtaatgcggtgtcaaaaaatgaaaccaggtggaggagtggagggagggaggggggaggggatcgatcgctgatccatccccagggcgatcgatcgctgatccatccccagggcgatcgatcgccaaacaggatttccgcatgtacaaaggtagagtcagatatgagctctacattatttagagactagcatcctacaacagttatagacaatatagtctctaatcattaatgtattaaaatattttttcttactcttctttcatttctttcaccaccatgcaacaaaatttgctctaataaatactaagagtcgactctaagacattgttatgcataacaaccatactcctttctctttcttccatgtcatcaaatttacctgcatggcaatagagagatcactaataaagaccgttgtacatgccctaagaaatctctttaaaaactcgcatactaacttaaaacaatcagacacctaactgtaactcatgattttctaacaaaatatacatatccaaccgaatttaagagtgaatctcatattaactaaataatataatataaataagattaaaatagtctttatccgttacaatgcacgaacattttctaatagctatataatttaaaaaataaattagaaatcagaagctgaaaaccaaacttttttccgattctttggaagctggctatcgacagggccaggttttgagagactggaaccaggataggcagcagcacacaggaattgaaacgcgaacgcgtgcagatttgcagagacgacgagggcgaggcgaggtagtctgcactgcacgcgtcacaggtggccggtgcagggagggagggagggagggacgcccctgcgccggccgggcggccggcaggtgtgacgaggagtggaggaccctgtcgcccgcaggtcgcagcaggaagattgatgagattccttctcacagatacagataatgtgagacatatgctcaaggtcacgggagaagatcgtctatcgcaaggggttctaaacgcaatctaagggcccttgaatcaaaggaaggaattatgaaagaatttagtaggattaaatcctatacaaaattttttatgtagccctttaattcaaaggattgaagtttttcacatcctacaaaatttctatgaaatgtcttattgcatataggttttggaggaaactgggcccctttgaaacacaggataggaaaaacataggaatagaaaaaatataggaattaaagtggcatgttttcctaatcctgcaggaatggaaaacataggaaatatgaagagagtccctttgataccaccacaggaaacaagcaaagcataggaaagtttccaagaggttggacctcttgcttattttcctatgaaattgacctataggaatgtaatcctatagaaaattttctatattttcttatgaatcaaagggttttataggaaaaatttttttaggaaattgaatcctctaaaattcctatggcaatcctccaattcaaagggggtagcaagaggtctaacttcttggtaaaaatcctttgagtatatctctatcatccgattcctgtgttttttctgtggtctaatcaaactatcattcctacgtttttctatgttttgcaatcctctgttttacacttacattcctgtcagaatcctatgtttttcctattcctccattttttcattcctacaattcaaaggacccttaaggaattgagatttgcgaaaccagatgtagtgtacgtggcgtttcactcgatcgtaaaacactactccctccatcataaattatagcaacttttaactctcaggatttgtcccaaaatataacaacttcttcactaacattctcttcccaaccaattgttgagaatataggcatataatgatttaatatatttcataaataaatcatgacattatataagtatactagcattaacacatcattagatctacacatgtaaattaagtagtaaaacatgaacagatcaaatatgcgcaacttgtcgaacacgtaccgaggtggcggaaagaccggttgctcggcaagaactactcgcggttgcgagcgtcgacgaaggcgcgaagcacgcgagcggagaggaaggcgagccgtcgcggacgaatagggagcagtcgcgcgaagcgcttcccaaaaaccttattgccgccttctcccggtgcaggacgtcgaaggcagaggttccggagacctgctctcccgatcgccggtgcacgccggcgagcgggatggaataatctacgagcgacgacgcagtacagagtaggaggcaaaccctaaattgattttgcgtgtgttgcgtgaaggcggcggctcggtttatatagagataggtcgcttgatcagggcgccgcacgatctccactccgcataaccgaaccggataagtgaattttcctgcagcaaaacaaaaatgcaaaaggaggttgcatctgcgcaagggtgaggagccaattttgcggaccattcgacacgtacgtcgtgcaagggtgaggagccaattttgcggaccattcgacacgtacgtcgtgcacacgcgccgcatgcctgaggcgagcttgtgttccccctcttctctccaccacaacatgcttcgagtggctaggaggtcattctcccttttaaggaggtccccctctcctagaataagcaaggtggtactaaactccacatgcatgccatcccatgaggtgggcttttgtgattttctaaagaattaatcttcgaatgggccttagcccatctattaattccaacaccaatcacaacgctccaccatttactttccccatctacctccactactcatttaatcacaaccctccaccactcacttttacctactacttcttaataaccgtgtccaaccgtaaaattttttatattctaggataaccgtgtccaaccgtaaaattttttatattctaggacagatgtagtacttactttttatttgctgattcttcaacatcagcaggcagggtgttattggacatctacgtacctgtaattcttagtttcatccgagcttccgattttgtcatttagcaattctgaaagtagttttcttttcccacttttttcctgcacgcgcgaaaggattacacgttaatatattaggttttgtttccccgcttagtggaaatgccaaaggtagaacacgggccattgttttcccagataactccacagaaattctctcagaagttatagtacttggatttggacagctcaacttcaaagtacgtgaggtgaattagagatctcgtcagatagctccaaagcgattttatgcctccctgactgacctatcacgcacggtagttcacttcagcagaggagagaggcgcccacacgcacggggcttgttttctccccattctaggctagctacttgcatgcggcgagacggcatgcacggcgctggtcctcgatccaccacagtcgcctttggttctttctcctgcgcatatatacggggtgcatgtgcatgtgagcaaaacatgcgtcgatagacagcatcatttcaacatcaattcttggcctcctgtcctgtgtgtatatatatgcggctgtggtgtttgttgttttttctttaattcaaacaaaaattgcgcaagctgaattaatccaagacaattttaatctttttcggtgagattgattggatagagctcctaccaatccactttcttgtttggcgtttcatgcagtcttaaatattcagagttcttcacgacccaaaaacaaacaaaaaaaaagaacttttcatgtggccatcgaccaagtatataactgcgggaaaataaaaaaaaggaacagtttcagggagcccatcaggattcaggcattgcatggctctctcaccggtgagaactgtaacagtaacagcaccaacaactactacacaccggatcaggcttctccaccttccaaatcacctgactttgacactaacatatgagttcgatgaaccatagatccatatgtcagtgatagagtcatggtgcttttgaggtagtggatctcagtgcccacggcggcatgccacgcgccggaaactaccaaaccgaggagaaatcgtccgcttccaaccgcctgcgcatgtgtgcaaccaccgcaccgcaccatgcattattgcccttctctgcaggtgattgcttaggaaacagaccaagacacagcgttatatagcgtctctgaccatctgcgttcttgccatttcggtgctttcggctggctgcacagcacagccacaggagagctagctctcatcacgggccaaatccaagggggatatcgtatttcctgtgcatcgatcgtttgctcattcacgagctcacagactcagagtctcacagggagatcaaggagtcggagaaacctcctctgccttgcatgccagtgagtgagtgcgagagataggttcacttcagggtggttattggggtgagcacctgagctgatcagcagccatggagggcgtcggtgttggggttagaattagagcgctgctctgctgcattgcgatggcggcgatgcttctcagttcctaccagcaaggccaggttctctatcttgctgatgttgtctcttaagtctctctttgaattggaaacaattgtccggcctcgtgtattattctgatatcttctccattgaaggccgaggcctcttacatgccatggccgccagctacgccgccgccacctgctgctgccgctgccaactccacctccaccgcggcggcgaacaactcgtcgtcgtcgtcgtccaccaccgcgccgccgcagcagccgaccgccttccccatggtacgcccatcaaaacgatcacagattatgaaattaatccacattgcgctcatttcgtcctcctctccgatccgttcttgcagtacggcgtgacccccggcagcctccggccgcaaggtacacgtaatctccatcgatctctcgctgaattaaccaatcaattaagcattgttaactaggagtaattaagtagcaatcggtggaataatgctgtttggcagagtgcgggggtcggtgcgcgtacaggtgctcggcgacggcgtacaggaagccgtgcatgttcttctgccagaagtgctgcgcctcctgcctctgcgtgctgccggggacctacggcaacaagcagtcgtgcccctgctacaacgattggaagaccaagcgaggaggccccaagtgcccctagttaattcttttttttttcattttagcagcaaattaaaccaccattgttgagggagggagggagggagggaggaaggaagccgccatggctgcaagcttttcagcctttgctctgagctaaggcacggccctcatgcatccagagtttgtgaaattcagatgcgactctctgtgttcttttcctcttgttttttttttctgttctttttggggtatctctgctagagtggttgtttgtctgtattgatttcgtggatcttaaggtagaagatgagttgtcgagatgaattttgatcgtgatgtgtttcgagtttgtttgtaatttgtatgcagtattgaggagtaatttgtatgctactatgggttcttttctctcatttcccagcttctaccttttcatttttcacgtgcatatttgtcgaacaattaaatagttttattcaaaaaaaattctatacgtaagttgtttcaaaatctgttcaatctccctccgttttaggttataaaacgtttcgactttggttaaagtcaaattacttaagtttgactaggtttaaagaaaaaaaatattttcaactcaagacaaatttattatgaaaatatatccaattattgatttaatgaaactaatttggtattataaatattactatatttttctataagcttagtcaaatttaaaatagtttgactttaacgaaagttaaaatgtctcgtaacctagtaaaacggagggagtattaagtactccatccgattcatatataacgttttgatttctttccaagtctaatatttaagatttaattaaatttataaaaatatagcaatgttttaaaaatacattcactattatatttaataaaaattatttggtatacaagatgttactaattaaacttatactctcttaatccctaaatgtttaacgccgttgactttttaaatcatgtttgaccgttcgtcttattcaaaaattttaagtaattattaattctttttctatcatttgattcattgttaaatatacttatatatatatatatagttttacatatttaaaaaaatttcaaataagacgaacggtcaaacatatttaaaaaagtcaacggggtcaaatatttaggaaaggagggagtagtaaataggaaaaaaaagttaaagcggttaactaccggaactttttatattagcttcttaatttttggaaacataatttccacgaaagggaaaaatggcgctttactcgcacgcctccttcttcccgcgcgaaaatcccccctctcccgcccaaaacaaaataaaactccaaacccacctcccctccccccaaatctcgcttcccaaggaaaccgtgagagatcagacgccgcgcgccgcgctcgagctcctccaattccccacgccgcgatccattccgaccagctagggatctcgcgcttctccttctccttctccgatggggaggccgcggaagccggcgaagcccgcggccgcggcgtcctcctccgcctccgccgccgccgccttctcgatcggtacgtgaccggaaaccctagccccccacgcctcgatccatcggatccctactagtgtttgtttgcccgatcggattgcgtgatacggaaaatggggcgcgcgtgttggcaggcaactgcaaggtggagatccacgggagcagcctgaggtgccagtccacggagcaggaggaggaggagctcaccatttctgggcccaggggcgcgaagatcgtcgtgtctggtcagtgcgccgggtggcaattagtggtcctatttatttctttggtcgcagatcatcttgttcttgacatttttcttttgtgtgatctttgtgcagtcgacggggccaagagttcttcagttggtgagttctagagtgttcaaatggaggactagtggaaggggagtttagtctgtatttcttttcattgatgcggtctgatctttaagtgttatctgcaggtgacggttttgatttcatccttctcagtccgagtgatgtcaatgagcgaaacaaggcattgcttcaggtggttaaattatacagcttctgcattaatcatttccagtgcaccagcaaagcaagtgaaagtggtacattatctcgattttatatttcttttgctggtagagtgcacttgcttgcagagctagaaggtttacatggccgcatattggctgtgcacactactattagtagatgtgtaattcctttttgcacaaatcgatttaaagaaaagaatagctgtatccatggtgacaataggattttcaaatactacctctcagtcagtggctgattccatattgcaaaaccattgatcatcgtatcagaaatatttggaataggataattcattggcgttcttatactgattttcaggaggtactattgctttataagcaagaactcccaactatggattatgctgctaacactggaaggaagtcagggtttctcgaaaaatgcgtgacaaatgggtacaatcttattctcttctttatcataaagtatttccatacccacggtataatatgacatatattggcgatgctgatactactattcttgtgtttctttttatttgacacaactactgcattttgattgtaaaagtataaacagtttacattctggttgtatgtcatgtacccaggaagtacaagactctagttctgagctctactgcaggttatgaagaggtaagcattaagaaccagtagcatcatctaaccatgtacatctatttcacaatgcataaatactactccggagtctgcactgatttcttggattgcttgtttgatgttaataaatatcttagacatagcatatgatccttaagatcagtgtggcaaaaaagttattatgacaagatgagatagaagatttgaagtgttatgcttctacctaaacttgatattttatcctcagaagaaaaaacctaggatgccatagatggttgagtctaccaaccagctcatttccaattatgtgcttactatgttgatttaatgtaagatagtgttacttttaaaccttgtgcctgttttcactttggttaattgattattggctcacaagtaggcagcagcacatatttaatgattacatcaggccaggtatgaagtgcttaggtggcaataagaaaacatccataaagggcaaggagataaataagtctcttaagtgatcacagcttcaattcccctgtcatagtttccaattatctaaaagatatccccgattaaactgagtgagccattaacttggtatggcaacttctgatccaactattctcattttcctttcatctcacacgagcatcctgcttagcgcttgagaattaatttagcacttctaaaaaattctgactaagtaaactatggatagtggctaatgtctaatgaaacagagttttctctaattagccttgaagaattttctgttcgctgcaggccttgcaattaaactacatttgattaaagctaattaatctttgacacaggtaacagctgccttatcatatcagctagtgccggctgacacacagtatgctgaaatacctctggcagtcgtgagacctccttatcaacgtgtggtatgatcaatgtaaattatatttcagtatcaaaactagcatccgttgcaagtttcattcctatcctctttgcactaagttttaaatgaattgcctctgcaaaatttcttggtacttggcttcttttcctacatgagatctgtaggactaacaccccgtcacccaaacttgaaaaactaatagatttcttcctgcgagttgcttatactctgtcctatatatttgcagtcattgatcgatgaaattccttaatcctttttattttttaccctcttaagcttcataacttatgtaattctttaaatgtttatctcagggtataggtcagctcttgtacaaggagcttagccagaggcttcgaaatgttggcgtcacaaccatattctgctgggcagataatgtctcagaaggattttggcttaaacaggcaagccaaaatagatatctaaataaatccaattgttttcatttccatttgcataatgaatatgcctttattacttatggtcagcaaatgctagagactagtaatctaatgttggcactattttaaagatcgtgtctcacttaagaaactaagctactaagcaagtctatgtcctctaagcatcaaaatctggaaatatgacaatgtgagttttcttatggagtgttctgtcatcgtgatcagtagaaaagaaatgcctgattagtgattgtttatgtattctgccaatcattagctcctaaaatcttatactccatctatcctgagttaaaattataattggcaagtgccgccaccagtcacacttaatggctacctacaagcgacccaagtaatgtcaaccgtgggcaactaaatttccctttttgtagcattttagttcattatttgttagtggactattagtcttattaacagatatatcctactttatcagcacagataatcaattaagacttggaagtctatgctaactagatgcttggtctttgcttgtgagtcaattgcagggttttgaatctgttggagaggtagatactaaaggcaagatttgcagaattccagtaagggccgatatcaagagggcattatgctttccaggtggttcaatgcttatggtttcacatctgaaggatttgccagctcctcaaaagagtttactttcatctcagcaaacatatcagtttcacacgtttgcaccagatagtaagtctaagtgaattcatattgctaattttcttttgggttctggtatctcaaacccgctatttcctggaactaattgtctaggcaactataattgtgatatgacatagattacatgcaatttagcaattatatgcttatatattatacaggcttcctgtagttctgagccacttttgtgacctattacttggttgcaattttattataatcacatgaatacaattaatctaagtaaataaaaaatgtaaagaagatcgtagtagcctaatatgcctcacatggtagaccagtatccatttatgactcttcatttgtcttattaattttgactctcaccaatcaagctttaaccagcaatatttttaggatgtctaataacatagcataaagtttgtatggctagatttgtaatcaaagttagttaatttaaattttgtatatttagagatattttcttttgtgatgtttaaaaattaaccgtcaaagttatatctgtcagcgccaaaattgggctgtaaatgtgagcagtgatggaataagccttgtggtctttggtccttgtggtccttcttttgcttttaggttgtttttccccttttaggacagcatcctttcagttttgcttttagcatctttcggttttgcttttagcatccctaggacagcatctagcatctcctttatgctttattcagtttggatgctctctaggacagcatcgcgttcaaattttagactagtgtgggcagcaattagctagcagccatccagccaactatagctatatatatgtatccaacctccctcgggaaggcatggcttttgtgtttgtgaatgaagaaaaccagaaaattgcctcatctcgagtgccatcctcttctcaatgagagtaaccattgaaattctaacatctggtatcagagccacactttcctgtaggctaaacatctcctgttccaccccttcccaagctcggttgagcactcagccagtagcagcagcagcaccagctgctcctccttcccctttcccttacccctctccacacagtagccccccggaggcgcgccatgtccgacgttcggtctcggcgttcggtcgcctcgagcactcggcgtcagcaggacgccgagctcgccgcagcagaggagcgcaggcgagcaacggctcagactgctgcagcagcagcgagggcggccagactggcggcagcggagttggcagcagccagggcggaggcggaggcagaggtggcggaagatgcggcacgtgcggcggaggtagaggttgagaccttgcgcagcagcatcaacggctccatcgccagcgacatcaccgctgacagggagcttgaggagctggcaagaggaagggcgcgggagcgggcagagcggtgggcagcagtccacccccacggcggcggcggcggcccaagggaccgcgcgcccgccgacgggaacccggacgggcgcgggcgtgccggcggcagcccggagcccgcgcgcggccctcgcaggcagcgcggctctccctcccctgaccggtgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtctggtacagcgacgtcgactacgacgaggatcggcgggcactggatgccctcatcgctgcagtcccgcccgagatgcagttctcactttcccagaagcggactgccaaggaggcctgggacgccatcgctgcggcacgcatcggcagcgaccgcgcctgcaagtccacactgcaggcactccgcaaggagtgggagaacctggccttaaagccaggtgaggatgttgatgactttgccctccgtctcaacactcttttgcagaagatggtgcagtacggcgacaacacctacaacgaggagagagctgtcgagaagctcttccgctgcgtcctagagaagtacagacagattgctcgctcgatcgagtctctgctggacctctccatgatgtcgatcgaggaggcgttgggtcgcctcaaggtcgtcgacggtgatgagccacagcctctctcggggcctaccaccattggcgggaagctccatctcactcgggagcagtgggaggcctctcagggtgacagaagaaagggggagtcttctccctcgacaggcggcctcaagccacgcaaggcacgcggaggtgtccagctgcggtgggcgcgaagacgcgccgagggtggcgctcgcagaggcgcccagggcggcgccgccggcaaccacaagccggcacgagacgacacctgccgcaactgtggcaagcttggctattgggccaaagactgtcgacagccacgacgtggccaggcgcacgtcgcacaggtggaggaggaagagccggctctgctcctggcacacgcaagcatcgagcttcctccagcggcaccggccgcagtggctttcctccaccttgatgagccgaaggtactcgtctccctctgcaacggctccagcaacgacaaggctgatgggtggtaccttgacaccggcgccacccatcaccgtgaccggccgacgggagttcttcaccgagatcaagggcgttgtctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggtactaattgactctacatcctcggcgcgtaggtcgcacaaccagtttgcctcgacgctcgtcgggacgacgaggcatggcagtggcacgagcgcttcgggcacctccacttcgaggccctgaagcgcctcagtgccaaggagatggtgcgaggcatgccgtgccttgaccacgtggagcagctctgcgacgtctgcctggtaacgaagcagcggcggctcccttttccccagcagacgaacttccgagccaaggagcggctcgagctcgtgcacggggacttgtgtggcccagtgacaccggccacaccaggaggatgacgttacttcctgctgctcgtcgacgacctctcccgctacatgtgggtgatggtcctcggcagcaagggagaggctgcggatgccatcaggcgcgcgcaggccgctgcagaggcggagtgcggccgcaagctgcgcgtgctgcgcaccgacaacggcggcgaattcacggcggctgaattcgcgtcatactgcgctgatgagggcattcagcgccactacaccgcgccgtacaacccgcagcagaacggcgtcgtcgagcggctcaaccagatggttgtggggatggctcgggctctcctcaagcagagagggatgccggccatcttctggggggagacggtggtgacaaccgtctacatcctcaaccgctcgcctaaaggccctcgatggcaggacaccgtacgaggcttggcatgggcgcaagccggcggtctcccacctacgggtcttcggctgcctcgcgttcgccaaggagcttggccacatcggcaagctcgacgacaggagcaccccaggggtgttcattggctacgcggagggctcgaaggcctaccgcatcctcgacccggagacacagcgtgtgcgcacaacgcgcgatgtagtgttcgacgaagggcgagggtgggtatgggacaaggcggtggatgatggttcgactctgacgtacgacgacttcaccatcgagtacgtccacttcgagggagctgggggagtaggcagctcttcttcaccgagcgtgtctaccccagtcctcgagcctccaccgactccaacaccaacacactctcgggccacgacttcgactacgacgagctcttcgtcgacaccaccccagccggtgtccccacgcgctctagtaccaacagccactcctccgggcacgtctactccgacgccagctcgtgttgagcgcagcccggtggagttcgctacttcgctctcccacgacggggagcgcatcgacgcgtaccacgacggcgagcagctacggtaccgtacgatggaggatcttctcggcgaccagccggtgccgggactggtgcctcgcgacatggaggcgcagttgcaccttgcgtgcgacgacggtgagcctcggtcttttgtagaggtcgagaaacatgcggcatggcgtgccacgatgcagtcgaagatggacgcggttcaggagaaccgcacctgggagcttgctgacctccctcgtggtcaccgcgcgatcacccttaagtgggtgttcaagctgaagagggatgaagccggagccatcgtcaagcacaagactcgcttggtggcacgcggcttcatgcagcaggaggggatcgactacgacgatgccttctctcccgtggcacggatggagtccgtgcgactccttgcgctggctgctcaggaaggctggggtgtccatcacatggacgtcaagtcggcatttctgaacaacttgaaagaggaggtctacgtgcaccagccgccgggattcgtgctccctggcaaggagggcaaggtgctacgcctgcacaaggccctctacggcttgcggcaggcaccgagggcgtggaatgccaagttggattccacgctcaaggggatgggcttcgagtaaagcccgcacgaggcggccatctaccggcggggcaatggaggaaatgccttgctggtgggtgtctacgtcgacgacttggtgatcactggcaccaaggatgcggaggtggcggcgttcaaggaggagatgaaggccaccttccagatgagtgatctggggcctctctccttctacctggggattgaagtgcaccatgacgactccgggatcacgcttcgacagaccgcctacgccaagcgcgttgttgagctggctgggctcaccgattgcaacccagctctcactccgatggaggagagactgaagctgagccgcgacagcacgacggaggtggatgctacacagtaccggcgccttgtggggagccttcgctacctcacccacacacggccggacttggccttctccgtcggctacgtcagtcggttcacgcaacgaccgatgacggagcaccagcaggcagtgaagaggatcatccgctacgttgcggggactctcgaccacggtctctactacccgaggtgtcctggcaaggcacacttcgtcgggtacagcgacagcgaccacgcctgcgacatcgacaccagcaagagcacgagcgggattctcttcttccttggcgagtgcctcaagcagcaggtggtggccctgtctagctgcgaggccgagtacatggcggcatccgccgcttcgacccaggcgctctggcttgctcgactgcttggtgatctcctcggcagagacactggagcggtagagctcagggtggacagcaagtccgctctggccctggcaaagaaccccgttttccacgaacggagcaagcacatccgggtgaggtaccacttcatccgaagctacttggaggaagggagcatcaaggcgagctacatcaacaccaaggaccagcttgcggacttgctcaccaagcctcttgggaggataaagttcctcgagctctgctcctggatcgggatggcccaactttcccacaagacgacacacaagacttagggggagaatgatggaataagccttgtggtctttggtccttgtggtccttctcttgcttttaggttgtttttccccttttaggacagcatcctttcagttttgcttttagcatctttcagttttgcttttagcatccctaggacagcatctagcatctcctttatgctttattcagtttggatgctctctaggacagcatcgcgttcaaattttagactagtgtgggcagcaattagctagcagccatccagccacctatggctatatatatgtatccaacctccctcgggaaggcatggcttttgtgtttgtgaatgaagaaaaccagaaaattgccccatctcgagtgccatcctgttctcaataagagtaaccattgaaattctaacaagcagggggagtatttaaggcacattacaagcctaaattacagaaactgctagccaaatatgctttatccattcaatgttgagagcaatctacttacatttagcttaatggtatgagcacttgtgcatttgcacaaaataagttcaatttatctggagtgattttttgtggtctttttcaggcatctctccaagtgataccggtacttcaactccctcctgtgaaaaattgcttccgcagacagttgcatgccacaaggtcagcaagactgcagcagtggaaaaaaatgaagatttccatggtaccggaggatgttcattttctgaccaacaagaaaataaacgtacacatgaaacctcatcatcttcactaaagtcaaaaagagtaagatgttcccaacattctgaccatcaccaagacatgaatcaaaatgagatctgtggcaaacccctttctataagcaacacccccatacatgaaaattcagtgcatctgatgcccaacgaactttctaatccaagcatggtaggtcatgttaaaagcaaaatatcaggagatgcaaaggccaatatcagttccaatggaagtccttctgttatgctcatgaatattgccgatgaaacaaagaagacacaacttatagaggtaatttctgtgacaatcttcatctttgagaaaatataagcgccatgtctaatgttaagggaatatgaatcatgaggatgcactcattgcacaactaggcaaactttgatgcattgaataaaatgcattattctttcccttccttttttgttactgcaatgcaatttctcttctttaagatgaagtaagttgtgaatcatgtcgcaggtagttgagatgcttggcggagtagtcacttgtgaaggaaattcatgtactcatgtcattactggaaaagttcgaatgactatgaatttctgtattgctttgtgctctgggttagttttcatctaatttctccttcaacaaaccacagacgccttatgcttccatcttatttcaaactataagaaaaatatggtttcttgtgtttaccctcacttaattcaaaatttcatgtatgatgttcaaacatggtactcattgtagagtactccctccgtcccaaaatataagcatttttagctatgaatacctgtgtccagattcatagctaaaaatgcttatattttgggacagaggtagtaagaattttgaataactagaaaccatatactccttgcagagcctggatagtttctccaaagtggctgaaggaaagcttcaaaaaagggaaatttgtaggtgagcaaaaacttgataactgtaggtttgatgtgtttttgtgctgtcaaatatatgaaaaaacatgagcaagaaattttcatagtttctttagttcgtggaggctggagctcttattgtaattaagtaggtgtttaaacccctagtactccatccatattgaacaaatgtactgcatgaatgttcaaagttaaaaaaaagcattattacttaaagtccatggtaaaaagcaacgacttatctccttccattctcttgctcttttctgctttcctaggagaagcagaatatgtttttcaagatgatgaatttaaggtgaaatacaagtctgaactgagagatgcagttgtgagagctaaagagaggccttgctcattattttctggctacactttctgtctgacgaagaacatccagccctccgtcaatgttctctctcgcatcattaaatcttctggtggcaaggtaacttcatattgtcaagctgtttcaaaatcatgtatacccaaacttctggtgaatatatgccactttttatatttgggattgataccttaactttagaaggtgttgtatacagctacataatccctccgttacacattataagatgttttggtctcttcatccttcgactagattcactatcattcatatgaatttggacacatatgaagcacattaatggatgcattaatgaatctattcaaaacccaaaacatcttgtaatgtgaaacggaggtaatatttatttgagattcatcatgacccatgggaattatgtagaacttctatattctagtgtcagacatgaattttttgcaatgatctttcaacagcttctattaccagtgatgttcaaatgtaaaaagtcttatacttcggttacagaatagtataaaatatttacataaagacgatagttaaactaaatgcatcgctttgatgaattactggcaaactgctgcctgtgtgcttaaatggttgaatgtcaccattagttctgagttagcaaatgcagttatactagtacttcattgaggagtattattcaaatatatttactttacagctcatcaataagctggatgacataactcagcccttgaagacaatcttcttagcgtgtgaagaagatatggaacttgcattggatgctgcaaaaagaggcatcaaaacattcagcggtgagtggttcttgagctgtgtcatgacacaagagcttgaccttgaggcccctcagttcactgaatctctctgatagtaggcctgtagttttagtcaatacagacttcatcctaactaatacctcgttagttggaactgtaaattattcttttggtatctgaacggttaatgtttatgtgtaaatatgaacattatatttttttagacctctataaactatcgagctatatttatgctcggaaactttggtgcaattgttgtatgatttgaatgaatattcttaagttctaaccgggctaatctggtaaatataaatgcaagaagatttcagacacattttaacattagttttgttgcatattgtggtttgcaacagtttttcttttagcttttgtgttgctatattaattggttgccatgtttgtgagcagtaagttacataaaaaaaatactctatataagaggcatatacgtttttcttacggatcatgagcctttacatggtgttttataggcagtgagatgatgtttggtacatatccttgaaaatgtagagtagaaagatagcataggtttcaaaaatcatatggagatggcatggaaaactaatcatatactatcatgacaactgaatcatatctaatccatcagcatggatccattccattagcgtcctttccactccccatcacctcatggcttcacctctagctccactgtttctggagctagagtctaaccaaatgctccgtctgtcctagaaagaattagcctaggagaggaggggatgtgactcctcctaggttgatgtatgtggatataaggggtgtccacatcccctcctaggttgattcttgtttgtatggagggagtagttttagatctaccaaaaaacaaaaaataagtgaaagcgagctaaagtgatctgaaaagataaactagagaggtggagcagggtttaggctgctgtacaattctactccagatttcgtttctggggagtttggattctgctgaacataaccctatttaaaattgcattaaaatatgttattataaaaatgataaggttttgtactgaagtagtagtatttgggataagaaaacgaaaaagatagagcaaattttgctacaaaacttttaaaatttatgtaatttgttggcaaagatgtttcacacctgaaagacatcttagaaaattgataatttgctagtggacacttttggcttaattgaaaagagagattcatcaaatagatgagaatgccccttgggccataggcttctaacataggattggagtaaaaatttgaaaattatgcagctctaatttcgccatcacttaaagtatatcgctaacgtagatcatattccaacttcaccctagcattaggttataagcttttaaccctaagagcattcttgtattttttaagcatctctttttaattgagtcgaaagtgatatttagcacattaccaaatatttaaaagtgtctgtcaattactaaatatttaaaggtatctgtcaatcatgatacttttttcgatgtctactggtaaatcgcatgaatttcaagtgttatagtatgtagcaaaaattgcttaaaaaaatggatgacctcacccgagt

SEQ ID NO: 57546 - DNA, 730 bp, Oryza sativa
  unsure (1)..(730): unsure at all n locations
cggtcaaaactgctttgaacttactatgtactgttttaagagacctaacaaatctgtcttgggcttgcctaactgattggggagcacctactatccataaaaaaagacccaaacactccatggaatccatgttgtttgtggatttcaactcatatgattccacaagcacagaatgtaacctctcaaaaactggcctgtgcatcctaaacatgttgtaacaagcagttctattagctaatgttctcataacccaatcatgtccagactcaggtgctacccttcttggagccttattagagtaaagttccaagtaatacgtaccaatcatggcggcaagcatacatgctcttctcctgtccatttctcttttcttcaaaatataaatgataagatcaatctcatcatcactgctatcttcatcagagatatcttcatcaccactgctttcaccatcctgcaggagtgacatatgcatagaaagaaagcacatcataaatataatatgaccaaacttcaagaagaaaagaagggaaggtttaaataggtccacacatcacatgttcattacgtcacatcacatcaaacaagttgatagttcaacacaaaagtagatcataactaatgcagctaagacacaactaatgcagannnnnnnnnnnnnnnnnnnnnnnnnnnnnnnnnnnnnnnnnnnnnnnnnnnntcagggntnacaaagnccaaaattggcccg

SEQ ID NO: 57547 - DNA, 8230 bp, Oryza sativa
  unsure (1)..(8230): unsure at all n locations
gcagcgattgagaacacctctnnnnnnnnnnnnnnnnnnnnnnnnnnnnnnnnnnnnnnncgcctgcacggctggcctattatgctgccgttgttgggcgtctacgtcttcaccgaccggcttgccttcgccgccgccgactggtgtccacacctgcacggctggcctattatgccgccgctgttgggcgcctacgtctacaccgccggcctgcctccgtcgccgccgactggtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacccgagtagtaaactccgatccgtgaaactttgttccattaatgacgaactcatgacactcatatgcatgattgggaagtgcttaggccgactcccagtgcttggtggctatgattagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgctgccgactggtgtttccgcctgcacggctggcctttatgccgccgttgttgggcgtctacgtcttcaccgaccggcttgccttcgtcgccaccgactggtgtcctcgcctgcacggctggcctattatgccgccgttgttgggcgcctacgtcttcaccgaccggcttgccttcgtcgtcgccgactggtgtctccgcctgcacggctggcctttatgccgccgttgttgggcgtctacgtcttcaccgaccggcttgccttcgccgctgccgattggtgcttccgcctgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgccttcgtcgccgccgaccggtgtcctcgcctgcacggttggcctttatgccgccgttgttgggcgtctacgtcttcaccgaccggtttgccttcgccgccgccgactggtgtttccgcctgcacggctggcctttatgccgccgttgttgggcgtctacgtcttcaccgaccggctgcctcgtccgccgccgactggtgcttccgcctgcacggctgacttattatgccgccgttgttgggcgtctacgtcttcaccgacaggccgcctcgaccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgccgactggtgtttccgcctgcacggctgatttattatgccaccgttgttgggcgtctacgtcttcaccgaccggccgcctagtccgccaccgactggtgtatccgcctgcacggctgatttattatgccaccgttgttgggcgtctacgtcttcaccgaccggccgccgcatccgccgctgactggtgtcaccgcctgcatggctggcctgttttaacgccagctgatgctatcttcttcacggctggctacatcgctgtcactactaataggcatcagtatcttcaatacaagctgcctacgtttgccatggctgccgactggtttcttcacttccatggctgcatgattctgccagtgttgattggcccattatgccgctgttgttgggcatctacatcttcatcgtcggtcgtctcgtctgctgctgactagtgcccttacctctacgtctggtttatacagctaccactactgatggacatcatcatcttccgtcgccgactggttatgccgccgtcgactggtgtttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatcttggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcagctctcctccaattatttgtcttcacggttggcctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtttacgtcttcatcgtcggtttgcttttgtcaccaccgactgttcttttgttgttgttgggtgcctacatcttcattgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaagcctaatatgtctgcaacccatgttttcaggtgtggcctgtcacgttcttttagggacttaggcactttttgcttaggccaaagtgcgcgtgatcaagtgcccaataccccaataccttaaaatccttttataccgcagttacttaactttttaggagttggtacaatgcatcttaaaaggtgtcaaacagtaaagctttatatagctggcccgctgactttttaatatagtcatggtgcttgttggttttttaagcaattggttagatacaatatctgtgcttttttgcacggtagtgtgcattttaatgaccaatattatggcttaggctgattatataatgggggcatttttcaagcgggtggtaaatcctttatgagtttatttactcggattttataccacatatgccatatatttccaggggtggtggaaccatgttgtttttagggacttaagcacatttattaaaacagtgtgggcatggcgtatgaccaatactttggaaatttctttattcacaacatacaagcttttttatagctgttttgctatgtgaattttcaataatgtagccaactttaggttacactcatcatattttacaaagcagttggtatatcactcggatcatgttattcagggatttacaccgcatatgctacatattaatatcaagtcgcttggttaactataattatcgaagccactcggttggttggattatttattccttgactatatgcttagtttgttcacttaaccgcatagtcgagggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggcaggagacaacctgatcgtcagatctatactacacccggcggattcaaatccccaaacaggagtagggtattacctctcattgagagggcctgaacctgtctaaatcctttgtctccacatccatccacttttacgtctcgtgcgctaccccgttttattattgccgaatccatgtttcgacataaacccattcaaacaaagatccattactctcttacgtttcgagacgtatcttggtcgtttttttgttgcgttgttatcatctttcgttgtgatttatgaacagctcctgccagaaaccagagttgctggcttctagaatagcaaaggcagcggcacgcgcggaccaagcccccccccccccccccccggcgcgcgcgcgcatgtgctgacaattaagcgtcaaaatgaacgtgcgttggtgtgtgcgtggacaaatacctaactatcactgtgaattcagccagattggtgcgttatcgcacgcccaagttgcccaagttgccgagatcgatttggaacttgatcaaatccaaaacgaaaagtaggagatcgatgccgcagtgcagcccaaaactacgtacgctaggctacgtcctatatatatattcacctgctttaatttgcatcgatcccaacttaaactgagtgacgccgcgccaatatgcagccgcgctgtacgctcatccacgccgtcgccgtcgtcgcggcggcggcggcggccgcgctgctgcttcctccgctcgccgccggccagccgtggccaacgtgcgacaccagcgccggcacgtacaaggccgggagcgcctacgagtccaacctccgtgacctcgccgccgcgctccgcgcggacgccgccgcctcgccgtcggcgctcttcggcacgggcaaccgcggcggcgcgcccgacgccgtctacgggcttctcctctgccgcggcgacctcagcgtcttcgactgcttcgactgcggcacccgcgtcctcgccgacgtccgccgcgtctgcggcggccgccacggccgcgccaaggacgtggccctcgtgtacaaccagtgctacgcccgattctccaacaagggcgacttcctcgccgccaccgacaacgccgggggcgagacgctgctcatcagcggcaccaacatcaccgaaggcgccggcgtcgtggcggcgtacgaccgcgcggtgaccgagctgctcgcggccaccgtgcggtacgcggtggaggagaacccggcgaggctgttcgccacggggcagcgcgtgggggacgacgcccgcgacccggggttccgcaacatctactccatggcgcagtgctcgccggacctgccgccggcgtcgtgccgcaggtgcctcgacggcgtcttggcgcggtggtggcaggtgttcccgctcaacggcgagggcgcgagggtcgccggagcgaggtgctacctgaggtctgagctgggcgtcggcccgttctacaccggagctcccatggtggtgctgcgggcggacaaggtctagccagcgccgtcgccattggcacccgatggaagctgcggtagctacagcctacagttctacgcaccaaaatggtggaggtgcaccctacctatggccgacaaagtgcaagcaaatctctacacgtatacctatactattattaggacattccgacaaaatgtccacgttcacccgagaaattttagtgaataaatctggacatcgatccagttaaaaccaaatttacaacggttcaataactaaaataatcgacatgcagctcttcgccaacttcaggtagaggttcacaaataaaattcagtagttgtgggagctttatcttgtgttggtgtttattagtttgtgcttacttaatattttgttggtgcgcttctaaactcactgtgtgagattgcttttgtgtgaattctgtaataattggatatagctcattaagcaaaaaccgagatgttttattccatcacctataaaaaagctaaaataatcgacaacgctttcagttagacgtccaatcaaatagaaaagatagggcatcatattacccatgtctaagctacatggccgctatatgtgcatgcagtagcctatcttcctactcactagcattctcctcccttccgatgtcttttctacgtttttaaaatagcttgacatgagttttcttctaaattatttatattcaatttacaatccgattatatcttgaatttattgttattaaatatgtaaaaaaagatatcacataattatattcttatgaaagatatataaacttatgttttaaccatgaaaattcatgttcatacgcgatactgaaatgtttcaacatatgtttcacataatctttcagtatttcaatcactattttttttcaatgtttcacctgtggacaacttaaacatttcaccccccccccaaatttttttatggaaattaggtgcctggtatcaatttcatgttggtacttcctcccgtcccgaattccctgatgttttggataagattgagatccaccaattaaacctttaccatcaatcttcctctcatttacaatggtaggcattcttaacatttccacaatcataatgatgtttaagaatctagacatatttatttttcttgaatcctttacactcatataccatcaaatggatgggggaaatacttcgataacctacccttggaaaacgg

SEQ ID NO: 57548 - DNA, 966 bp, Oryza sativa
  unsure (1)..(966): unsure at all n locations
gcgccaccgggactaaggatcccggtgatctttagccccggttggtgctaccacccggaccaaaagtcccacccctatatatatgtcttcttcctcctccagctgcccgagcaagcttcaaaatttcttcaaaaaagagtggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggtcatgccaagctataattgttggacatcccacggagagcaaggtgttgaaatggaagaagatgaagtggaagacgacaatattnnnnnnnnnnnnnnnnnnnnnnnnnnnnnnnnnnnnnnnnnnnnnnnnngtacatcgaattgcattcaaaanngagctg

SEQ ID NO: 57549 - DNA, 4663 bp, Oryza sativa
aaaaaaaaagctgaaccctatgccccacgttaggttagcctctctacacaggcgcatgaactactctagcacagtttcagcaagttccattctggctttgaatggaatggtttgcctctgtctgtctgtgtctatgacagtatcatactatcttgtgagcacctttggaattcatgaattttacagaattttcacatgatgaaacagttcaagtcacatgaaattcctcgaaaaatcatacgtcccaaaaggacgcttgaacaaaacacaaaaacacacacacccaaaaaaaacccgaaggaactgcctcaatatccttccaaatgatactgtgtgcttctttctgttataaaaaatgaaaggaaaacgaactgttgtttcacctataacctattgatgtgctgttgctgatgatacataaagaactagtctaccaaagagtggagaacagaaccagaacgccattggtaatttggtatagaatgaatcatggatggaagacaagtatcctgttcatgagcttgtcagtcaactcccacggtcttgtagctcgttcatgagaggaatcaactccacagtacccgttccagcatcgaccactttgattctttcatcttcgacagccacattcagagcatgacagctagaatcatctgcgacaaggacggaaaattcagcagtgtcttgacctcctttcctagcttcagtagattcattgtcctgaagcatctctgccgggaggagcattgagttttggtcactctggggaacaagaaacagcagcatcagcgggagcagcctcgacaagtttctgatcaggacggcaacccagaggttactgaactctgttcgagtcacattcagcaagtgcagcatcaggccaccccaccagccagacatcagcaacccggcattttggatggacatgagcagcgcatagaaagttccttcgatgcctggaggacaaagcttggagcaaagcacgaggagcggcaaccatttgagcctcccaaccatctgggagacactgttgtcgatcaccgcaaagacgtaatccggaatgccgattcttgtgttgagccgggtcaccattatcagattgagcattcctgccaggcttgaaagaacttggccccagaatagcacgccgcggaaagggtagtccttcagtgaaatttggtatagtaaaactccgagcagcgaaccgattgaaccgaccgaatacacaaggccaataaattcctgaaataaacgatcgaatgacgcaatcgaagtgtcatcagatgattaaaattagaagaaggtcaaataactgaatttatctaaaaccacacctcattatatggatttaacagtggtatgcattctcagtattacagtccatgcaaatgatgcgatgaactgatgatatctagcaaatatctatatgcaggaatgtgcatacctcagagaatcctggtcccactattggatcagtgtaccagtagaacattcctgcttggatatccaggcttagactgagagaaacatacatatacacacacggccgccaaacttcagtgttgcccccatggactgaattgctttgtagaatttcctatgaacctgaatccatcaaagcactcaagtggcatcactgtccatgcctgaattcagcaatctcaacacacaaaaggaaaggtgttcaaattttgtcttgacattctgacctgcttgtaatcgaaatctgtaactcgcctctccttcagcaaaacaccagccaagaacaccagtgcagaagggatgcttagtaatccaagagcacccttagaacaagaaaagaaaaaaaaagcaagaatcacaatcatatcaattgacattgtgtgagaaaacaaatgatgatgcaaatcattatctaaggtcagggaatatcacacctgagaccctatggagtggacaagaagaccgctgatggagaatccaagcaatgccccaacggaggagctgaacccacacaggctctgcatgtctgcggctagcggctggtgcgtgatgctgttctgagcaaccagcgcgtccaccgtcacgtcggccaccgccgcgcccgcgctctgcgccgtcagcgccaagatcgccggcatgatgcccagcttgcggtggagagagagcgtgagcatggacgacgccccaatcactcctgaatgaatcaccgagagaagtgatcaagaaaggcgaaagccttcgaactgcgagatgggatcgaggaggcggaggctgcaatcccctcaccggcaggaggaagtacgggcggcggcggtagccggcgacggggacgacgtcggtgagcaggccctagatgggcttgacgacccagggggcgctgacgaacccctggtagaactgcgccgccgacggctgcacgcgctgcacgtccttccagtagtaccccgccgtgacgccgccgacggcgtcgccgacgccctggcaggccccgtagacggccacgacggcgagcacgaagctccagcgcagctcgcgggacagacgccggagccagccgccggggaaggaggcgccgccgccggcttctcgaagcgccgcgtcgtcgtcctcctcttggcgatccatctgggcagcgatttcttgccgggggtttcttggggatctacggcggaagcccgccggaattcgcacggctagaatgcaggtctcgcgattgctcggtgggagagattgacgaggcgcatcttggcgttggcgagctgagcaagagcaagtgtgcgttgatgggtatctgcgctcaaggttttgacttgacaccccccccacccaccttgcaactattatagtactgtatactcctactaatttaaccatggtaattttgcaccattaatctatgtactagtagtagaaaactgggcaacatgtcaacactaattttgcctttgtgccttttactattgcgcatcacctctttgcactgcgttattactgcgtagctgcttacgacctgatcaaggcccgacaggaattaataagtgaatatgaaataagttcactttcgacatttaaatgctgagtttgaattgcgtccttatccacaataccagtataatatgtcagttaatttataatatcggtgtacccgagattctaaaacagtataacaccccattttaactgacatgattagccaactatgatcataatgatcgagtaagcgtgagacccacatgagccccatatatcagcggtcaactctttttttccttcatcgccccttctctctacccatccctcttgccaatttctctccaccggtggagaaggccagaagggcggtgagcagcgggaagaaggatagcggccaatgggagaggggtgacaaccagtggactagaagaccttgagcttgccacgcggctgctcgagcaaccctcaccctcaggaacccagcatcgacctcgattgcgtaacatcatgttgccccctcggcttaccccgatggcaacacaagctacgtggccaaggtcactacggggttcttgagcatgatggcttttccagcagctgctccagttcctgtcgggagagagatggggaaaagggatgggtagatagatattaggtaaagggactcggtagagagagttggctgctaacatataagacccatgtgggtctcacgctgactcaaccagattgataatagtcaactcgtcacattagttaaaactggatgttatactatcatgtgacctcggttacaccgattttgcaaattggttgaaggacacaatctaaactcatagtcaataagagagacctaaagtgaacttattataatgaatattgactattgagttggcccagcagcccaccatgttcataagaataaggtccatgacaaatagtgctcacctacttccgcctctcccagtctcctgttcgttcctctctcccaagtctagggatgaaagtggttggaaatggtcggaaacggcatcattattttattattttttaaaaaacaagcagaaacgggcgaaaaattttcatattcatgaattcatctatttagtgtcaacttcaatgccacgccgatagaaattaaaaaaactaaattttaaaaacgataaccatcgataaaaatattattattatattagtttttcggaaacggtatcggtacggtcggaaaatttccataccgttttcacccccagccaagtcccaacaacgttccgaggtcacagcgctcgtccgggcgtccatcgctgccaatttcaggcccgttgttttggcgcccgaatccccctcccgcatttttccccttcagaaaaccccgcgcgcgcggccttctcgattcctgcccgtccgatccgccctcacagcctcaccgcctcatctccgccgtcaattggccctaaccccaccgaccacccgcggccctcgtcttcctcctcgccgcgccccctttcacaacggagccgggcgctgtccccccctccgcgctgcaccgcaaaccagccgccgcctcccgtcaagaccgtccttcgccgctgcagccgtgagggcatccctccccctccccgccgagcgagctacaccggcctctttccccccctgccccgtgctggacggtgagtggcattcttcttccccctttaaaagttttcta

SEQ ID NO: 57550 - DNA, 794 bp, Oryza sativa
ggccggactgaatacttctcgacacacgccctctgacagaggaattcggtaccccttcgtctccgttgtgcccgtctgtctccgccgcgcccgttcgtcgttgtttttcccgcgcctcgtcgcgtggtggtaaggatccgtcctctcgcttccccgccctcgtcctctcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaataatccgcaaatctccatataacagcattaaacctcggatgatcatattttggtcatacgaactccgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgtaggttcggaaggccgttctctctgagcaaggcaagtcaca

SEQ ID NO: 57551 - DNA, 725 bp, Oryza sativa
  unsure (1)..(725): unsure at all n locations
gcgtgcactgatagcttagagcccatgatacnnnnnnnnnnnnnnnnnnnnnnnnntatcaaatgtagattacgtaatatggtaaatttcacataaacataacaggagcagacaaataattgacagcacaagtcagtgattatcaaacataactcgctaacctatctcacaagatacagaatgatctcaagatgaaacagtgatggattcttaacatgagaaagcataccaatgactgatgtctggttgcaaatccaatttgtcgctgacagattgttgcttcattttctcttcaaaaatatagccctgccaataagaatcatacttagtgttatatcatgtgtgcatgaactaaacaccaaataggtaaatatacatgaaaagaatgagctgagtgataattgtaggctataattccataatgaaaaccaattggttcttatggcaccatacaccatattttggtggcctgattactacctaaaaggatgcatgcaaccaaaagttctttcaattatatgaaaggagctgcgcttaagatgcaatgcatctgaatttggaaaactaagatggataatctataagacattatgatatatgtttaattgatgcagcaaactgtggaatggaaaacatggaaattgaaataatactccataaggaaatcatgacaatattacatttttgtgtgaggtcccttatanggtgataggaatatctagatc

SEQ ID NO: 57552 - DNA, 1106 bp, Oryza sativa
ccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctgggcgttctgaattcatg

SEQ ID NO: 57553 - DNA, 529 bp, Oryza sativa
gatgaggaaatcaccattgccgagcgcaagccatggcattagaggaggaagcggctgagccagcgcgatgtggcgccacggtcggcacacggctctgaagcgaatccggtcggccaaggagtgcagacggtggagcacaatgtccagtagctcaggccggagatctgaccaagccgaagactgcgcggtggccatggcacaagcctgcaaaaaattaagatgattaaggtttcagtgttagcaaaatttcatggacaagattcagaatccctgcgtttcttgttatcatcaggagtaaatcaattcgcattgcaatcacacagagtaaccaatcaatttgcaagagcacctgttcctacgcgcgcgcgcgtgtgtgtcgccctgtcgcggggaggaagctccggagaacggggagatgggcgcggcggccggtcgtgtatggttggctgcagaggaaggggcccggggagccgccgccggcgaggccgcgatcggcggagaggcgtccgtggtgattggggaatttggg

SEQ ID NO: 57554 - DNA, 11189 bp, Oryza sativa
attctcaccagtatgacacttccctttcagctaaacttccttgagctcctccaaactccaaacccacggatctgatggctcccacagcaaatgagctgaagaacataacgcaagcaacatgatgtgcatctcattcccatctccaactcttagggccatgaagatggaacaaatttgataggcaataaagtttcgagaaaaaaaatgttaggtgatatgaatgtttgaattcaaaaggaactttccctacattataggtgtcacatactttcaggacatggacttttgctataaatttggagggaaaacaaaagatgaaaattaactatagaagttccagagttctatgtctattttccgctgctcagttgaagacagcaagcgttctccttactgttaaaagcaccaatgttccatacacctcttttgagcaaacactgcatttcctatagcattatattgggaatgccatcgagtttctatgttttttatttttcttcattcgagaaagcaaacatttgcatacaagtatcgcagatgctccaacatcatcgagcgacttagatctgaatgtgtttccttcatcttaccaaaagcaacctgattacatttacatctgaaccatcagtaaaagttaattgacacttctcttatgttcatgccaaaactctactatcaggagatgccaagaagagaaatcgtaaatataacacctggaagcaagaatactatccaactaagttcaagtttcagaggggaaaagccaagttggacaccatggaccgccgtgtactgcaagaggctccgccactagagtctctgtcaacaatggcgccactgtcccgtctctcatgttgtacacgccagagtccaaaaaaggatcttcaggcttcccattcttgatgtcctcatgcatgaagtagatgcagtcttcttcagctccggcactgagcgacttggagcagcccttgctaacaaagagagcatgccccatcaatgtatccaccttgatccaccttccacagccactgctcaggtctgcggcttcaaagacttcgaaccgccgtgttcgcttaacaatgccactgtcgcttggatagattggtggaagattgatccaccgtcgcaccatgagcagccgatcgttggacgcgacgagatatcgctccgtcgcgtacctttcggtggagcaagggccaaaccatgattcctcgcctatatctttcagggtgctgcttatgcatcttatgccaatctgcttagcattatcgactccaaagatatagagctcctcctgacgtttccttacgtcagatgttaggtagtagagcttcccttggaaggatgcaatgtcgacgatggagctagggaaatgtgcaagtggaggtgaaaatccaatagtgacaatgaccttccaagtgcggtttccgatcagcaaagcggtgaagttatcagacaccaccgccttgttgatcagcgggacaagtcgttgcctatcggcggcgaggtatttgtacctgatgtatttagggagcacggcggcgagggcggcgagaggggtcgttgccaaggaggacgggttcatcagggagagcatgccgtcgccgtgcacgatgaggaggccgcttcccgtggaagcgaggtgcgtggcatcgccggggacggcgggcaagcggtgggccgcgccgtcggggagggtgatgaaggcgccgccgcggaggaggagccacgggaggggcggcggaagaagatccagctccacccgcgcgctggagcgccatgggcggcagacggcgcggaggcggacgcggtcggcgtgggacggcaggcggaggagcacgaggcccaggagctccgacgggaggtccggccatgggcgtccactgcagggctctggtgtggccattattgcctgggttggcggaggctgatcgtcggcgtggagctctaccttccgtttcttcgagggcatagtctcgccgagttgtggggacaggtgcatcgccggtgggagccgccggcggcgaggccgcgataatcggcgatcgccggcgaggttggggaattggggtttctcgcgtaggaggaaatcgtatagctgctcctgcctctttttattattttttttttgagagagaggaaatcgtatagctttcttatatggagaaatcgagaaaggccgagtacgagtaggagtaggccgtaagccagtaaccggggctagtaggccctaataggcccatctatgggttggtttgtgtataatctctcccgtataccttaccagttgattgatcaatgtagcacatcatgatatggagctaccacgattctttggtacaaagaaacaaggagtaaactgtccagaatgccaaatagcagaagagcacaaaaccatatgagtaactaccgaaagataatcagatgaaaacacatcatgatacaactacaaaacacgattatagggtccagactgatgtcaacgtccaagccattgcttcaaagcaaattattttcttcctcaacagtatgaaagttcctttcagccaaaatatatgtgaatgttgattttcttttcagtttgctctgtagctgaacaattgtcgtttccagtaatggaaaaggggagcgctgtgctcttctgtttcaaaataaataaataaaaatatgcaattcataaaaatctgacagttcccatagcaaatgtgcaatgtcccgctgaataaaaaatcggtgcacttatacacactgcacacaagttggaatttatcttctcctatggtcatatagattgaaggaattttataggaaaaaggaggattaaattcaaaaggaacttccctacattagaggtgtttacattatgagattgcaccatcgagacccctacagggcaggaaattttgctatgaaatttgaagggaaaaaaatgaaaatcaattggaagtttcatagttctttgtctacttttccctgctcagttgaagacaccaaagcattctcctaaaattttgatgttaaaagcaccaatgttccaaacacctcttttgagctaatactgaaacactacacttttcctacaagcattatactggtaatggcattaagttcctacatttaccctgtatatgaattcgtgttcctgcatttgagaaagcaaacatttgcatacaagtactgcaaacacatagcaacaaaacagtatgctgcaacatatttcattaagggacctagatctgatcatctttttccctagtctttccagaactcacctgattacatctcaaccatcattaaaagtttaactgacactttgtccttatgttcatgccaaaactctagaacaggagatgccaatcgcaaattgataccttgaactccggaagaaagtatacagtccatcttagtttaagtttctgttggaaaaagccaagtcgaaaaccatggaccgtcatgtgcagcaagatgctctgtcactgcagtctctggcatcaatggcgcaaccatcccatctctcatgttgtacacgccagagtccgaaagaggatccttaggaatcctattcatgatgccatcattcatgaagtagatacagtcttcttcagctccggcagtgagtgactcggagcagctctcgctaacaaagagagaatgccccatcagtgtatcaacttttatccatcgtccatgttcgctgctcaggtccaccgcctcaaagacatcaaatcggcgagtccgcttgatgctgctatctctcggcagcatgggcggcagattaagattaatccaccgtgccaccatgagcaaccgatcgccatccgcgactagatatcgatggaacgtgtacctgtcggtggagtgagggttgaaccatgcttcgtcttcatcgcccacatctctaggagtgctgtgtatgcatttgacatcagacaccatgggctcctcatcgcggacttcaaggatgtagagctcctcctgacaattctctatatcaaatgttaggcagtagagcttcccttggaagagcgcaatgtcgaggatgtagctagaatcaggaggactccacttcaccactgtatgcggctgtccagaagtgatgatgaccttcgagctgttgaaatagaaagcaatgaagtgttcagacaccaccgccttgatgatcggggtgattctccgttgacccagttggaatgcggtgtcagggtatttgcacttgatctcgccatgaaagaccgcggcgaggtcggggagaggggtcgtcgccgaggaggacgggttcatcagggagaacatgccgtcgttgtgcgcgaggaggaggccgctccctgtgggcacaaggtgcgcgacatcgccggggatggccaagcggcggtgggctgcgccgtcggggagggtgaggaaggcgccgtcggggaggaagagccacgggagcggcggcggcagaagcttccgctccagccgcgcgctggagcgccatgggcggcagacggcgcggaggcggacgcggtcgccgtgggacggcaggcggaggagcacgaggcccaggagctccgacgggagatccggccacgagccaccattgcatggtcgctgtgcggccatcgcgccggtggaggagatgctgcagcggcggaggccacccgcagagtacacgtcgccggcgagcgatcgaattggggaattggggtttgggtttttttttctttttctttttcttttttctttttattttttatagagagagagggtggatttgcggaattattcacggcccatttgttgattttcatatgggcttggaagagcggccgtgcagtgtgggccggtagtgcaaacgtctcattttcttagaatttctcctctctctttttttttttagcttaggtcttctttaatgtttacaaactcagttcaatttatacatgattcagggcaaatacatgtcctatgttcaaaattccaaattaggcttagacctgtgactgttggttggcatgtctcttgccgtataccttaccagttgattgatcaatgtagcacatcatgacatggagctaccacaattctcaggtacaaagaaacatggagtagactagcaatgtcccactgaattccaacgataaattcgatctcagcaaacaaaacaaaggacagaccccgggtatcaagcatatacacggaataagatgatgaactctacactttctgaagcgacagccaaacatttcatcagaacagagtgattaacaagtaccacctctatattttaatgtatgacgccgttgaccttttgtccaacgtttgaccattcgtcttattcaaaaaatttatgtaattatcatttattttattgtgacttgatttatcatcaaatgttatttaagcatgacataaacattttcatattttcacaaaaaaaataaaacgaatagtcaaacattgctaaaaagtcaacggcgttatacattaaaatacggagggagtactaacattatttaagcatcatccatcagcctatctacatgtaatatgtccatataggatacttcaaaatacatcaacagccgcatgccacacagtacgacggattacattcagattacgtagcaacatcagcagggaagaaccatgcaggatccccccggcctgtaggatgcagcctcggcgctgtggcatcctgcaacaacggcgtgatcaccccgtttctcatgttgtagacgccagagtcacaaagaggatcaccagcataaggcctccaataatcacacatgaagtagatgcaatcctcctgaggtacaccacattctgcagcagggagagactaggaacaatgtgtgccgacaaatagtgctcgaccccccaaagatgtaacccttctccacatgcgagagccggtggtcaagtccgcttcaaagaccttgaatgaaagagtacgcgaatgtttgaaggagttgggctctgcaagagggagcacaatgccaacataccgtgtcaccatcaacaggccaccaccagactcaactagatagtacctccgcataatgagataatcttctggaaaggattggggttcagtcgtcgaatcatcctgggagtcaattatgcattcaatggatgagatctttgggttacctatgtggctctcatcaatctcgaggatgaagagtttattgaaattatttaacacatatagcttcccatccaagaaggtgaaatcctgcatgccctccattgtagaaccctcgactctgaatgactcagtggcaactggaggctggcatatgcacaatgccttttgatgagaacgattcatgatcagtgcaacaacgagggaagttggagaaaagtccaggggagagggcactgccaacttataaaagagaggaaacttgggcgcagcgtaccatagatgatgacaccaaatggtatcaagtttaggaagctgcaatgtggccttagagaacaggttcataagcgagaacccaccatcgtcgtggctaaggaagagccagttgtcaatggagcaatggcaggaagcatcatctggtaaaggcatgcagtgaatttcaccatctgaaatgctaaggaaggtcccgttgaggagagtgagccaagggagcggagggggaaggggctgcagccgagcattggagcgccatgggcgacaaactgctcttagtcgaacacggtcagctaaggagggaaggcgtgtgaggacaagacccaggagctctggctggaggtctgcccaggatgaagactggacagctgccatcatgcaagacttgaaatctaacaagaaaatacaaagagttcagaatttaacaaactactctgcacttaaaattactaagcacttacactatttacactatttctgtttttttttttttgcggggtacactatttctgtgtttgatgaggctagaacagaaaggatgattctttcaagtaatcagtatcatcaacagcacttctaaaactatcatcaatagcagcagcatcattaaatcctggcgcattcccattttcctttcattagggaaaggggcttcttgttccacaggaaaagaatgaaagcatatcatttcattctttcatacactggcggttttttttttttttgaatttgaagtacttagcacactaaaatgtgttctttgtagtggggtagtgaatggaatgctaagacctgtatacagatgcattgtggatgcacatatggaccaatgcattaaaatttctagtcttaaatctgacacgtttccccgcaaaataaataaataaataaataatctgacacgttccataccagaacactagaacagatcagttaaaaacaagcacgaattcggagagaaacctgtagcaatctgctcagctaggggaagggctggaggagattgaacatgcagaaaaccacagaaccactcctcgcacagactagcggcggccccccgtacccaccacccagctgcggtggggagaactgccgccggtagccggggagagaacgccgcagcggagcgaggtagacgaccgccggcgaggatgaggagggtgtcagctcatcgagggttcgccgtcctcggtgatgcacctcggtgcaggggggttttggccaagttgggccgcggcccacgagtcgatggaatctagaaattttacccctagttttctcgtaagctagtgaaggctcctttaaaatggagaaaattttacatttttacatgaaatgaattcaattcttataaaattgcaccaaaatttctccatttcaaaggtccaaaacttaggatgtgttcaccagttggagttgggaacacttccccattgcacgcaaaacgaaacaacgaaatcaagtattagctaaaaaaatgaaaatggaataatatgatttttgaaagcaacttttctatagatttttctttttgtaaaaacacaccgtttaacagctggaaaaatgtacacacgaaaaaaaacaagaaaggggaagttgggaaaatagactaaagaacacagtcttagccattagggctgcaaggccgtggacatcaccgtttagtcgctatctggcgcaacaacgattcatcaactaataccacctggagtagctcgaattacatagaaagcggacattgcaataatttactgaaaaggattgatcgagactcttaattagttccatgactataaaacgccagaattcgaaatgtatcctttttccagctctaacctctagtttggttgatcagtgactcagtatgaccacactatatgagttcttgtgacttgtaacatgcacatccgttgccttaaaaaaatgcatttctgtagtaattgtcaatctcaggaaaacataagaaaggatggataagtcaagtataaaatgagaaacatgaactcaatgctttctgaatccagagcaaatcattctagcataagagtagacatgacaagtagcaaaatattaagcaacatccgccggtttacatgttgcaagtgcaatgagaaaacccaaatcaaacagtcaacagagagtgccatgaaatggggctgattacatttacatagcaccatctgcagggaagaaccatgtcggatgcccctcgcctgtaggatgcagtcgcggcgctgtgttctcctgcaacaacggcgtgatcaccccgcttctcatgttgtagatgccagcgtcgcaaagaggatcttcatcagatcggaagtagtcatcacacatgaagtagatgcagtcctcctgagctccaacatattcagcagcagagagagacttggagtaatgtctgccaacgaagagtgcttggtctcccaaagattccacccttctccacatacgagagccggtgttcaagtctgcctcatagacctcaaatgaaaaggtaagtgaatctttgaagatatcatcatcatcttccggagggaatgggacaccaacaagtcgaatcacgttcaacagtctgccaccagatgcaactagatatggccatgtcacacagatatggttctcaggacaaggttgagaatgggattcagttggaaaatcttccactatgcattctacatgtggaacctttggcttttctatatgtacctcactcatctcaacggtgaagagcttcccacaactaagtgcatacagctttccaccacagaatgcgatatcatagaagttgttcttgattggacgatcatgaaatctgaatgagtcagtagaaattgatcgatgaacaatacaaactacactgtgacgaagagggtcattcatcagcacggcaacaagggaatctgatgataagtccaggggcaagggcactgccaacttatagaaaagtcgagtacatgcattgtacgcatttcccctctcatgatgccaaatgcgggctagcttaggaagctgtagtgtagccttggagaaagggttcatcagtgagcacccatcgtcactatccgtgaggaagagccagttatcaatagagccatagcaagaagcatcatctggtaaaggcatgcggtgaatttcaccatctgagatgctgaggaaggtcccgtcgaggagattgagccaagggaatggaggggggagggtcagcagctgagcattggagcgccatgggcgacacactgctcttagtcgaacacgatcagctaaggagggaaggcgcctgaggacaaggcccaggatatccatctggagatctgcccaagatgaagactgggtggctgccatcatgcaagacttcgaaactaacccaaccaaaaaagacaaagggttcagaattttacaaaaaaaaaaggacactaaacattacaacaccacttcaccaggtagtgtcatactatttaacatggcaaaaggaattgtacttagtcatttgctaaaaaaaaactcaaggtgcatgactaaataaaatggatgacctgacatcatgcaagactgcaagtctaacaagaagtgacaaggtgttcagattctgattaggtaaaaactgacatcatgtatgcaaagagcactgtatactttttttcacaaggcaaatgcaactcaactaagcttttgtcgaaatctcaaggtaaatgagtaaacataaacaatgattctttcaactaactattatcatcagcagcaacctaaacgggtaatgacgtactccctccgtcccaaaaaaaaggcaaaccctgggtttccgtgtccaattttgactgtctgtcttatatgaaatttttttataattcgtattttcattattgttagatgataaaacatgattaatattttatgtgtgacttgtctttttaatttttttcataattttttcaaataagacgaacggtcaaacgagttggacatggaaaccagggtttgtctttttgggacggagggagtagtgaattagacgatgcactgatggtatactaagtccaatattcagaaacgatgcgcactatatgatttcatatgacaaaaacactgaaacaaggggatatgctcatgatcatcggtaccgcgcattaaaaaaaatccgtggttctcttacacatcaaatgctccatgccatcttagatcaaccaaaagcgaacactaatttggctaggttaaggtatgaactaagcaccaatccggtcccttccggaaaggaaagtgtagcaaccgctcgagtaaaggggtgtacctgcggggcttactcgtgatcgcctacttgccgccggtcgccgagagctggaggagatgggactagtagggggtagcgcgcggcggagaagaggaagcggcgcggagtagcagcctccgaagtaggcgggggcgaggcagatctccggggagggggatgaggaggaggagcgcgtcagttcgctggggattcgccgcctccggcgaggggcatcgccggcgagcggttcaggaggcggagcgagtggtcgaattgggaattgaggtttcgtgttttttttaaataaaaaattgatgggaaggttttggggaatttgtgaagcgaggagatgaattttttgggccatttgttgccactgcagggtgggctggtgcctggtggcacaagccacagcccacaaggcctcctttacagtttttttcttttttgaaaaattaggcatcagtttttttcttttcttttttttgagaacgcatcggttcagttgattccatggagaaa

SEQ ID NO: 57555 - DNA, 6483 bp, Oryza sativa
ttctaatatcctttaggggtaattttggtagggggtgttttgttcggtgcgcatcttcggttcgcatcggttcacatcgaggtgtggactccgtcgcgctattccttccccggcgtcaccgccttgcccgcatccgtccgtatcgctcgccgtcgccgccttgtccgcctcctcagtcgccgtccctctcctccgcccgcgtcgccttatccgcccctccgtcgcagtccgcctcccccgcccttcccgccctcaccgctgtctccagtccctccggcgccgtccgtcggcccggccatctccccctcccccttcggttcgcatctggtcggaggcaggcaccgcaggcggcagcgcgcccggcggctattcctcctggcaggcggcgtcacggctggtggcgcggtgcgtcgcgtctgttcgacgcaggcggcggcgtggcctgcggcgctggtagtggctgggtgcggcgaaatcatcaggtaggtagtggcaatcttgtttttcagttcaatagcagttgaacttgccgaaatgggactaatgtgttacctgaattgctgaatctaaatctgaaaattttcttctggattttaaaagctattgtttttgtaaataccatcggattgatttagtacaataaattaagcgctcaattgttaaatagtctttcaaaatgattatgcagtctcttttcttttccagacatgcatgaatctatggttggcttaaaaattatagttgaatgggcacaacattaatgttcactgtgtacaaaaaactgtggttgtattttgaattttgtacatgatccacgacaggtaatctgcattggttatttggtatatttgtggagcatattatagatcaagatatatgtgaactaatagcattttaaaattaaaatttgtccagatcaccatatttgcatgaatatttttccttcaaagttggtccattttgttcagacaggacaacattgcacttcattttttttttcatattatggttcaagtgcagatattgtggattgccataacactatcaccttccaagtgcaaattagcactgagatttctgggttgatcagtcgttgtgagtatggtattttgattctatgttcttctatgattaccaggctctggaaggatgtaatctatgatatatacaggtggtgatcatagcatgatagcaatcaaattccacagtgttggtaggaatgaaatttcaaaggttgtttgttcttgaatccattgtattgtatattgattatttgattgaatggttgggagcagggtcagtttgcaagacggtggcatgcgcgaagggtggcatgcgcgaaggggatccgcatgccggcgaaggggttatcggtgtcaaggtgcgacattgtagcagacgcacgtcggtgacgtcgacagctgactgcgctgagtcaccacgaagcgtaaggattcatataccgctccttctcaaatggattgaaatatgaactatgaatattatctcaaaaaggcatcaatgtttgggatccaaaaaatactcaagtagtatataaattatttaataagggtaagagagcatagtaaggtaattgtgataaatgtatgacagatgatccatttatgtcgtggttggtagcagtggacgatctttaatgttgttcagttcggagttgatcaaaattccggctaagtcctgtcgaaatgttttcacttccttctgcataatgtaaagggagtgcattttaaatggtttttcgtattgggaagcagtggtgcaaaatatgaatagaggttgttgtagttacctgtagttgaatttttgggagataagatccggtccaatgctccatgaacttaagggtgtacaggccgcacgagacgctacaagaatttagtcgttaggctaaaatgtttccgtaattgaataatgtgaatatcacgtggaagagtttgagtcacccaccagtctccttgctttggcaatttttggactttgttgtagtcccattcggtaattttgaaatcaggccaatcgtgttttaactgtgggtgctgattctctgtcccgtgtaatcccctctcgatagctagcagctgggaagttttgtgcaacgttggtacggttaaaatatagcaaaaccgatttgaattatacaagtggaagtgtatcgcttaccacacgccttagatcgggtcgatctttactgattggctttgcgagcgaatctagtatttgcacctcacgtcgcttggcgttaagaacggctaggtaccagtgtgtatctttaatattaattgggaggaaaatctgcagatggtcaacagtaagattgagtcataaattgaaatccccattacatagatagcttaaataagtattaccatgtcaaatgctagatagtcgcgtgccatatctctaatccatcgtttatctcgaggttcgcttgcttcgatatgcgctccctctacatttagtagacctgttttaatggccatctctaggaaggccttgccatctcccctgattcctttctctttatagcggaggcattggatgtatgcatccatgacctgaatttgagtttagttgagttacataacaaatatagttataaaagaatagtaggcttgttaaataggcgaacttacatcatcattcaagaaagctggttgtgttagtactttcattcttatccgtttaacctccacttcttcaatatgcaccatcactttgttatcctccgtgttattaatgtaggtaatgaacgggtcttctttttcagtcaactctacgaaggtaggacaaattagtaatagatgtatagaaatgttaaatggttagtcattaccttctgaattttttaacgttgtttggccattcgtttttttcttcttttgacctcgtaaggcgttctttggtgggcctttgtctatgtttttttgggtaagatcttccttctcgatgtacactagaaaagggtaagtcaaatcagtaacacataaacatagaatataagtaaaaaattaaggatgatgtagagagttcatacattcggatatttcattcggtgtttgattgtcttgtttcctcttcttttcaccccgtaattcgtttgtgtctggcaaagggtaagtcaaatcagtaacacacaaatgtagattataagtaaaaaattaaggatgatgtagagagttcatacattcggatatttcattcggtgtttgattgtcttgtttcctcttcttttcatcccgtaattcatctgtgtctggcatgtaagcttctttattcgtttgcgcttgaaaaggagtaaagttagtaccattgacatgagcatatgtaactatgaaatagcatagtacctattgttttctttgtctgtgcttgggttttgattatgtcctttttaccccttgtttcgtagatgaagtcagtccgattagttggtttgtatgttcttcctgtaggacctgtaagcctcttcctgctttgattgctctggttacttctgtcctgttaggtaataaagtgcacgttagtattatgataagttgtagtaacgttagcgagagaaataaaattctgtttaccttcgtttcacaagtcatgtttacattttggtttatataggtctcttcgttatgatttgatacatgctccctgggatcaatttgttcttgttcaacatcctgcaaaagcatcaacctttttttagcggtgttatgtaagtaataatgattaacagtgtagcatatgatctttacctcaaacacatgcgtactatcttttcgatctgggcattttgaaccattttccatgcaatctagtatcaatgatcgcatacgtggccaaaaatcctttgtgaaatcgttgaaattatcttgtaaagtttggatgctttcttgtaacctttcttgtaaagtgatgtcggctgattgttcagtggatgttatagagtgtacctgcatagcacaagtgagaaaatgatgtcgaacatttttttgttaaatagagttcgtattaaaaccccataatatatacctcttcagaagtgccttcaaaatcttcattgctacgtgtttctgagtcattgtcctgcgctttttcttcggggatttcattgcaatgtatagttcccctaatgtcgttgacaacctatttttagtgaaaaaggtgtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgatggcagtccaagcaaacaatcaacatcatcgagtgtcatcgttacgaaggtaccattaatattgaatgctttcttctccttgtcgtagcttcttgcaatctcattgcacaagtttcggtcaatatgtatgttgtcaatctttagcaagttgccaagacctgaaccctcgatagcttccttttgacgtggacttagatggagtattacctcgtacatggcatgtggagagcaaactagagttccctgattaacagaaaagataataaaagtttagtccttgtgaaaatttatgcaagtgctcatatatacagcagccataaatcctaatggtgcactgtattgcacatcataaggtactaatccatattaattttcttaacatgagaaccaatgtgattgaagtgaacaccttattaccatttggggtcatataaatcataatgtactatattcttgctgatgtgataattatgcaagcatatattttttttgtactatatctttcttagtggggatgggcgtgggggtggggtgggggtttggctcgacagggatttctgaacatataggatgaaggtgttagtcaatataagagtgcgtaattggagacaaagcattaattggttcacgggaaaatcagggttaaggttgtaaatgctttttgagctttcatatggtgttttcttttcttgtgtctgtggaaggagctttcattggaaggtattagcaatgtaaatgtatttcatatttatctctgcaagattaataaaagattttatatactaaagtacagttgcaaaatgggtataatcatagtatacttctgtcctgtttttgcagttccctctagtatgtatgtgtggaacaatacgaagaatggtagctgaatccaaggatccagatctctcaaagttggagcttgtacatgtaccagggggagctttagcatttcaacttgctgccaagttctgttatgggagctttagcatttgtttcattcactacacaattggttctatatacgctctgttaggtgggaaaatcagctatatgttgggtaacaaaagtgtatggtgctgtagtaggagttatacctgacccctttaaactgttgcctgtattatcccatgtagcaggcccgtattttttgggacatctagccatggtgttttgtctgtgaggctgctacgtcctctaaacatttgatacagaaactagccagagctcaaaagaggcacgcaaattcatcacgaaagagactatcttcctaaataatctagacatatctgctatacttatcatagcaccttagatcggatgtattttttgcttgaggagtgtatgatttgcagtagtgatgtttacaagagctgagagtgaaaatttcatgtaaaaagacgtacaccctttttcttctgatggcttgtgccctgcatcataggagcagagtgtttatgcatgctcctaatgggggtgctcagaatttggcctcatgttgtacagaaaccgaatactgtctcatatatccgacatatatatatacatatatgtatatatatttaaatccatttaatttgctgcattacggtagggtccattgaacagaatgaatggtttcttgacaaggaatattccgaactcaatctttaatttgggcgg

SEQ ID NO: 57556 - DNA, 4437 bp, Oryza sativa
  unsure (1)..(4437): unsure at all n locations
gctgtgnaacggttagagctgtnnnnnnnnnnnnnnnnnnnnnnnnnnnnnnnnnnnnatatatatatatatatatatatatatatatatatatatatatatatatatatatatatatatatatatatatatatgtatgttacacctgggattagcttgttacgaaaaaatagaagatcaatatgatatacagttattagctattgtaaatccgcggctacgagaaacataaatttcggcagggaaaaataacagataattcggtttaaaaaagaacagataattcggcataaaaacatctgagcaaaattctgcaggaaaaaaaacagataattatgcatgaaaaaaattcagttagagtacggaaattctgttatacttctactacctaatctcagccgagttcggtagtattagttttaaaaacctcgtgagtttaaaacggaataaaaagatatcgttaatataacacaggataagttccgacaattttttatagttgtgcaaaataatccgttccgctatattatacgagcgatcgaccggaaatccatgtttttaaaaaaagcgaccgtccggacggtgcgatttaattttttatttgtccaaatttaatccgtgccgctataatatacgagctatcgaccagaaatccatgtttttaaaaaagcgaccctccggacggtgctacttaatccgttccgctatattatacgagctatcgaccggaaatatttgttttattaaaaatcgaccgtcccggacgtaatagttattttgtccgaattaatccgttccgctatattatacgagcgatcgactggaaatccatgtttttaaaaaagcgaaccggtccggacggtgcgacttaatcttttatgtgtccaaaattatcagttgcgctttaatacactagctatcgaccggaaatgcatgtttttaaaaaagcgaaccggtacggacgtgtaacaccctgaaaattcgaccggcaaaatcaaaactctaaaaatacggattttcaaaaactttttaaattaattgcatcatgccgatcttattcgtctattttatctggatttgatctcaaagattattaatcgtgagtaaagaatagttaattaggaataaaccttaaaaacaaattggtaaaataaatacaaaataaagattaggtgggatagaaataaataaaatattatcgcgaccatatttggatcaattaaatttaaatacgatggaataagaattaaccctaattaaaactcaaataaattacataaaaataaaatatgagtaatattaatctagggtgaattcattagttgagataatacacatattgagtaaacttcatttatgcaagatttagaaattatagaatcaaatttatatagaaaataaactaaaattgggaaaaataggaaaaaggcactattcattagcctctaggtgttcgacgaggctccctagccccttcccctcccctgccatgcgcgcctcgcgccccgagccgtcgccgtcgccgcctgccgccgtgccgctgtcacctgccgcgctgtcgccgtcaccgtcgcatccctcctcgtgccgcgtgccaccgctgccgccccgtcaccgcccgccccgtcaccgctgccgcgccgtccccatcgccatcccgctgccgctcgtgtatgtgcacttggtatttcagctatgaattcgtgtgtaccagactacttgatccagggaaatggtactgtttacacgattgattcctgttataaaaacgggggtctacaggacggtgcgacttaattttttatgtgtccaaaataatccgttgcgctgtaatatactagctatcgaccggaaatccatgttttctaaaaaatcgaaccggtccggacggtgcgatttaattttttatgtctccaaaataatccgtgcagctatattctatgtgcgctcgaccggaaatcattgttttctaaaaattcgaccgtctcggacgttatagtagttattatgaccgaaataatccgttgcgttttacagcgtgcaggtacatatatatccacagaaaacggaacaacgaaaacattggaatgctcaacttgagtcgtgcacggtcacatgttgatccggccggatgtagcggcaacaatacaaatagatatagattccaggaaaataggtatttgttattctgcttttcttgttgtctcgccagattagtttcaatcaagaaacttgccgatcgccagcagtctccggtgacgacgtcggcaacgacgcacccgacggggtctccgatcacgatgtcggcagcgacggacccgacggggtctccgatcacgacgtctgcagcgacgcacccgacgaggtctccgatgacgacgtcggcagtgaaccatccgacgggggattcttcagcggcacggtctagggccagtaagacttcgaaggatgatagcacttgcaccgtttcagatgaccccgtcgttacgggtgttatcgatgctttccaatctccaccgattcttcaaaaaactgcggtatttttgctcacattcctgttgtcatagatatttatttttaataactgtcattgtgtactccaattttttttttggtacatagtccgcacatctatatccatttttttaatcataaacttgtcaattatataacattgcaaatccatgtctaccacctctgtgttgtatccaccatattagccggaagctataatgacgtactgacaatatgaagcaaatgattgtgattgtttttttagtacgtgattttgtatacgggaataaatgaatgtttgttttctggttttgtgcatgaataataaattaatgtttttatttgttcaggtcactggattgcaaacacagattttgctttcactgggggacctttcgagccaaatttgtgaaacgcaaaagatgttgataaagatggcccatgataacactgaatttcaggaaaatatgaatgatagaatgacaaacgttgaacacattcaacagctacaattacagcaagtcacggtacattttctgaacatttatgtttgttttttccacatggcaaaatgctttgacacatatctttcttttgtgcaggatataacgcatggagaacaacattttccaaggaaaagatacatcgaggtcgagtatcctagcactataggaaagagggttcgaggagtcaatggtagggccgttgtaagtaacaagaaatttgattgttacaaaagatgcttggtagacggtaacgatgacttcgattttgtttgcactacggacgaaacacgcattgcgttgcgtatattgtgtgcaaagcctactgagacgataatccatattgatgacgtcgttttgacgaaggccgatttggtatgtcttgtacagacttatccgtatgacaattatgaaaaaaacattagcacaaaggtacgcctatgcactatttttgcaaaaagtaaagcaaaatcatctctaagtaatgcttcataaattgtattgttgatgcagatcattaaggcgtttgtcaagcattttggacaaagtagatcaattaaacgacataaacatatgtaccatgcctacttagagaccccgtcagttgtgtcaatgcttatcaagtatggctattatgatggtgttgagctaggaaacactgatgaaaatatgtacaaatccgctggagtcagctatgtgaataatgatatggtaaaatcataccttacaaatttgaattcattatattatttaactattttgtaaattgtattgatttgacatacagatttttctaccaataagaacttcaatagaccattggtacgtagcggttctggactgtaccagaaaggaggtgtgtgtccttgactcaatggacacgactgaagatgacttgaaagaacttaagtttctggtactttttccccataaagtgttagcattatcagtgcaaccaagtttgtagaatattaattatcacatatttatttcatgtagatgaaaggcatccgcaaatgtgtccgacttgtcctcgatgataaaatagtagagaaccctctgtgggacgattacaatgttcaagcttggaaaatcaggattagatataacttgcctaacaaaaaagacaggttagatatttacaaccctgagagatgactttgtaaaaaaattcatttcggaataattttacatctactcgtactcgtacaggacatccagtgggctttactcaatcaagttcatggagttatggacaggagattcgctaagcaaacaattttatcaggtatatatgttgtacaattagcacggaagcattcctatttatttcacttaaaactaataatattgtnnnnnnnnnnnnnnnnnnnnnnnnnnnnnnnnnnnnnnnnnnnnnagatgtcgaactcaagggcgg

SEQ ID NO: 57557 - DNA, 32158 bp, Oryza sativa
attcggcccatcgaccccgggggaggcaaaatagacttttgcggaggaatttgatttggaaggatttggattcgggattgaactcgacgatagatcggggatttgagatctgggatggcacggacactagacaacaagcaaagaaacaatttcgcaaatagagtttttatgagataattttcccgctaggcgccacgacggaacaggcgctacaacccctcgtcggcaagtggttcaccctttaaatgttttgagctacagttgataaatcgcagaaaaaataaatgaagcaatcaagaacaatttatgaatcctctaaataaattttgctaaaaaatcaagattggcaagtaggaaaaaacaagggtttgttgtgaatatggaatgggagagttggtctagacagttggatcagaagaataattgactgagatccatagcgagttctcttgcaaaagatcaacctcatcttttcacttatcttgggacggagggtggtacagtacacactggtcaccttaaagaaaatgcacatcagtaataattgttgatcacatgaaaacataagaaaggattggacaggtaaagtacaggttgtaatatgaattcaatactactttgtcctaaaaaaaacaatcctagctacgaccctgaacaagcatttgtccagattcgtagttaagattatgttttttataggacggaggggctactgctgaagccagaaccaaccattcaatcaggacgcaacaagtaacaaaacattaatcatcatccaccagtttacatgttgcatgtgcatatgagagaaacccacaaagagggccatgcagaggggctgattatatagcaccatctgcagggaagaaccatctcggatgtcgccactggtagtagacgccagagtgacgattaccacttaccaaacgcaccaacggcgttatcatctcgtttctcatgttgtagatgccagagtcgccaagaggatttgcagaataaggccggttgtagtcagatatgaagtagatgcagtcctcctgagctccacattccacagcagggacagacttggagccatgtgtgccaacaaagagagcttggcctcccaaagattctacccttctccacatgcgagagccattgctcaaatctgcctcatataccacaaatgaaagagtacgcggatcttcaaggacatcatcatgtgacagagggaatgggtaaccgaaaagccgaatcacctgcaacaatcttccaccagattcaactagatatcgccacagcatccggggatgactctcacgacaaggttggaaatgggattcggttaccggttcttctgccaagtcaaccatggaattaatgcatgaaacctctggttttccttcatggccctcactgatctcaaggatgtagagcttcccagaagcactcagtgcatacagctcccaccacagaaggcgatatcataggtctgttctcgagtgaaaaatcatgagatatgaatgaatcagtagcaatgggttgatagcaaatacaagcggcgctcacatgaagggggtcattgatcagcacagcgacaaggggaactggtgatgagtccaagggcaagggaactgcaaacttataggaaagtagagtatattcgttgcagagaagtataccagatccacggtaggcacgttccatcttatcatgccaaatgctggctagcttaggaagatgtaatgtaaccttggagaaaaggttcatcagtgagcacccaccattactatccctgaggaagagccagttgtcaatggagccatggcaagaggcatcatttggtaaaggcatgcggtgaattttaccatcagagatgctgaggaaggtcccatggaggagagtgagccaagggagtggaggggaacgggctgcaaccgagcattggagcgccatgggcgacagactgctcttagccgaacacgatcagctaaggagggaaggcgtccgaggacaagacccaggagctctggctggaggtctgcccaggatgaagaatgggtagcttccatcacgcaagacttgaaatctgaccttccaaaaatggaaaaaagaagggttcagaggtttacaagaaaaagaaagacactaagcgttgcactacttatacttgcgatacttggtaatagcatcagaagatagtgacatgtactaatatttaacaaggcacactaaactgtactagtcatttgctaaacaaactcaaggtccataactaaataaaaaggctgacctcacctgactgacatcttgcaagactgcaagtctaacacgacgagacaaaggtttcggattatgattaagcaagcactatttaaaactatgtattctggtcacacttgacaagaacatcaccagaaagcagtatctaacttttttcacaaatcaaaaggtaaatgcatctgcacttactcctttacccaaatctcaaggtagatgagtaaacataaataatgttttttttatttttgcaactaactagtatcatcagaaacatactagtgggtgatgacgtagtgaactagatacggactgatagtatactaaatccaatattaaaaaatgatatccacctatatgatttcgtagcaggaaacgctaaaacaaggggaacgtgcacatcggcactacacattgaaaatatgtacttctcttagatcttacatgctcctccataccagtttagatcaagcaaaaaaaatttggtccaaaaacatttataaacacatccaaatatccaatgggtaaatagtggtatatctccaaatgtgaatagtaatggtatttttttcaaaaccaataaatttataatgacaaggatccaattaacccttttctggggggttcaaccaagttgtagagaaagacattttctcatcgacattagtgccgcaattcaaaatgtttgtggatttaggccaaatgatctccgacagaaagccggcagctaatatcaaatcagcaacgaagggcacatgaatgtgggccatctagagcatcgattcgttgaacgaaattagggctagtgcagaggagctcacctgcttagaggcgatgacctgatgaacggtcggtgagagggggaggaagagcagggaaccgaccaccaactcgtcgccggcgggagatcgagcagcagcagccgctcgtgtccggctgcggggagcacaggctgtgcgcggttacgacgcggcggcgtcctctagaggaggcggcccggcgatgagaggtatccgctcgcttgggtggtctccggcaacgccgcaacggcaaggctcgccgtcgccggcgagcagagcaggcggcgatcgggaagtggaagatggcgtgggagccggaggaattggggtttttgcttcgattctgtgcggcgttattttttttatttattttttatacctttttggtctttcacctactcgcagtaatgagcaccccctgaagtaattagtgaagtgctgccagctactcccatgtttgttgatttattactagattattatataatgaattactatttaattataaatatatattaaatagtttaataaatactgtaaaataaatggtttaaacaatatgatagtaaaaaaaatgagaaaacattttttttaaaaaaaaacatgaagtaaataatcgatttgaactagctatccaatgaataatatgaaaagaacgaggtcgtagtataattctctgcataatataaaggatgaacgtattagactttatacaatttaatttaatagaattccctgtaaaaagaagtgttgaaatcatctgagtatattaatacgacgagacaataaaactttcaaacaaaaaaaaatgataagtacagaaaccttcaagacctactcccagtttatcgagctgtgtataaaatttaaaactgtaaaacatcgtcctatattgctgggctgatggcatgcaacacagcgacagcccgaaacaccctcaactccacatcgacacattttagagctgtcgctgccaaaccaccgagcaaacattattatcattattctcatttataatcaaacaggtcgagtttgaagcctgtgttgttcttgtcatcgatctacaatgcagccctctgctggctgaaagccaccggaatttatgtgaccaggttgatgccctcggcgaggagggagtcggcgagcacctggttcgccgcctccgacgggtggacggcgtcccagaacacgtacgtcgtcgcgttcgggcaggtgccgatcgacttggggttgcacagaagcaccgtcgtctccaccgtccctgtcccgcagcatcccctcctcgcctccgtgaatcctaccaccaccaaaaccatcatcaatggtgatgaatttttagcagggccggccaagataggccaaccaatcaatggtgatgaatcactgaatatgcacagttgcagtttgcattgatcatgcaagatgagatacagatttgcgtataagtttgttgttataccttgggattgaggagaggtgacgaggtcgtagaggggcgtgtagatgtcgaacacggcgatcttgaggtcggagtaggtcttcgaaagcgagtcgacggtgacgttcatcttgccgttgaagttctgggcgtcgctgttgagcctcgagacgcacccgctgctgccgtagccgaacagcgtgatcgccgccggtaggcagcccaacggcggcagcgacgtcacgccgatgcgccgtgctcccatgctgtacagttgctacaagaagcaaaggtcccaaagaaattttcacatcatctcaacaatccgtgttcagaaactatatctctaattatactatgagtctagtctatgactatctatgtcgatgaggaagctggttagttgcttactgccacggtgtttttgaagatgccgacgaggcggtcggagaactggtcggcggtctgggtcttgtagaggaaaggattgatgtagtaattctggacgaaatcgctggcaccggcgctgatgatgtacaatgagccgttgatgattgactgggcctggctgcttccggccacggctgccagcttagattggtactccttgaagtactccaattgttgggacaaaggaatagcatgctgcattacacagttttgtccaagttagttaagagatcatttacaccgccacatggatttgcaggtacaccgacgtccgaaaaatagcaatgatagagttcataatttatgaggcatgcatggaggatgtaactatgtattaacacgcagctgaaatatttcaattcagagcttctcttctccttttcaaggttattggtgatacttacatacagaagtgcagtgtggtcatagtagccagatcctgcagatgcaaagttggctccaatcagaaggttcttccctgacgcatctgggctgagatacgcaggtgcgtagctttcaaaccccaacgtctcggctgcaaccacaggaagtagcagaacaggatctctattagaaaatgcaactgcaactcacatatacattggaaagtaacaacatttagcaagagtgagaatgtgaccagtgatatcagtagccagcttgccgttgcagaacctccccgtgggtacctggttcttgaagtcccttccgtagggagggaagtttgccttgatgatggttttgaggtagtcattgttacctacgtccaccgatgagtcaccgaacgtcatgacggccggcacgagcggctgcgcttcaccaccatgtgttcctagcagaaggaagagagccaggagcagcaagcacttcacctccattggagctatccttggagtcttcttaggagtgtggctcgaaagagaagcgtgttctggtaagacagaacgctgtgagcttgtttatataagtgtgcctgcaaacatatatacacaaaatgagatgaaacgcactaattcagtagttaatgaagtttgttatgaaccccataactatactcatgagacaagctgtcctgataagaccagtaagcaactaacttaatcagtagtggggcctagttgtcatccaatgtagtagtataaatcttctttcggtgcaacctttggtgtagtgtgtggcatgacagtagcacattgttagtatagtacctcatcgtggcaatgtgccaaattcagtctccatgccctgctttgcatggttatccacattaattcttccatctgcaatggcgactatttattagattgataaggaaacaaggggcagttgaggtgctattgaggcacatcggcactagaagtgccaggaagaaggtgtaaaccccaacagctactaaacaaccactaatcagttattgcacatgttgtactaacacaatatatgcagttggaactcgagcattgggtcccaactggaaagatctttaacactggttataactgacatggtttttgacaatgtaagaaaaataaaaggagttgcaagacttgacaataaatatgcaaatctttcaagtgctgtgtgccagctagtaagacttatcatcattgaatgcaatgctgccactcgtttccttcaatgccagtacttccccacgaaaataagtactccaaataagataccccctccgtctcaaattacatgttatttagatttattctaagtcaaacatatatatctttgatctctattttttaagatatttatgtgatctaacaacatgtgaatcatatattataaaattatttctcatggtgaatctaaaaaaaatatatctcttatgataataaactatctgagtttataatgtgaattgatggttaaagactaaaatgtttgatttatgacaaatctagaatgataagtaatttggaacagaagttgtaccagaaactgagacagctcagataaaatattgtgggggaaagctagtaggaattcgatggtcaaaatattgataaaaatgtggcagtatatatatagcaataaaatattcttccaagattcttatgcttgtggattcttgggaggctgggaccaaagatgtatactacgtacctttcatgctgtttctgaacatggatcaagagcatacctaatataaaaggtggtgatttagacacataactgaattctgtacatgtcatgctttcaaaggttattgtccatttctctgattgagaattgaaaaatgaaaataggccagtgtgagactgagaaacacaaacagtttagagatggagcgtatgctatgaagtttgatcattagctaaaaaaaacttatgctgtggtcactgtttatttacgaatactgcaatggacatatgatcgctattatttttatgataaaaaaagggtgaatagtcaaagtggtcatccaagtttcatctgaggctcagtttagtccttgatatttcaatctatccatattagtccttcaagttttcattttagttcaaacttatccttgaaaaccaacaactctcttcataaataacacttatacccctcatcattcacatatataagagagaaattgcatgcttgaatttttttatagataatacatagtatattatgtaaaacgaaaaaaaattatgtactagcaagtgtatacgatagcaattgcttaagtttcatgtgcacatgtcgaaataatggaaagtagatctgtaatattgtttattcatgttggctttctcttttctagtatatagatgtatacaaattaagggcaaaaaggacattttctaatagaaatattgactataaatagccatatggcatattaagtggacccaaggatgatttcaagccaaaacaaatatttgaaggatctatgtggacaaaatgaaacgtgaaggaccaaattgagccttcgctgaaacttgagggactaaattatctattcacccataaaaaaacttataatcttacactaagaaaggaatataagatttgttaaaatatgtcaaaagaaagcagaactcggaattaatgcacaaaaaagaagtaaactagctattcataggaaaagaagaagtctggggaaagaagataacattaggggcaataaataaagctacataacttaagatattttattttcattcttaaatgttcagcaaccacatgccatgtaaaaacaattggaatattgtttagtgcttaacaaagcacaacattcaattgagatgggttctgaaagtgatgaaaatctcagaaaagaacctggactgtaaaagtgactctctgaatattaagtagatggagtttctttgaaaggaggaggatcatacttcaaaacaacatattacaaacacatttagatttgtaatgaatcttcagagaagcaacgagctgctatgtatcaaattaacatttttttcaagatacactcgctgttatgttagtatcaagaatggacccagtgtgactgattaatttggatgtctacgaaatatgttcaaggtcagatatgacaacaattgtacttacatagagagtgacaagtacgactcaaataacacaaaaaacacactttgccctacataatacagtgtatgtatgcatagcttcgattacctgattgtgtaaaaaataaaatcataatagcaagagtaaatcaaaaggtataatgaaaaacatgagcatttagattatcaccagtcaatcggtacacataaagcatgaggccatcataataccgtggaaaggactaccttttcgaacaatgctagtaacaacaaaatagttgcaaaattgggtaactagacattggccaagctgctaaagtcaattattcaatttattcaaaaggttgaattaacacattaagaagacgaacatacatgtctgaaacaaatgtctgcagattggattgaataatgaacttaccattgcaaggatatatggagaaaggacaatccttgtgtgtttagcatcaatactgactgcctacttcataagaatcattagtgttgcaagtttagtagacattatgtagtcatcacaaaaaatactacggcagtatggtcaggtagattttagtcacattttactgtgttgaaatcatgtaaaaatattccctacaaaaatgagagaatgttgaggaaatagtatgtgtgaaagctaatagtgaatgcaagaacggtaaaataaactaaagttatctttctctcagagtttcgaatgtttaaaacaggcctgcaaagagataccatggcacaatcacaggataacatacttcgaattctactgtttcataatttcatataagaataaaaacactagctttggaaacaattacagataacatatagaaaagctagagagtgatgagctggcattccatgatgaactgaggaaagaattgattggaccatgttgtacttagttccaccaatttcagttctagaagactatggggtatcaaatgggtaataatgtcaaatatacataccttacacaaatgcacaaaatctaaagagtgtactagcattcaacgattacgttcctttgtatctaatttacccagatttacataataaagaaaccattggccatagttgtcatatatgctacgctaaagagttaagatgtgtaataaaaatgtgcatgcaactgaggtttatcaggtaaagcagaaacaaatataaattcaagtggggttttagtcctaaatggaggaagagcattgatattaaaggataatgatacattactgtgtttattagcagcaaaattcagttggatgttatcatcaatgtattcagatttcagcaggaagtcagaaacaaccttttgattttttttttgtcacaaacagtacatataaatgttatgattcagaaacagaaattggaaaaatatgttaatcacagggtgaatatgatggtgatggttccgtttctttcattcatagcagcaaaaaagcacttgttcctatggcactgcttgaaacatgggaatttttcccgataccttgggaattaaattgttccgcataaaaaagtcttgtactccaaacagggtgaagaggatgagtttcattaggacagaacagttatgggaaacaatgacagtacaactaacacaatgaaacaaacaagaataaaggatacccttatcatgcaatattttaacagtaagagcattcagtggtcctagtcatcatttatatgctatggaattccaattggaagtacaagaataccccactcgtgcagatgcaattatcagttagatagaacatctatatggttattaaaagactctgtccatgacaagtccaaacaggactgagtaacttctgattagcatccaaaagaacagtcaaagaaatttgacatttaagacacagaatatgaaggataaacacgagcatgtgcctcaggttaagcctgcaatgttttactggttactgacaaagtgataattgcagcggcagcagcagcagcaaatagtatacgaccttctccaacacctaagttttctcttaaagatactccactgagtagccaagccaccatcagcattcagatacaggtttgccatgaaacagcaagctgtatcagtaatttgttctcagatgttgatcattacaaactctttctgtaaagttggtaaatgttccatccaaagccacagtaataatgatcaaatttgcatgtctttcgctgtcgatcttgatcatcatccaccaccaaaatttgtacaatcttaaaatggcccaagctcatgtacccagtttagcaaaagcaagcacaaggcttcacgcatgtttcacagcagcttctgtcgctgcgatctcctcccatgccgcgcccatggcaggaatggtggtaacatgagcccagtcaggtcccaaggccgcccaccaccttcctcctgccgcacaccaccggcatctcctccgcaatccatccaaccattggagccagcatccatctccaccttctgatcaccagcgattgactccgcctcgccgttgcgcggtgccgattgcgccttactaggtttggacgcggcggcacccctcccgcagcccggagggtacctccgcacggcggaggcgcggcgcacgagcaccacctcggtggtagcagcggggacctcgattccggccaccaacccattcccctcgccgtgatcgggcccctcggtcgcgaccgcgaggagcggctgccttgccagcttgggggatttcgtcgccgcgcgcgccgatgcgttcggaggtggtcggaggaggttggtggcggtggtggaggggccgggctgccccggtgggtgcgcagcgcggtggtcgcggccgcatcccggcgggtagcggcggacggcggaggcgcggtggccggcggcgagcatcggagcgtgggcggcggaggtggtcgggcggaaggaagtgcggacttaagtgaaatttcgaaccgaacgaacggaggattgcaggagaaggaacgtgaagcttgtactgtttcaatctctctcctgaaaacgcggaaccagttttgtgtttttattttaggttagttgtaaccatgtcattacagatatatctatttcagataaatattattatataattaatttatttgtagttgttgcactgaaattttataaaattaagatcgccactgccatcatgtttttcatcgatcttcttcattcttcgtcttctccctactatcttcctatcttcttgcattgcgacgggggcagtagcatgcgagcagcagtggcgacgattgccgacctaggggcttggctacttgctacccaacagcgggacaggtggcagatgacggtatagagaaggttagggccggatctagatagcgacgtgatggcgatgacctgggaacgcgaaggatgccaccagtagagggcagtcccatcccccctgtggtggtgttgggggtggttccctcgggtgaaagcgcggtggtcgagacgggtcccacagtgtcggcgacctccagatctaggtggtattgatgggaggcgcagagaacgacaggtggaggcgcaagacacgaaaggcgtgaagaactggcgttaacgacggggatccgagaaaactatacactttataaatgtgcttttttttttcttttgaggaacattggtaaatgcatgacaaaaaaatttctatataattttgtgctaatatgcattttccttgttttgtttaaaaagtcaaatttctacccgtcctaaggttttatgcagtataatatactccctccgtcctaaaatataacaactttttactataaaactaaaatgcttataatttgggacggaggtagtaacttttagcggtatactgtgctatagcatccccttatcttatgatcataatatgttcggcatgtacccaatgtaactttaaattaacattgacaattacttaaggagtgcacattagtctccattagcgtatgtatttttttctggttcctatggggatcaaatgatgtaggtgaaaaatgcttaaaaatcttatgaatttatggtttcttcttatataaaaaatctaataaaatattccactgttctccagtaaactaaagctgggccgtatcctgtattcatgtgggctttcttgcaacaataaacccaaatactccagtataggtttctaactctgcgtcgcacgcagcaagggccgaaggccgcatcttcgccgtccccaactccttccaccgcgacttcgccgccgtccacggtccgccctcgccgccgtcgatggccgatccctaccgcgcttacgcccctccctcctctctcggccgaggtacgtgtttgctcgctcacgccctccccgacccaggccgaccgggtctcttctgcgtggttcctgtgggggcgttcttgtgtcgattggacgaatcttcgaatgaatcgggagctcttgctgggttcctgttgttactgctttggatttatagattcagttcctgcaaggctcaattttgggtggctcagatggttttcttgtcagtttggtgcgcaatccgggtagttcagtgagttttacttcagttggtgcacactgcaaaggagggtaatgattcgcatcgtgtagctgaattaatagatttccatcatgttgtgagctctaatgtcattaggattcccgaccaaattagcaccactagtttctgattgctcctgattcgcagctgctaggttgatgtcttaatgaatggttggattgagtatatgctataatcttctgcgagaaattctgtgtgaatgttaaggaatcattgcgctggatataatccatctggatgcaatgtctgtgcttatgttgagctagacaaattacaactttttggcatcaattatggctcggggggtgccatgatgggagggttgggaacttgtgacttgtgaatttgatgttgtttagtttaagtgaacaaaagattcctttttcccagtattctaactggacatcttgctattttgaattttaataaaagggtaggacgtattgatgtaagatttcactgaattgggattttgttttgagggatcatgtggtgtacaattcacccacataaatctattgttgaattgaactagtgtacaaagaaactacctttgtggatacaagacacttctttccatatatgagcagttaagaacttttgatgatttggggaagaacggaatgcatggttgttatgcatagccttgaggaacactggtgtcaacggcggaccttcttttgtcgttggagtgggttggataaattgttgatgcattgttaaaagtatataagaatatctgaaaactatatagacagtttgaacatggggaggttgaatatagaagggattggttttcatttatttgaacttgtgtcatgtttttccttttgttttccttttcttgtttgttctgagattgataatgacacttatcattgcattgggaagttgaatatagaaaccttttatgttcatagcaattttattgtgtttgcagatccgcagggtgattttcctaggcatcctccatccgagggctcttattatgcttcaagaatggctgctctccatggaacatcagatatacttagacatgatgtaacgactttatttttagtggatttgatcgcaatataaaagtagccaccatgttgtcacacaacacgttgatttgatctacaggtaccattacagccaagagcttatggtttggatggtgcagcaggagcaagtcatcctgctttggctggtcttggtggactggctgctggaactacagctcgggggcctagtccactggaagacccagctttagtaaggagaagttcttctctaggaaaaactgctagtattccagatgttgagcatcccagaccccttctgaaccttgatggtccaagagaagatgaatccaacattctctttgttgatggtctccctactgattgcacaaggagagaagtggcccgtatccttcctacttagtgttcttatgctctgtgtttatatctctttcttagtttcctttcgtgagccttaacttcccatggaagatttgttccgtccttttgttggcttcaaggacatcagactagtgcataaggagccaagacatgtacgtgcttttccttttcaatgcatcaatttttttttcttagttgaaaaatatggttggacagttctccttttgaataactcacaagtctatgcgtgtatttgcattcacatcttggaactgagatatgttagaagtaccacatatattatagaatgcaatatatgcttttctgtccttaacatatataattcaggcagagctgctttttagcttaaaaaatatactggtatatagtatataatgcaatatatgtttctagccattacatgaattaatttaatcacaaaagtagcatatttagttagactatttatgtatttaagtgggtaagaaattacattgacttccacatgtacttttattgccgtcttttttccacgggccaacgtcagtagagctgttaacatttgtcgccatgttttccctaggcattatcttatttcctgtggtaatgaacctacagttgtttatgcttgttttgcatcacagatccccattccattcatcatttatctgttactgctgattctattagtgctagtttgaatttggatcaacactaacttttcatactgctgcttgcagagtagtgatagggcctatgttctatgctttgtggagttcagtgatgcaaaatgtgcaataactgctatggaggctctccaaggttattccggtgtcattgatttatcgcattgatattctcttgacagcttttcatatatcctggcagagtcggtttgctagtatgggattataatcatgttacattacatatagaattgaatggtgtcttgataattgatatgcatggtatccattggctttttttctttcagtagtatttcacagttcacagtgtctgttagattcttgtgacacactgatactaaccatatcttccttcaagagctgtagctatttaaacaataaggcagacagttcgctcatatttcatagcaaacctaaggatagtaggaatcaactttaaacctaaggctgtaacatgagcttttctttgttgcataagctgaatttttcagattattgattttgcagaataccgcttcgacgagaggaaacccgacgccgctgttcttaatatcaagtttgcaaggttccctttccggccggccgctgccccccatgatgatcggagacgccttaccttgcactgattagttcctaacttcctatcatccttagttagctgtgcccaacctgaccttatcattgcaacttgtaaatcttgtaccatctctgtcccataatacaagggatttagctcaatcctttatattctgtgatggaggtagtaacaacctgttgtcagtcgaaactggctagcaggaatcttgaacagcagcaaaacaaggaatgtacatttgtgggttcgaaacaccttcagattttttgctggtgccagttccagaaacaatgggatttgcttttctgcaggctaattactaatttggaatggaagatattttaaggatgttttgtaggaattgttccgattatcgtcaaaatcctataaaattcctgcgttccaaatgagcgaggatcctttatcgtaatgtcactactgttaccgtcactggtacgtaggtttcaccctttaaccccacacgtcaatgagtgttattgtgatagataatgtgaacccgttccaaaggagccgttaacgtcagcactgtgtcaattgctgtaagaacggcatcctgtccttttgagctgttgacgtgagacaggtttgacgttcaagtctccggtcctgcacaagaaaccaccaaaatgtgtcaggctcgttcatctggcggccgatctcgaattctcgatcaacatcgccgtcgagtctgggcgctcgtcgacgacggagaggtcagcgacgaccgtggagcgggggcggcgagaagctcctcctcctccgccgtcgctttcgccgctggaaactgccggcgaggtcacaggggcgatgtgctccgccgtcgctttcgcccgctggaagatgcttttgcccattttgcctgtggccggtgattgacgctgtttcttaccacggtgacgcttcgcgagtgaggtcattccaatattccatccacagttatgtcttaacacttgtcaaataaccaaaatttccaggaaaccaaacaagtttttttttctctggaaaactctaattacatatagatattattgcaaaaataagaattttcgtgtaaaacacttgcctgatcgtttgtcctataactgataagctgtaaaacgaaatataaaattatggcttatcagcaattaaaatataatttatggacaaaaatacacggttaaaaggttaatataaaaaaataaatcatgataaaaaaatcaaatcaactttgttcatttcttcgatcacgctataagctggatacaatttgccaaattgttaactgaaaagcacttatccaacacatgacatgacatgttcttggcatctcttacattatccttttttttcccactgtgacaagttcttttttttttcttttgatttctaaagctgatttgccattcttgcaatttgcaaaccactagtgccccgtgaacacatatatctgacgccgttttctgccgccaaattggatggcgcagcctttgcaatttgtcaggatagatagagagatttcacatcacattccctcgttgccacggtagtgagccgtcctgtagccggtggctgcaaaggctatttggattctagcactgtgctgttccatcatcaatttgtgtaagtgcactagcattactattctctgcatcccaatttactgcaaacgtagttttcactgtctattgtcagttttgtcacagtagatatggaatttatgctggaatactaatttagacgattgcggaaaacgatcaacaaatcatcctatagctattaaaaataaaagcattcatttaatttccaccatatttctctgtatttattagactgaacactacaattttagatgatatattgcgccttaatttacacaatactaggtgaaacattgctgtgggaatttagtatgataacaataaaaaaataacgtgtaagatagctagataacatcagattaagtaaattaatgtggtttatgataatttaaatttaaatagtatgtagaatggtgattcaaactaacaagtaaggtggtatgactttatggaagaagaaaaatagagagatagtttggaccgttgattaatcatctaaaggctaaaaacaattgatgtgatataacttaattagaggaaaaaaaggagaaatataatttggatcatagattaatcatttaagcactaactaagcgaggatgaactatataagtatataggatatcataaaacataataaagatatacattgaaacattatgtgaattatgttggatgataatttaacatgtttgtatttgaaaagctcttaaattataaaaactataaagatatagcatgtttgcacgatgtttaaatgtgatgattgttagtggataatgatgtggcatcttgttaattagtggatgatgatgtggcatcttgttagtagataatgatgttgcatctttgtatattaagcttaaagagttagtggaggataattttatagtaagataaaattccatctgtaacaactaacggtcttaacctgcctatgtaaataatacccgccatatttatccgtattttatttgacaaaatacttcagtacaattttagattatttcacccccaatattgggtgtacaactgtacatcgcaatagtgatggccctagatagtgttgcactatatgtgtgtctttcaaggcattgaccaaaacacacacgtgcccaagctgcaatttatctcaccatttcagattatgagaatcttcaattctcctagacagcaaagaaaaagcatatacaattttacatcaccattttcagattaggagaatcttcaatagacatcaaagaaaaagcatatgcaaattttacctcacaatttcagattaggagaatattcaaaagacagctaattagaaaaaaaaagagagttaaaaaaacccataataaaaaaagcaaaaggagactagtactagcaaggctagccagcccatggtgttcgactcgtctccatttcgcgtctcctcctcctcctcctccggccatctcaccctcccggcgagcagcgagcgggaggcctccgccaccgccgccgccgccgccgccgtcgccgcccgatggggaagccggggaagctagcgctgccctcgcacgagtcaaccatcggcaaattcctgtgatctcccgttccccccatctctctctctcccgcttttccgtgtcctctgctgctcgcatcacgcttgctgttgttgttggatgtgtgttgcttgtgctgattccggtggtgtttcgggggtttgggttttcgggctgcaggacgcagagcgggacgttcaaggacggcgatctgctcgtcaacaaggacggcctccgcatcgtctcgcagagcgaggaaggggaggtaaagtcaccagcggaaatgatatagtttcacctgtttggtattccgtttggcaatcgtaggagtgaactcgccatggttggatcttctcttgggttttgttgaggagatgaaggtgtgaattggatgatgggcgggtcgctagcggcgttcctggattcactctggagtgaattgttgttgagctctgattatattctggattggaatgtcatgcgtttggcaatcagggtgctgtttgcctgtttggtaatagggcagatgcatacgctaattttctacattaaaatgtgccaataatttgcaaccatttttatatggtagtgaagaaatcctgaaatagtttaattcacattttctaatccacagcgaactaggataggaaacagcatgcctttttatcttcattgtttcgatgagcgtcatacttatatagtggtttctcatgtggagtgtctagacactaactagtggtatctgcatatgcaataaattactgaaagcatatatgctgcatctggtagctctgttcctggtgctcacttatagtgtgagaatgttctttaatactatcattactttttgtactctccattcatttaatatgttcttttattttgtgtactcaccttctctctattggcatgctaaaattgttgcaggcccctcctatagaacctttagatcataatcagttgagtctagatgatctagacgcaatcaaagttatcggtaaaggtagtagtggaatcgtgcagttggttcgccacaaatggactggccagttttttgctctgaaggtattatatgaaagtacattctttgctttttatgatttcttccactctccccttaccagttttaactacaatctttttagtgttcccaatagttatagcttcatgtgagtccagtgttttttcatgtggtcttttgcctaacacttgcaaaggatctttagttctttacctccattgatatattattgcgtttacaggtaatacaactcaatatccaggagaatatacgcagacagattgcgcaggaattgaaaatcagcttgtcaacacagtgccaatatgttgttgcatgctgtcagtgtttttacgttaatggtgtcatttcaattgttttggagtatatggacagtggctctctctcagatttcctgaagacagttaaaaccattccagagccctaccttgctgcaatctgtaagcaggccagtgacatgtggtagaagctatcacacaatttctttgctttgcaaatgttacttaagcaccacatggactttataataaaaataaataaatctttcctgcgcaggtgctaaaaggactgatgtacttacatcatgagaagcacatcatacaccgagatctgaagccgtcaaatatattaataaatcatatgggtgaagtaaaaatatccgactttggtgttagtgccatcattgctagttcctcggcacaacgagatacatttactgggacatataactacatggcggtgcgtaaaagtttctgtgtcatgaaatgtatctctgattattgcatgaaatgctatctattttgtttgtcttgttgaaccaaagggaaattctgttcttgacagccagaaagaatcagtgggcaaaaacatggttatatgagtgatatctggagcttgggcctcgttatgctagaattggccactggtgaatttccatatcctcctcgtgaaagcttttatgaactccttgaagctgttgtcgaccacccaccaccttctgctccatcagaccagttttcagaggaattctgttcattcgtctctgcatggtaattgtacttctttgatgatttctcttatccacttacatttgcagtactagcaatttgttttaatttttagtttacaatcacgtgcttctaatatcccaagttggtgcctgttttatacattttacatgcaaaatttaagtgaaaaggtgactaccttcagagtgtgtttggtaccctgtatgtcattcagcctggcttgcatcagcagagcttgcccaaccagtcctgtgtagatgctgaaaattgacaagtttagttacatgcttttgcttagctaggccatgtagggagtttgtttggtttacagcatgtatacgtgcaaagcccaaaatatatctttggagccagtgcatgccagcaatttcgtgctctcaccagcaggccagcaggaaacggattctgaatacggaaaacgtttctatggggccatgcccatacctcactttggaatgcgcagggattggcccatccaatcacacagaaaaccaaacattggaactgttccagggaacaaatgcccccttactgccttggtatgcagattgtagggacccaattgatgcatggcgggattacacccaactaaatcatttattgtgtggcgtgttccatactccctccatacttataaaggaagtcgtttaggacaatatttaagtcaaaccttgagaatataaatcgtgaataactctcaagttgttgagtttgaaaatataaaaattatatgtatagatttgtcttgaaaaatactttcataaaagtatgcatatatcactttttaataaatatttttatagaaataagaagtcaaatttgtgttttggagaccgtgttgctttcctaaacgactttctttacgagtatggagggagtacttcttttcttgagatatttttgttactcttacatgtgaaccaaataggtctaatgtctttcaactcttcatattcatatggactttcaatgttaagaaggctgctaagttttataaagggaaataaataaataaacagggctaatacagttcctctgtctgttctgtgggttgcagtatccaaaagaatgcttcggataggtcatctgcacaaatcttattagtaagtgaaaattcttatccacgctgttctttttaaggcatcttttgcacaagtctagctcactgatcttgttgcgtcctccctctgctctttgatacccagaatcatccattcctgagcatgtatgacgacctgaatatagatcttgcttcgtacttcacaaccgatggatctccgcttgccaccttcaatacaagtaatgatgagcaacttgtcttttttctttgtttttgccatccattttgtcatagacacatgttagtgccattctttatgattccagtggatgaaccatcaagggaaccttacattcttttttttcgtaggcaaccgatatgatgacagatagtctgatgcaacactgcgtcatcatctagctcgaaggatgatcctttggctgtccatctgtagaatctaccatctacctaactggccccaaatgtttcgtgtattttttgggagaaaactttgccctgtgtactgagctgggattgatgtctttgatatgtaaatttcgcgtaatttcatatgtagaacaattctaggatcattgggcattgaagttttgtttggccgtgcaccaggatgatctgttcttgatcgctttacctttgtttctcacttctgtaactaaaacctatatttaccatttaccggattgttcatggcctcttctgggcaagtcggtgtcgactgaaagtctcaaacaattgcctcttcctacgacgactggtgtgtttcatgcaagtttcgtgatcttttgacaaggtgtgtgagcactgagcagccggtgcgaagcaaacggcacgaagttggccttgtcggctgaggcacgtttcccaaccgtgttcttatcgtgtcaggtcgccattctggattgcgagctcgtccgttcaaacatgaattacatactctatccgtcttaagataccaaattaggattagatgagacataacctataacaaatctgtatatgttttttataattttttttgagggagtcattgcctattcgcccgtggcatttttaaatacagtagttaactatctccacaagcttatgtaggccagtaacgtgggctgtatgggccggcagtatgggcccgtatttaattatagcccaaaagtatggatcgtttttggttataatttgctggattctgttcatacttttgctttatataaaaaaccgcaaataaataaataatgaaatgttaaattaaccgtccgggtttctccaacagccaaagaatttatagtcgaactcgaggcgccgtcttgtgaattgcttgatattgcttccacacgaaaggagattactgattactataaaataaacgcatgcagaaccagtgccatgatacaaaactaaatacgcgtgaagtcacgtttcgcacatacaatatccgatcgacatgatgatcgccggtgatggccgtggctggctgctgccgcagagcgtcatggccgtcgcctccgccgccgcgctggcgctggcgctgtggcggcagcagccgggaggcagaggcggcagcggcgggccggcggcgatcctcctcgccgcggcgccgtacgcactcctcctcctgctgctctggtgcctccgcgcgttcgagcgggcggccggcgccggcgacgcggccgcgcaggggaggctcaggctcgccgtgtggctgctcagcagcgcgctcaccgtcacgttcgccgccagggtcgcgccgctgatgcacggcgcggcggcggtcctcgtctgggccatgtcggcggcgaccatttgcggtggtttctacatgctcgatttgtttcctctccatcgtcgactagatagaatcaattgaagatttaacgtcattttatactttttttaatcagaatatctgtgaaaatttgatgaataatttgctttaaaaataatattatcggtttctgcgaagctgtatttaaaaatacaagcggaacacaaattttgacaatttgaccatttacaaaaccttatttcaaaaataaaccatgacctcagcgccatcggaattggtgctgagatccaacatctcagcgccactaattttggcgctaacctccgtccgagatgtcatgcattagccacatcatcaggggtcagcgccactaattttggccacttacaaaaacttattataagaataaaccgtgtcaaaaatttatttcaaaaataaaccacgactttagcatcatcggaattggcgccaactaatttttacgctaaccttcctccgaggtgtcatgcattagccacatcatcaggggtcaacgccactctcgttggcgctgacctctgtattggttaaaattttaacatccttttatccaattaagaaggtataaagtataatagctcagtggttgaggtggtactctcattggcgctgacctctatattggttaaagttttaacatccctttatccaattgagaaggtataatagctcagtggttgaggtgatactctcattgctttatccaaatagcttagtggttgaggtggtactctcattgctttatccaattgagaaggtataatagctcagtggttgaggtggtactctcattggctgacctctttacctttatccaattgagaaggtataatggctcagtggttgaaagcaaggtccaattgagaaggtataatggctcagtgattgaaagcaagttgaggtggtactctcattggctgacctctttacctttatccaattgagaaggtataatggctcagtggttgaaagcaaggtccatacctttatccaattgagaaggtataatggctcagtggttgaaagcaaggtccaattgagaaggtataatggctcagtgattgaaagcaaggtataatggctcagtggttgaaagcaaaggtctaaggccctgacctctgtattggttaaagttttaacatccctttatccaattgagaattcaaactttcaacttttccatcatatcaaaacttttctacacacacaaactttcaacttttccgtcatatcgttccaatttcaatcaaacttttaatttttgtgcgaactaaacacaccctaagattaaaacccactcatgtaacttttttcttatatttttccctaccaacggttatatgcccaaaatatttgcatacccaaggcttcgaacccaagacctagggctaaaaaccaaaggagctaaccacttcactaatagtacatttgaagtaggaatcaccattacaatcttttagtctttgcaaaggtcggcgccaatgagagtggtgctgaaccttgatgatgtggctaatatatgacacctcggacggaggttagtaccaaaattagtggcgctgagacgttggatctcagtgccaatttctatggtgctgatgtcgcgattcattttacggtttatttttataataattttttttaaaaaaagtcaaactgtcactatttcggagcggatagatgcacgaatccacctatgaaaataggtacgctggctgtatcacgaggaccttgtgatgaggctgacacgttcttcggtttttcctgatctgaggggtgacacgttcgatcagacctatgcctgccagccgggttcgatcagacccatgccgctcgggttcgatgcttttgctacaccaaggaaaaaaaggttatacgaaagccgggatgaacaaaataatataacgcccaatatttttgtttaggctgagaaatattctactcatcggtatatgagtagacaaatacagaagttgtaagaaacatatgaatgggtgaaagttttatttcttctcgatttaagtacagacggtagaaagtaagacgaaaagttagagtcttatttatagacggaggaggttgacggctttcgtagtaagctggcttacgccagaaggttacttctcccgcaatctggctttctcgacaagctaagcttgtttatggcgccacaagctttcttacgctatgagatatcttttggtataaattttttctccaacttaagatttcttttgaagtaaacttttcactctattataattcatacacatagatatatgttttataacagttaccatttaaaaccatctcattaaattattctaaaactaaaccttctttcctgatctttttagccacgaaagtggtgccgacgtggcaaaatcatgctgccatgccagcacacgtggtgtggtacggcgccacgctcgcggggttagccagcctgatccgcattgattctgatgcatcagctatatactacactagacatgtttgtacacgctacactatcgggagtgagccgagcaatcatgtactgagttacttacatccgtttcaaaataagtgcagtcatagatatccgtgttttatcgttttgaccatccatcttatttgaaaaatttataaaaaatattaaaaaaattagtcacacataaagtactattcatgttttatcatctaataacaataaaagtagtaatcataaaaaaaaatttcaaataaaacgagcggtcaaacgttgggcgtgaatagtgctaaaactatacttattttgggacggagggagtataagactttctagcattgtccatattcatataggtgttaataaatctacatacatatataccttagattcattaacatctatatgaatatgggcaatgctagaaagtcttataacctgaaacggaggtagtaataattactaggtggtgtttgaatctcctaaagataagatgaagataaagattaaatgtttcacgtaaaacgatgtggtaataatgtgtgattaattgagttttaattattacaaacttaaaaaatagattaatataatatttcagaacaactttcatatagaaatttttcgcacaaaacgcaccgtttagcagtttaaaaaacgtgctacaaaaatcttatcttcattcaacttttatcgaagaaaataacgggaccttaagacggttagatttaagttgttctgtacagatggatgacgactaaaaaaagttgaaacgaactagataacctattctcaccaaagttccatgttataaatcctttctattttgtactttagttttgaattattttgtcttactgttttgtttctaccggtcccgtactcttttcttcaacatcaagtttaacccgttaccatagtcttctctttatagtactcttattttcactggtggagaaactatctttcatcggtcggccgaattccacaatagtcccggatgcaataaaaatcagggctaaagatgatctttagtcccggttcaaaagagtaacgggcatatttgatctttagtcccggttggtaacacaccaaccgggactaaagatctttagtcccggttcgaatgctgtcagggtatgtcaggccccttcgggatctttagtcccggttggtgatctttagccccggttggtgctaccaactgggactaaagtcccacccatatatatatgtcttcttcctcctccagctgcccgagcaagcttcaaaatttcttcaaaaaagaggggaggtcatgccaaaatttttattgaatttattttggtgattacatacaaatcggaggtgcctaaaaggtttgcaacttcatcgtccaatgttttttttttgtcatactacatttgcacctatgttttgcacactttttttgtctccaaaatttagttgtaagttgatgagagagaaaatgtgtgtgggaaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtattaataaagatatcttataattattttatgactgtcattattgtaagaataattatttgtgtacgattttttttgactcatgtagatggatcggcaatggatgtatgctgaccggcggtccaaagagtttattgacggcgtgcactattttttgagagtggccgaaactaacaggcaaaggggttttatttgttgtccatgcaataagtgtaagaatcagaaggagtattctgcatccaggactattcatttccacttgtttgagtcagggttcatgccaagctataattgttggacatcccacggagagaaggtgttgaaatggaagaagatgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgatgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgcccatggttcgcagtggcgaaacatcgatagaaaatttaaagaatttggaaaggacgcacgaaacatacagtttggtttgagtacagatggcatgaatccttttggagagatgagtagcggccctagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtcccgtgtgggacgaggacaaacatgaggagtttaacctacgagcgctgctgttcgtaaccatcaacgattggcctgcatttagcaacctattcggacagtccaacaaggggtacaaggcttgcactcactgtatggataaacagaaagtacgtatcttaagcactgtaggaaggttgtatacatgggtcatcgtcgattccttgcagcaaaccacccggtatggaagaaaggcaagcacttcgaacataaggccgaccaccgtacgaagcctaaacatcacagcgggaaaacagtgtttgctatggttaaagatcttaaagtagtgtttggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaaacacgttgtatgatctgaagcatatggaacaacgcggcgaccttcacccggaaccaaaggagaaaggaagccattacttgagtccaggcagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttataataaggggtatccttccagacaatgtccgggcaacaataacaaagtatgtgcattcatgaacgcaatttcacagaaggtcatcgatccggatagattagaagcccttaagaatgaagtagtgcaatgtctcgttagttttgagttgatatttccaccttcatttttcaatataatgacgcatctactttgtcaccttgtgaaagagatccgtattctcgggcctgtgtacctacacaacatgtttcctttcgagaggtacatgggcgttctgaaaaagtatgttcgtaaccgtgctcgtccagaggcaagcatcgccaagggttatggaacagatgaggtcatcgaattttgcgtagaatttatcgaagaccttcgcccaatcggggtacctgaatcacgccatgaagggagactacggggaaagggaactctcggaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttcctagcgaggggaccgtctgggtcgatcgcgacattccagggatatgagatcaatgggtacacattctacacgagagcccaagacatgaagagcacgaaccaaaacaacgttgttcgtgtcgatgccatgggacacgatggaacaactgccacgtattatggtgccattgaggatatatgggaacttgactatggtcctctcaaggttcctctgttccggtgccaatgggttaggttgtctggtggagacgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagattgacgaggattacgatcagttggataggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccacgatgtaaactattttggatgtattgattatccatataaattaattgatgtatggcataatttattatcattcatatgctacatttaattgaatatcattcatatgctaattataattgactagagaatttttaaaagtattaaatcattcatgtggcatttacagatgttaattagagtttttcacaatttaatttattatctttcatatgctacttatatatgactattcgaatttttaaaaggtttaaatcatgcatgtggcatttacatatgttaattagagtttttaatatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaacctttgtactttaaataatgttaatgcattaacttctattttagaaacacatatgtaagcgaaaataatatgcagagctataatctttagtcccggttcttaaccctaaccgggtttaaaaagaatttggaaatagcgggaaaatatctttagccccggttgatga

SEQ ID NO: 57558 - DNA, 1641 bp, Oryza sativa
agacaaaattaacatgaacaccatataacagcttaaaccatcacgtaggctaaatataaatcacatagtgcatatcataattcatcaattaatttagcttgttttcttcacatccttttcaagagggtataagtcatttaatgacatgtaagtacgtaatatacttaggaagtgcaatatttatacatgtcattgtcagacaatcatatctcaacaatccattttgagatgctgataccaacgcaaccaaactgaagtactgaacatcgcatgagctgaacacgcaaacttctgatgaagtcaaaatcatgaactctaaaacacagttcagttgaacaggccggccactgacaatcgcatcagctactgacttcggagatgctgtgcagcgatgggcgccattgacgatgccgggagtgtgtcgccgagctgctccgttggccgtctatatcatgctacgcaaaccgcgataggatgggcagcagaagagtaatcagaattcagaacatggcactttgtcaaaatttaataaagtttaggagactttgcaatcaaatcaaattaaagataaacctaaattatgaaggctaaggtgttcaatactggaatgtcaagctaatgagattagatcttgccaaattacatgctattcctgacagggaaatgtagatggctagaagatgaataatggtcttttgcaggaactgaaaatccctttcttgtcgcaacaagacatttgatgtttattattatcacccataaactgtttcaagaattgtcggtgatttttttaaaatttaattcgtctgaagttttggaactgacaactaggttcgaggccttagtggagcacttcacttttctgaggcattcatagttcatacaacatgtggacactctgttcatgtaatcttggatatttaggaacatgacagtactaatgtaatcttggatatttaggaacatgacagtactattacttcaatctgaaaagttgatgtgacagaaaaaataaataaaaccaagatgttgacacaccataaagtaagcctataaatccaaacttatcactgctcacaagtttgtatgattgcaaagccttactactgccataggctcacattggaggaagtagttagcagatcgttctataatcatcacaggaaaaaggtttcctgaccaaactactagtgattaaaaagcttcccaagtccagcagccatatgcagttgtattgtaccttataacttacaagatctgattaaaaactgctgcaatgtttctgcacatatggaaacgcacgcctaactttcagaagagattttacctgatgcacacagcaaaatgatctgttcccatgcatgcagtcttgatggctatagaaaaggagtctgttcttcacctattgctaagattggagccactgaactggtagaaataggaaacagtcagcaaacgaaattgaaatggattcagaggagggtgtaactagaagaataccccccccccctccccaaacaaaaaaagttttcagtattaatggcacaagtaatcttgcgttcttgccatgatctggctcctgattacaagtctcttgtctgaacctgaattggtaccccagactatgttcaactaagactt

SEQ ID NO: 57559 - DNA, 4713 bp, Oryza sativa
  unsure (1)..(4713): unsure at all n locations
cgccgtgnnaacgtanagtcgtgtnnnnnnnnnnnnnnnnnnnnnnnnnnnnnnnnnnnnnnnatcatattttggtcatacgaactcccaatcgacccgttcaagtctcctaatgtttgttataacctaaagaaccctgggctttctttttatgtattggtattgcttctttataggcttgtagctttgcttgtgtgcttcgcgtagcttctgtcgttccggaggttcccgaagcgtggttcggggtcgtcgccgtaggttcggaaggccgttctctctgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccttattattgctattgttattattattaccttgttcaccctagattaaacaaaacctcaactagtgggtactctattcatggttccactagtatgaatttaggtagatgcttcgcggtttgaattagacaacattaggtggttttacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttgggaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggaggagctgggacccaggtcgggttgccagttcggtccgaatcatcgcaggccttgggttaaggcaggttcgtgagggttcacggccttgtttaataatactgtgtagctctaggatcgtctttacaaaatggctttgggtaactaagtggcttttaaatgctgtttactgcaaaacttaatccctatattattattcccttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccaggttgactgtaggataagccaagtggataaaacccaaggacatattttataaataaaaattatttgcgaaagttcatttttctccttcccctaatgctgtttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtcccaagctctggtctattctttccttgtaggcttcctctctcaacccctaccttgtgacagatggataacattggtaacaaaggctatgggaatgatggatccgatgactcaagaacccaagccaatgggaatgagaaaagcctcaacgaaacctcaccagagctaatccaaattgtggttaaccaaaccaacatgttggcaacagcctttcatctattacagaatcggaacatcccagcaggggcaaccaacgttcaagtacctacagtcccgcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccacaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgccactcgaaagtgagcataatcggatgacgaactgcaagagaaggattgtcaacatcccagtatttccaggtagtaaccaaagacagcgcactgagccacttcagatcaccggatcttctgttgtgcatcaagagttcctgccccaagaagatgaatgcaatgcagacatcaacactagcaatactaataatgatgacacctccaacaaccaaggttctggccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcacaatgatcatccccagatggacagctcagcaaagaagacgttgatttgttacaactgcaaagaaccaggtcatttctctagagattgtccacagccgaagcgtaacttgcgccatcactccggccattatgcaagaagaagacaggtcactcgccttgtggtcactggagcaaacgccgtacctgtgaggcctcatgttaattctaacccatagaggaaacaatgtaccgatgttaagcacctccctttttgtttaagacagtgccttgtattcatgtaatatgggagagatttgtaataaaaccaagttctaagaggattcttttggaagatgcggatatgtgatcatgtgtataattgtttactgacaaaggagactagggtctcgtgccagaggaactatattctaacctcgagctaataaccaacctgaggatggaaaagaaaatcaagcgattaccaaagagacatttgtggggattaagagtttcagatgtgtcttttcggatcaaagacaaagacagtcagtacagctttgggcaaaacacttgaaggtttcactgaaaggcagcagaccaaaggaccacatcgtcaccaaaagcatccacaactcttggagtgaagagtacttggttgacaaagttcaaaaggttattgatagaagataccagcaaaggtgtttattatcgggcaaagaagtaggtcgaaaggtgattgataagagaaatctgaaaagaacacatcaagggttaaatgtgtaaaggaatactttgaatgctaaatgatgacaacatgaagagaagattccatctgcaacagtggatcgagccaagcagtccagagtgaagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaattaaaattcattcgctaaaaggaataatagaattaattaaaattcgaaaaagaaattggcaaacattaaaatacgtacaagaaaaatttaaatgtggcccggagactttttgttaaattctccttggtctaaaaggagtcctcaaattttannnnnnnnnnnnnnnnnnnnnnnnnnttacaatgcgtctctccgtt

SEQ ID NO: 57560 - DNA, 5230 bp, Oryza sativa
gcatttatcctaatacatattttttgtatcggcagaaaagacgtgttgtcggagtcgtccctcaagccggagtggaagagctagccgtagaaggaattcgtgcaggcaagtgacgtaataatataaatgattgttatatttgtaatgcaattaagaatattagacttgtaattagacttagcatataattaagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttatttgtaattagacttagtatataattattgactacgaaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacaaatattgtacgatacaatcgcggagggaagcaaccagtactggaatgaagaagaggggaacgatgatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggttggcacatcataacggaagtggaagaagatggacgtcctagtgccccggccgaagccgccaagaactatgtacatcacagcggttgggttgtgcgggataacgtgcctgtcagtacggtgtactggtgaagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggatgagttcgttgcatataagacaggtgaacaagggcaggtgatgatggaaagaaacaaagaaaatgccgccaagaagaagtaccatcaccacttggggtcaggaggctatagcgtcgcgatgccgaagtgggaggagttggaggctagcttgattgagaggggtatcgaaccggcaaccgccaattggccggaacgatcgaagttttggtactatgctcacggtggaacgctcaacccagctgatggctcactggtcttcggtgatcagatacgagaggctgcgcgatgactaacagatgcagtggaagcctcctctcagggcacgttccaaccggacagagatagggacgagctgacactcgccctgcagactccagagcatccaggacgaacacgagggaaaggggtgattccttggaagattggtttcaaggaggacatccacacgtacaggagtcggatgaggagtaagagagataccgaggcgaagattgcagatctagagttctgggtatcgagctacgaacttagcatgcaagaggaggtggcaaggaaggttgatgaacgcatagccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcccaacggacccttcaggtacttaccactgcaggccgattccagcaggatactcaaaggtcgaagttgagttggtcgaaggcgcgtacgaggacctcgagctggattatcctggaggagatggtgagactcatctacgagacaaaagccatgccattattctatggcgtagacggtatatcatcctccctgggcgacaaacggcgtctcgtgcaccatctcctccggctccgccatctcctcctcaggatcctgcaccgtctcctcctcatgatccgccagcaccgtctccacctcaggctccagcaccgactcctcctcaggatcctgcaccgactcctcctcgggctcctacacctactcctccgcaagctcctcttccggcaccttcaaagtcaagggccgccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttctttaggggtatgtctgcatctgtcaaggaggccatcaagctatcgaactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgaccgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccctgtatataagtagactatagaaaataatatactcccttttatcgttatagaatggagattcaaagggcccgacggcggagggttttcgatactggattcatcaaccctcagagagtaaacgtcgcaatgctcgaccaatatccacaagaaacagaggacaatctcgtccatctcctgaaggcgcagcattacaagacgttcatactgttgccgtacaacacagagttagtttaattttacagtcttcctacataccaaatttcattcccgtacgaacttgctaagtgtttcatatgtaatgcatcccacgcacattgcagatgacactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactacgaatcatagctttaaactctatgtagggcttggtatcggttccgtcatttggtccgcggcaaatggagagaaagacttaggcggaagttcaaatttcctgtgagtacacatgctctacttttatatttctccgattcaaatacatagaagtgtatattaattagatctctcgttgtttgtcatttatttgtagtgcgcaaagcaaaagcagggaactaacttgtgcggctattacgtatgcgagtattgccactgtaacaccctgattttcgttcgggaataaaaatcaattaataatacattttatagaaattaaacaaaagttaaatcaacttaatcaagtgaattattgagggaattaaaaatttcctttaaaaattattggccgggaatattttgtaatattctttgtgccctaatgtactctccggaattttccatgaactttcggagctcgagaaatagttttaatagcacaaagatcattgcatcaattaaaataaaaagaaaacaaataaaatcctccttcctctctttgggcccctttcggcccaatccctcctttctctcccgcggcccgcgcgccccctttctctccctctcgggccggcctcctccctcggcccgctcggctctctctctccctcaagtccgttctgcctccccagccggcctctccctccctctctctccgacaggtgggacccgtggaccccacctgtcatccctttcctccagctccaactgccgccatggccgcctgagccaccccacgacgccgcttcctccgcgtgcctccacgctcccgcgcgcatgcagacgtggtccaccccacgtcctccccttcctccactttctcccccatttcccccccccaaaaatcggcgccgttcgagccccactcgcccacgtcgccggagctc

SEQ ID NO: 57561 - DNA, 33902 bp, Oryza sativa
cctttccccgcccctcgtcgccgcgtccttggtgagctcctcgtctccctccttgcctccctcctctgtctcccgtgcgcgctgccgcgccggtggccgccgccggtgaccacctggccgtgcgccgccgccccgctcgcctgggccacccggaccctccttgtcgcgccgcgtcgatctcgtgcgccgccgccgcccatgcgtgccgcctctcccgcgccgcccgtcggtcgccgtctccggagaccgcgctaccgccgcgccatggctcagctaggccggctttgtgccgtgctgtgccccagccgcgccgcccctggccgcccgatcggcttgggccgatccggaccatcggttctcgtggaccggtggtggaccgcctcggtggtcccggtccacggtggaccggcgcccttgtgccgctgaccggtggggcccgcttgccggcgccgcccctcccctttgatgacgtcagcaaccatcttttcctttggaaaaataaataataattgcgtcataattcgttaataattctagaaattcatttaaatggctcaaaacttctaaaattcatatctaattcattcgaactccgaattgagccgttcagcttgcaaaattcatctaaaattgagctctacatgtttgtttactttttatgtactgtttccttggtttttattagagtttttcctcgttttgcgtgccagcgtgtagttcccgtcgtttcggaagatcgcgttcgcagggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagacctttttagtatcagagtgagctgcgtgctcgagacatctagccatgcttcatggtcgtaattatccaactaaaatgcgactgaatggtgggctgtgggtgcatggttttgctagtcgcacccatgtcaattaaggaccggttcgcgggatgccctggaagaacttatcgtacttaccacaagccagcgtgggcaacggctgggcttgtagtgtagctttcctctagccgacgcatccaggcaagggtgggcgtgatggagcggggcgggccctgggacggcctctgtcgcttccggattcacctaggcacgagaggggactgcccgttgcccgctggggatgggggtgaaacctgaggtgtggtgtgcttggttagagggggttatgcgaagggtcctgtcacggcctctttccggtatgtcgtggtgacatgtcggcgcacggtaacgtgtcatggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctattcaacttggtgtagcgttgatcagtggagattcaatattactttaattactcaacagttttactgttttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagatcccagttgagttttgcctgtggagtggagctgaagccccgctaggatcgcctttttccgctgctgtcgttctgtttctgtgtgaggactaagtgcctcttccgtaagtattttacgctttatttacgtttggaactgtatattacttgtcattttgtgtaccctggctggtcctggacagggatttaatacgcaaaatagtctggaaatttgggttaaatttctgggcgtgacagccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcaagtactactactacgtcgaaatcgtagctagctaggacatataatggattgtaattaatacatgactacatatgtttctatatgcatgtgtacacattttctataatataaatatattttggtcatatatatatatatatatatacacacacacatatgcatttgcataacatatatatgtataaatacatatatattatgcatgtacatatgtactgaaccatatatatatatatgtatatgtatatatatatatatatatatatatacacacacacacacatgtacatatatgtatgtatgtatgtatgtatgtatgtacgtatgtatgcatgtatgtatgtattgaatcatatatatgcatggtttatatatatataaaaaggtcaactcgatctttagtcccgggactaaagatggctcagccggccacgtggctgaggcattaccaaccgggactaaagatagcgatctttagtcccggattggtactcccggtttggaaaccgggactaaagggggttacaaaccgggactacaaagggtttctccaccagtgtttcttagtcaactttgatgttctccgcctccataaactggctgtgtttagattggcccaaagtttaaaatttggttgaaattggagacaatgtgactgaaaagttgtgtgtataaaatgtttgatgtgatggaaagttggaagtttgaaaaaaaaactttggaactaaacacacccattggctaaaagggtgtagaaaaggctaaaaatgtcccaaagtaagggtgtgtttagttcacgctaaaattataagtttgtttgaaattggaacgatgtgatggaaaagttgaaagtttatgtgtataggaaagttttgatgtgatggaaaacttggaagtttaagaaaaagtttagaactaaacaaggcctaaaaacaccggctctataaattaacgagacaaagctttatttacaaaaaaaaccttaaactgaaattttacttaaaacaatttaccccgtaccctaaaatatttttgttttaaaaaaaattccgtgaaaccttaaaaaagggccttccttttttttaaaaaataatttttttagggtttttttgtcccgatttaaggatttgtggagaaaaacctagaatttgaaattcaattggaattgtcgctattccaccttataagctaacaaatgtgtgttagaaaaaaaaaccaagaactatactttgttttttcaatcctttgaaaagcccaagtcaaatcaggctagctctaaatgatcaattcctttcaaacaacactttcgtttttcaattatctattttattaagcacagattcccattatattactatattttcgtatctttatgtgcttgtctatgttccaaccttattctaaagaagccttcgtacgaaaacaatggagactataaaagatgttcacgtggaacaatcaaataaggtttgaaaagaagggatgaatttgtatgggacaaatttcttggagatggccgaattttcgttgcatgtatcaattttctgtccttacaatttttctataaacttaagtactcatactagtcaaataaaattatcgatattatgttcggttttccttcatacacttatcccatatacacttttcaattctaggtttttaacactattatccgatatccctactgccaaagtttcacccgttcatacacttatcccatataaaaatatttaatccctcatatccttgcaattaaaagaactgatacgtaaaaaaaaatggcaaaaaaacaaatgacaaaatacctctagagaaagaccgatttaacaagatccattgtaacccacgagcataaggcagtgtttgtcaactacttttctaactttttactatgtttttcgcacgtgcactttacaaactattaaactgtgtatttttttaaaaatgattttataaaaatttgttttaaaaatcatattaatatattttttaatttattttagctggtgcttatctaatcgatcgctccgttttgagtgctgcgaacgcagagactagacttttgaccaccgcgtgagtccaacccttcacggcgagggaaccatgacgaaaactagcgatcccctcctgaatcccccggcgccggcgagcaatcgcggcaacggcggcgtgcgccgcgtcccgtgggcgtccctgatcggcttcgtcgccctcgccatcaacttcgcgctctgcatctaccgcgcggaaggggatcgcggcgcgatcgcgtttgtcaccttcgcctatctcaacctgctgctcctcttctggtgcatccgccagttcgatcaggcgccgcacggatcggcggcgaggggccggatcagggccgccgtctggatcctcgccacatcgctcaccgccgtctttacatggaaggtggcggcgctgatgccgctccccgtcgccgccgtggcgtgggtcatggccgcggccaccgtggtcggtggattctacggcttcttcatccatgaggacaagtgatcgatcgatccatgatcggatgatcaaatcgcaaaatcggaaaagattactgctccattgggtctactgcttttatggcttcaggttgtatatcggtcaggttaattatgtggtggttgatatcgactcgatcgccggatgcactgtgagagtgttgcatatcataaataaatgaagtctggtgctatatgcattacaacatgatttgtttggtcttacttgtatatgtatgtgttgatttcacctggacatttcaaggtctatctcacattttctcctcgattgcattacagggggaaaaagtgcaggacaagaacatacgtctaatgtttatatggtttcaggttgagccggcctcgatcgtttctctgatgcttgctgatcataagtaaataaattgagtctatacatcaatggtactggtgctatgtgcattacaacatcatgctatttctcttaatttatttgtattacttgtatatattgctcattgcaaccagaaatttcagtctctcgatatcattttcacctagatttcagaggggaaagtggagggtctgatgagctagcagcagagtggcaggggcagtgaacatagttcatgtcctgaagacactaacgaacagagattcttgagcatttcctcacttatagcattacattttcaacccaaggatttggacggttttgacattcaggtatatatgtgctgccattgtgtcgatatcatcttttttactgaccttggatacgacggtgtggtggttcaacaactttggtagggttttgagcagcagaagtcagtagatgtcatgatagttagctagggagattagaaaaatttttttttaaccttttcccggtgatagtcggttcaacggtgtgcagccatctaagacaagaaagagcatccaaaggatttctatcgtacatcactcttttttttaaaaaaaaaaggtagaaaaggctgaagttctgatccatttcatcgataaagaagagatacgcatcgttccaagaaaatgttcagccccaaaacaccatcatttctatcatgcatctacaaatcttatgttgtttcttactctagatgtttcaaacaatcaatgctgcttgcacaagaacacaattcaccaatcaccatgctgtgatataaggaatgcaacagaaagacaaaaggtgaccacacctctttccattctttgtgcactgaacgatcatgtctatcaactatcaggccttgtttcgtttacgcctagattcaatccgagccgggaatgacaagtataataaaaaatttataatagatacaataagagaccgggatttattctgggccggaaaccaatttagtcatgataggtacaacagaatatccggattagttccacacctcttaactagtggattgattcccggtctcttattgtccctatcataagtaaattgattatcagtccagaataaatcctggtttcttattgtatctatcataaatttcttgctacacttcatttctggtccggattgaatccgggtgtaaccgaacaaggcctcaaggtaggaacaaagctgtatgctgctttctgtggccgttgcggcagcagctgcatgtgttgcagcttccaatgacttgcatatgggctggctttcatgtcaggtttccaactgggcaaagtagaattagtcatatgatccggccggcgatatgatcagcactagctagctgcctgtttccagcgaagctaacgatagtatcgatcgatgatcccagagtcgtgcagaacaaagctggatgcacaaagtagatgattattccaaagggctggctcacatcgagcttttagttagctgtgtccaatcaaatgatcctgcggcttcttgctcctagctgtgaaagacgtactccatgttaagttgcagaatcttcagtggaaatgcacgtcgtgacagctaatttttaataattttttgtttcaacattttcacaaacaaaactaaggccctttttaatttttttctgacagaaatagaattgtgttatgtggaaatacgaactctacgtttttggcgtacgattcacacaataagatatatattttacagtccataaaaaagtatctatagactatactagatactaaaatttgagagatctatatgacactactaaattttacactataaaatataatactaatacatgtcagtatcttattaaagatggtataattatctgcttataatacctacaacaacaacaagcgttgtcatggaaggacaacacgagtagtctctacaacgttcatgtgcaaaggtggcatgtactagcccattacaaggagcagccaatttcaacgtggccatagccattcgtaaaatatataagtaactattagcgtgattaagctcgtccgaacaaacgttgttaatcaggtatcatccaattatttatcacatattaatcctgcgaacggtgtcatgttttcctccctgtacgtgtgcttaaatatgggccgctaattatcggtcgcatgcatggatacgtcgccatttgcatctgttgcgaaataagtagagtaatgcggagtgggacatgctcaaccggtcaggtggttttcttgggtacagactgaagagacagcgacagccctccgtcccattattttaagtgtagctatgttttcatactaaaattctatcgtccgtcttatttataatttcttttaaaaaaattaaaaatataagtcatgtataaagaactattcatattttatcatctcataacaacaaaaacactaattataaaagaaatttaaataagacggacgatcaaaattggacacggaaactcatggttgcagttaaaatgggacgaagggagtacttctaagcaagtagtaataggagtaatcgtcccataaaaaacaaatctagcacgggatatgatattgcaaatttaaatactacactcacttcgtcccataaaaattaaacataacacatgatatgatacgtctcagtactatgaatttgaatagaatactatccagattcgtagtacgtcacataccatactagattaaaaaatcgtcccataaaaattaaacataacacatgatatgatacgtctcagtactatgaatttgaatagaatactatccagattcgtagtacgtcacataccatactagattaaaaaatcgtcccataaaaattaaacataacacatgatatgatacgtctcagtactatgaatttgaatagaatactatccagattcgtagtacgtcacataccatactagattttttttaatgaagagagtaatactattatgttactgtcatcctgcttaaaatgtatgtgccgttgcatataaattacatcctccgtttaaaaaaaccaacttcaaaaaacacaaactaaatatgcttattatctcaagaaatttggtttttttttgacagagaaaatgtctgtacggattgacttgtaaatcacgccctctgtctaaacaaattgagagcatgaatctagaaagatggaattataaaggtttggtttaggacggagggttttttttaaagatagagggagtaaactagataacttattaatcagtgcttactcagtggactaggtaggtcgatctcaaatgttattatttactttctacggtctttttaattccttataattcagaacatgggcataggtctatggtcccgttcttagtagctcattgatttccccgcacaattttatacgtgttagttaaattagatttgttatacaactcttagcttatactatacgccgttaacttttaacatgattttgatcattcatcttattaaaaaaatatcatttatttttttacttattttatcattaaagaaactataatctcaacatattcttttcacatattcatttatattaaactttttatactaccccaggagtttggcctcacagttttttattttttttcatattcacttaaatgtgggccctacttctaatttgtgattaggctagcgcatcagcacaagtggaccaaatcaatgtgccacatcagcaaaaaccactcttaaaactgttaatggagccaaattgcatcgattttaatatcacgattaggagatacaaataatatatacctatattatttgggggagtaaatgtggacttagtccttccagcattgatctgctaacagcccacatgattgcggagaccggtatgggagacgaaaccgcgtgatctggtctgagggttcgactgttcgagtcggttcgaggcccaggagcattggtagtagtactacgtataagcaacgtcagtgaatgcgtcagtacctcaaggtggataagctataagaagtagtcgaagacgaaattaagtactactactacaattaatacattttgtgtaacatttgtacatgtacaatggtttatgtatatataaagtaaagctagatatgtatatatacatgtgtagaaagaaccaaacatttgcaatatccaatagctagcagccagtacgtaacgatatttacacaggaattaactgttccattgcttcagcatgtcgatcgatcgatcgatcattttcagtctacgccgggatgatgaaggaacaaggcgtagaatcccccaagaacagttgaggcggccatcacccaaataatcgcatccaccggccacggcatgagcgcggaaaccctccacgagaacaccgcggcgagcagcgccgtgacgacccatacgccggccttggcgccgcccctcgccggcgaattccgcggcgccgcctcgaagcggcggaggaacacgaagagcagcacaaggctgaggtacgacacgacgatgaacgacgtctcggtgatttctccgtgtgacctgtggatcgcagcgatcgagcttgctgtgaggaggataaacccgatgcaggtcgtagcagcttctgatgccatgaaacggatcggagtaaagagtgacgtcgtctggacgtccgatatattatatagccggcgacaaatactggaaatgggatcatggtttgttagcatgcatttataggccgcgcttgcctgcgcgtcgggttgaagttaggtcggtgcatgtatggccgagtttagtttcaaactcccaacttttccatcatatcaaaacttttctacacacacaaacttctactttttcatcacatcgctccaatttcaatcaaattttcaattttagcgtgaatgaaacacacttgattctcaagcttacggtggtcatcagtatgatatgattaacgagtggatgtatatcgatacgcatgacgaggtaatgatcctttttgaacggaacgaggtaattaatgattgttggttctcaagcttactgttgtcatctgtatattctgtagcagtataccatgtaaaagatttagtcttatgataatttctcacactatcattataacaaactgaaatatatatatgttgctaatattcctataaacttataattttattactatagttacagttttctaaagtttactctttaaaaaatacagtatatatgtcggtttcccggtgcactacggccccattagtaatttactcgtcggttcgtacggccctattagcatgtatgtccgccgttcgtttggcccactaacagcatattaaacatgtggataggatcttcagtgagggccagcacaacacggaccattaatcaatggcggttccgggtaacacgctgagtcaacgcgggatcagcgaccgacgatttggtcacgcgctccaagctacgtaaccatatgattacagttattctttacttctaacgtaggctgtgcttagcttgggggtctgatcggtcccgcccccatagacactcctcccacttctcccctttctcctccccttcttctcctcctattatagtacaccaaaaaaaaaattaaaaaacaaaaagttagaaaaatttatgtataaaaaatttgaattcaaattcaaatttaaatcgggtatgtaaacttttgacttataaactttgaatctataaactttaggtgtataaactttagatatatagaaatactatatatagaaaatatttgaattatttgaattcaaattcaaatttgaatcagatataattcaaattcaaatttgaatcgggtatataaactttaggtgtataaactttagatgtgtagaaatactatatatgaaaaatatttgaatttaaattcaaatttgaatcagatataattcaaattcaaacttgaatcggatatataaactttaggtttttaaatttaggtgtataaactttagatgtataaaaatactatatattaaaaatatttgaattcaaatttaaatttgaatcggatatataaacttttggtctctaaactttagatgtgtaaatttgagatgtataaactttaggtgcataaatttactaaaataggaaagtaatacggtgccaaaaaaggaaaccaggtagagggagggagggggaggagggttcccgtgcttagttcccttcaaacttctaacgttttcgtcatatcaaatgtttgaatacatgtatggagcattaaatatagatgaaaaaaaccaattgcacagtttgtatgtaaattgcgagatgaatattttgcgcctaattacgccaagatttgacaatgtggtattatatcatgatttgacaatgtggtgctacagtaaatatttgctaataacggattaactaggcttaatagatttgtctcgcagtttacaagcgaaatctgtaatttgttttgttattagtttacgtttaatactttaaatgtacgtgtgtatacgttaattttttttcgaaaacaactaaacacggccataatcaaaagaaaattatatttattttatttttgacaataaacattactaatatcactagtacagtaggaatcctcttctcatacatttctcaccaagtacagtacacgccacacgtcactgctaatttaattgtcaccgcaagcttcatgcatttcagcaattttgaagccgcggcgatgctgcatgcagtaattttggggcgcacagaaataaatcactggcacgaacaaattaaatggtcatcccgcgcgccgtgtgcttgcccggcgcgatcgatggagaggcgccgtatcaaattagcaaattaattagcaggagtaccgaattaatttcaacatggcaaaggttaactagctgtactgtttacataattaatcatcaagaaactactcctagcaagcattgcttttacatgaagcacggagggggagataatgccaaacatgagtagcggccgcgttgagcagttgagcacgcctacgcaactatttggatatatatacattgggacgtgttgactgagcagtgagcacaaagagtcacggcaacgcttgacctgttgagtacggatggtctccctggctagatgatcatcagggtgttttccttgtaattatcttatggataagtaccagagttgaaaactcttacacaagagtacaagacatgtcattcttcagagcctatcccctcacaacggctgagtatacaacacaactcttaaccattaatccatcacaatattttttttattacccttcttacgagaaagcaaaattcctttatgaaaggtaataaatgattttaaatttaacattgatgttttttctttcctctcccctcgctctctcatgttatcaaatttgtcttgttagttagtaaagctacgagcatttgattaaaaattgtggtacatgtcctaagtgagacgtttcatgtcaaccccttattgttttgtagtgcggtggagagactgaaatgagctcgaggaaatcgaaaagaaaacacaggaacgaggaaatagacacgacgtcagattacagtctccagagaactcgctttgatggacgataggatagacatgctgatatggccaccatgatcaaataatgtatcaaaattatgggagacttgtatctatgagagcatctagactctagtttccttttccacatctttatctgtcaaattttgatttcgaaccatctgatcttagtctaatggttacattactactactccctccctctctagacccttttatccctctccaacctcaccatcttttccaaactattcaaattagtcatatctaaactgcactatactagaaccggagatacactggtgacgtctttttttccctcagaaccaacattcctctacctttgacaccctttccatcatcgcaagcatgatgaccctcctgttagaataattgggctaggctcgatttatcctattaaaatctcaaaggcccataataagtgtgataataataccaccttaggatttaagcgaggactatctcaacctaaatagggagttattggagactccctgttgaccggttgaggtgggagtcggaaagccacacgcgtgcgcgccgggccgaggccgtggccgtggctggcgtcacgtcacgtcgctattcttttgcaaccacgatcccacgttcccacgactgaacgatcacaacgattcgcttgcttctttcccgggtgttagttcttcctcctccgcgcttgtgctgttctcgcttctgatcgcttgcgcgcacgagcacaccttcgcctgagatctgcaccgggtaggcgggtgatcaggtttttggggagtgcttctcacacgactgctcgtccaccatgtctgcgcctggagccggagcttccgatggtgcgcctggagctggagccggagatggtgcgcctggagctgcgaacgtcaacaccaacggaggcaattttgcctcacaatccagcggagggccattctcggggtatatccttctcctgctgttaactcattcgttcatagcgctgttagtcctgttagtcgcaagtcaattgcgttcttgcttatgatacctttagcatgctactggttatgctacatgttgtcactagatcaccccacactgtttatgccatgattattgtcttaacattttggattaaaatatgccgatatatgaccatatttccaacactccaaaaacctgataggtcattttcggtagttggctttgctgctgcactgaaaccacatgcttttgatggttctaactataagagatggaaagcacgtgcactattgtggttgacagcgatgtaatgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttccgggaaggacatgtgggatgcacttgaggccaaattcggagtttccgacgccggcagtgagctgtatgtcatggagcagttctatgactacaagatggtcgatgaccgttctgtagtagaacaaactcatgagattcggatgctggctaaggaacttgagaacaacaactatgagttgccggacaagtttgtggcaggtggcattattgccaaattgccaccttcttggtcagactttgccacttctctaaagcacaagagacaagagttcagtgtttctgatttcattggctctttgggtgttgaggagaaggcgagggcaaaggacgtccggggcaaaaaggttgagggaggttctagtgccaatatggtacagaagaagaaccctcatgcatcccacaataacaagaaagtcaagcatgatgtcaaacccaaggctgcaaccaactttaagaagaaaggcaagggaaaggcaaagggagactgctttgtgtgtggcaagtctgggcattgggccaaggactgtcctgagcgcaaagacaagaagtctgccaacatggtcattagcgagggaggaggaatatcggggtacggtaaaatattacctacagttctctttgtttttcactcacctgattggtgggtggatactagtgctaatattcatgtatgtgctgacatttctctgttttcttcttatcaggtcgggagaggttcctccttgttgatgggaaacgggtcgcttgcggctgttcatggtgttggtatggtcgatctgaagtttacttcgggaaagaccgtgcagctgaagaacgtgcagcatgtcccttcaataaagaagaatcttgttagcggctctctactgtgtagagaaggttttagacttgtgtttaaatccaataaatgtgtcgtatctaaatatgggacttttgttggaaaaggttatgacagcggaggcttgttccgcttttctttgaatgacatgtgtaataatcataatgttgtgaaccatattagcgagaatgatgagtctaatgtgtggcattcacgactctgtcatgtgaatttcggttgtatgacgcgcttagctaacatgagtttaattccaaaattcactttggtgaaaggttctaagtgccatacttgtgttcaatcgaaacaacctctcaagcctcacaaggcatctgaggcgaggaatttggcacctcttgaacttgttcattccaatttgtgcgaaatgaatggcgtgttgactaaagggggaaagaaatatttcatgacaccgatagatgattgcactaggttttgctgtgtgtatctattgaaaacaaaggatgaagcattgcatttctttaagacctataaagctgaggtagaaaaccaacttgaaaggaaaatcaaacggttgaggtctgatagaggtggggagtatttttccaatgaattttcatccttttgcgaagagtttggaattattcatgagaggacgcctccctattcaccccaatcaaatggggtggccgaaagaaagaatcgtactctaactgagatggtgaatgccatgttagacattgtagagctttccaaggaatggtggggtaaggcagttttgactgcatgtcatgtcctgaataaaattccaatgaagcataaggaagtaacaccattcgaggaatgagaaaggaagaaattaaatctctcatacctacgaacatggggctgtttggccaaggtaaatgtacctatagccaaaaagtggaaacttggaccaaatactgttgattgtgtgttccttggttatgctattcacagtgtgggttatagattcttaatagtaaactctggagtacccggcatgcatcttggtacaattattgagtgtagagatgctacattctttgagaatgaatttcccatgaaacatacacctagcacctctagtcaagaaactgtcatgccccatgagcactttgcaccgatagaacacaatgatcaaacgcctgaggaaaatcctgaggaggacaacattgtagatactcgtaagagtaagagacaaagggttgcaaaatcctttggagatgactacattgtatacctcgatccacaccccaagaaccatagaagaggcatattcatctcctgacgctgactactggaaggaagcagtacgcagtgaaatggactcgattatgtctaatggtacttgggaagtcattgagcatccatatgggtgcaagcccgtaggatgcaaatgggttttcaagaaaaagcttaggcttgatggtacaattgaaaagtacaaggcaaggcttgtggcaagggttatacccaaaaggaaggcgaggactttttttgacacatactcaccagttgctcgcttgaccacgattcgagtactacttgctctggcagcctctcatggtcttctcgtccatcagatggacgttaagacagctttcgtaaacagagagctggaggaggagatctatatggatcaaccatacggatatgtactagaaggtcaggagggaatggtgtgtaaactgttgaaatccttgtatggcctaaagcaagctcctaagcaatgtcatgagaagtttgacaccacgcttacatctgcaggctttgttgtgaacgaaactgacaaatgtgtgtactatcactatagtgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaacattaaactacaaagaggagatgagggtgggattacacttgtgcaatcgcactatgtggacaaggttttgagtcgctttggatatagtgactgcaagccagctcctactccttatgatcccagcgtgctattaagaaaaaaccgaagaatagcaagggatcaactgagatactctcaaatcattggttcattgatgtacttggctagtgcaacgaggccagacatctcatttgctgtaagcaagctgagccggtttgtctcaaatccaggagatgatcattggcaggctctggaaagagtaatgcgctatctaaagggcactgtgagctatgggattcactataccgggtatccaaaagtactagaagggtatagtgactcaaactggatatctgatgctgatgagataaaagccacaggtggatatgtgttcacacttggaggtggcgctgtttcctggaagtcttgcaagcagaccatcttaacgaggtcaacaatggaagcataacttatagcattagatactgcgacagttgaggccgagtggcttcgtgaactcctgatggatttgccggtgcttgaaaaaccagtgccagctatcctaatgaactgtgataatcaaacagtgattattaaaatgaacagttcaaaggacaacatgaagtcatctaggcatatcaagagaagactgaaatctgtcagaaagcagaaaaactccggagtgatagcattggactatgtccaaacggctagaaatctggcagatcagtttaccaagaggctaccacgtaatgtgatagacagtgcatcgagggaaatgggcttgatacccacctaaggttgcacaatagtggaaacctgtccattgtgatcggagatcccgtgaatttggatggcgaaacaaactattgtgtgactgagagaagagacccttgaaaagggctcattttcatgatgtacttctcttctttcctgcatggtaggatggctcatgccttaatgtgatccgagtggcttttccaagcagagatgttgacctgcagaacatctcagaagtaacacacctatatgagttcgactgctagtcacagtctatgaggtttgggcgatctctagatactcatgaaaggcctggagtttgacttatatgctccaaacaaaggggatgcaaacggcagcccagtaccagtcaagggtttgagtgaaacctgatcacacaaaactgacaattcaaggcatagtccattgttcagttgtggtctgatgtagctcatttcctagttggaagttcaacttaacagtctccaccaaaacactggtatatcaaacaagcacaaccttgagaacatttcttatgagccttgaagtttggtggggattgttagaataattgggctaggcctgatttatcctattaaaatctcaaaggcccataataagtgttaaggataatagtaccacctcaggatttaagcgaggagtatctcaacctaaatagggagttattggaggctccctgttgaccggttgaggtgggagtcggaaagccacacgcgcgcgcgcgccgggccgaggccgaggccgaggccgagggcgtgggcgaggcgaggcgtggctagttggctggctggctggcgtgcgtcacgtcacgtcgctattcttttgcaaccacgatcccacgttcccacgactgaacgatcagaacgattcgcttgcttctttcccgggtgttagttcttcctcctccgcgcttgtgctgttctcgcctcctcgcttctgatcgcttgcgcgcacgagagatcggaaggagcaaggccttcggaaccacaccttcgcctgagatctgcaccgggtaggcgggtgatcaggtttttggggagtgcttctcgcacgactgctcgtccaccatgtctgcacctggaaccggagctgctgacggcgccgttgctgctggagctggagccagagatggtgcgactggagctacgaacgtcaacaccaacggaggcaattctgcctcacaatccagcggagggccattctcggggtatatccttctcctgctgttaactcattcgttcatagcgctgttagtcctgttagtcgcaagtcaattgcgttcttgctatatgttcatgttcatgatgcttatgatatctttagcatgctactggttatgctatatgttgtcactagatcaccccacactgtttatgccataattattgtcttaatattttggattaaaatatgccgatatatgcccatatttccaacacctcctagcacccaaccgactagatgttccaagtttatttattgactatttctacccctggcacactcatcactcatccatcccatggcccatagccccaaccacgtcaccgccatctcaccacatatcatgttcgctacccccaaagtccttgaagcacaaggggttggaaaacaacgatgatgatgaacacctgatccctaaaggcattaggtttccgtcatcgtcgcactatcactgtagatagacagctcgtctaaacgacattttaattgtgtcggaccggatcgtgatttaaaaatcttggcatcaacctaaagacgataagattagaattgaaatccacccaaggatatttgttgcaaactaaaacatatattcattgtagtctttacataatagatacattatttcccatataaagtataggacatgatcacatctaatagactatactgtaaaagaaaaacacaaaaaacaatagtaataatctagaggtttacaacaccatgtttttacatcatttgtcaaggtacagttcaactatctatgtttttttggtactttccaacaatatgaattaaggtatcacaaataaacactgctgtttgttaggttgggtaacgtaaaccttttgccgccaaacagcacgtacgtatggagcttttgaagctacaaataatcaaacaccgtttggaagttttatctgacgtgatatatatattcttccatctactgccgaccagaccaaaggaacagtgtgtagaatcctccaaccaccgtggacgcagccatcaaccaaacggcggctgccacaggccacggcatcaacgctgaaactcgccatgagaagacaaccgtgaggagagacgaggagaaccagacgccggccttggagcgagatttcgccggtgagttcgccggcgccctctcgtattgctgcaagcaccagaacagcagcaggaggctgaggtacgacgtggcgacgaaggctatgccggcgatatctccgtgcgacctgtagatggctagtagcgagttgagcgtcaagaagccaaaccatacgtaggccagccatgaagccattgccagccgcaacagatgatcgatggtctgttaaggcagctagctccgcaggtcgcgtctcccggccatattatatatgtcgcctaattaatgcttattgttcaagcctcgagcagtcatatattaccgactcaaatcttttgacttgtattatatgactatccgtttatttatgttttcaaagtagcgaatcaaacttaattaatttgtttagcttaatactatatacaaacagcctagacacgtaccgcgtacgtacactcttgcgatcttacgaagcaaggaagcatcatccatatatacgtcttccccaaggctcttgaccattgaggcattgacttcactaatctaataaagaagtcttttcgcgtcgtgtagtccacccgtttgataattaaattacttgttactttaacttacacggcagtctaagggaaataaattctcggcattttccctcgcaggctgcagtgatcaatttgggaacaccgatccaaaacgaatggatgaggcatgatctaaggttagaaaatccatgtccctctgcattaacaacttctcgctacttgcgcgtccctgttcctgaattttgtcttataccagactcaagacctaccctgtaggagcgaaaaaacctacagggtaagacctatacctgcaaaatcaaaatttccatccaattatctaactgagacaagcacaagatctcctagctcaactaccagatcaggtatatatatacgtacatattttgcatacagaaattttcaaattgggagctttgagaatcaaacggaaagggaataattaacctcaacatctggaattctctcgattgaggaaaccgaacctttcaacaccgcgtcactcagcgaggagcggcggtgaagaatcgaaccaacgcaccaccgccggttggtgtgcagtgttgctatatgaccaaaagatggatggatggatggctggctgcggcggccttcgtttccggccatcggcgatgagcagctcgcatgcgactgcgctccgccgcccgccgtacgtcaaggtgcgacgggcttctgttccgttgccatctctccttctggcttctgctccggtgctcgctcgcgtttccttcctcatctgcaaaggagatgggatagttgagaggactggtgccgaagtttcaccgaaatttcagtataatcgacacccgggcccggtcttaaaaggagagagggagacattaacaagtgacgttgggccagtttggtttgtgaccaatgttggccttacgaaaatttggtatgccaatttttgataaggccaacatgtgtttggattgaagccaaattgaactaatttggctattgaaatgacctatgttatataggcatgcttcaattcaaacatacacaattattgttgaggttgctaaaaaattggcaagcctaatttagatctcaaaccaaattagcccgttctgccgttttatcaatgaaacacgtatgggttacgtcaaaccgtcgaagtcacctgatccacacaatatatatattggcttagttccaaatcttttcttaattaacatacatataatttatcttgttttaactatgtattttaaactcgtacgaaaaccatttatatagaagttgatttaaaattaatattaaatatattttcaagtttttagtaattaagattcaattaatcgtacattaatagtttatctcatttatatgcatacttaggctgtgtttgcaagagcaagttccaacactctcctcccgtttttcgcgcttacgcttttcaaactgctaaacgatgcattttttgtaaaaagtttctatacgaaagttgtttaaaaaaatcatattgatccatttttgaaaaaatagctaatacttaattaatcatgcgctaatggactactccgttttccgtgtgcacggtgcatgttcccattctcccctagtgatcagagccttaatcttaatactagactttcttgaacgaggcttatttgctatactatgtcccgttcttttctcatgaagataaagattttacctcagtttttgttagcatgtttttcaaattacaaaacgacgtgttaaaaactttttatataaaagttgcttttaaatattaaatatatccattttcttagtttataataattgaaactcaattaatcatatgttaatatgttaatggttttcttattttgggtgtccgcttttataccttcggtaactaacgttcattcgtcaatcaatcactctcttcattaaaaaaaaacttcatagttctatttctactctctttatcctaaaattaataaaattagtagtactagatttttattttaaaacagaggaattacatcattacctagtccacctatactagttttctactcccttcttcccatattataatgaaatacggattttaggtggatgtgacacatcctaataatacaaatctggataggagtaatccacataaaatcccttaaaatatgggatgcaatgagtaaacagtacctccatcccaaaataagtttattttcacaaaaaagatgataatacctctattttattaaatctcatgtaattatcctcactttatctatttccaatactatttttataaactccaatgcaatgattactataaaaataaacttcttttaagataagtgaaagaagataaaaataaatttatcatgggacgaagaaaataggattttgatctttctccttaccttcttggcatggagtagtatacttgagtacttctttccaatccgaatatccggagaaaagaaaatgacttgcacccgcaggtgctgtgactctgtgggcctgtgataatatggtagcaccaagtactgactgtcttagagaaattaattttatgggtatttgaaatttatctaaaacttgataaacttaaccattcatctactgtaggcacattgacatgtgattttaccgctccttttatatttcaattctaattttatcactctaaactttatattgtctatactaccgggtgtactgtaattctttttttcaaacgactgctgtacagacagccccatttcaataatacatatttccttcctcccaaaatgttacgaatcctaacgcaactaatcctatcctcgatataacatttgggaagaaagatgatcctcgatgtaacatttcggaagaaagatgatgggtgtgtttagttcacgttaaaattagaaatttgattgaaattggaacgatgtgacggaaagttggaagtttgtgtgtgtaggaaagttttgatgtgatgaaaaagttggaaatttgaagaaaaagttggaaactaaaccaggcctatatatggtgtgtttagttcacgttaaaattgaaaatttgattgaaattggaacgatgtgatgaaaaagttgaaaatttatgtgtgtagaaaagtttcgatgtgatagaaaagtttgaagtttgaagaaaaagttaggaactaaaccaggccataatatagtttgtttatatttgcagtacatattgtgacatacgacctccgtcctaaaaataagtgcagctatgggtatccgtatccaacgtttgaccgttcatcttatctgaaaaatttatgaaaaaattaggaaatattagtcaaacataaagtactatttatgttttatcatctaataacaataaaaatttaaaataagacaaacggtcaaatgttggataacagtgtaaaactgcgcttgtcctgagacggagggggtagattccagcaatttctgtaaacaaaaaagttaacctaagagaaaagagaaaatatgacatatcatattagaacaaatataaaagattcgttgtattaaaagagattatatccccacatagcccttgtttagttccgaaataattcttcaaactttcaactttttcatcacatcgaaactttcctacgcacaaactttcaacttttacgtcacatcgtttcaatttcaattaaacttctaattttgatgtgaactgaacacaccctatagctagagattgtttttggacggaggaagtataaaagcaacagccgctcatcctgtcatccatatccactgaagataagatcactcttatccatacggccgggaagacaatccagttcctctgctctcgaggtctcgcctgagtcctcatcctgccaagtgctagctatggttgaagtggacgatggatccaaacggcagatcggcgtggattagcagggcggggctgggcatcctcaccgtcaactccggcctcgccatctaccgctccaggggggacgcagccgcggtcgccttcgtcctcggctcgtacaccgccctgctcctcctcttctcctgcctctccgccttcgagcgcgcgccgcccgggtcccccgcgaggggccgcctcaagcgcgcggtgtgggcgctctcgacgctcgtcaccgccatgttcgcgtggaaggtcgcggcgctcatgccgccgcccgtggcggccgtcgtttgggccctcgccgtggcaacctcgctcggaggattcttggccttcttcatctacacctgaagtggtgaagccgatcgatcgctgtttctcggtcgcctgtgatgtatggatgtacatatagctagtaattagctatttagctattactagtttgtacatgcttcaagtgaactatactctgcctctgtacatatatatatagtactttagtaacataccggatgtacatgttttgtacgtatcagcgtatgaatatttctttctttttcagttttcactctttgttccagcgtcttgttacagttccaattgatctaaacgaggaacaagttcactttaggtcccccatttgttgctgggtcagacatccgtccttaacccgcaataacaaacattacgcgtcacttaactctgcaaatagtccacgtctacatggatggtttgacttaatccacgtcctaactcctacgtggtattggaagcaaaataaaaaaaatattttttttaaaaaaaaagacaattgcttatttggctccgtttaaactgatcctactttttctagtttgtttatgtgaccttacttttcaaaacaaacaccccatctgacccttttccactgcaccactaaagtttcattttttttaaagaaatataattattatttgtaatgaccaaactaccctcaagaaatcctatccacatctaaccctatctattcaatcccgtctttctcgtatatccattgcagcggcggcacgcggaggggacaagcagccacgtcagctagtggaggtagtggcgacggaggggcgcagagggaatggacccacggcggtgcgtgcgcggaggcggtgcatgcagagaatggagcagcgacggctacggcgagcagaaggactagcggtgatggtggctcgatgacgacgacgaggagcaacggcggcggagctcagctatgacggtgtgcaggcgatggatccggctttagctgggtgtgtgagccatggatctgacgacggctgggcatatgagtcacagatccgacacatgcgggtgacggatcccgtggcggcgggtcagcgacagcggcgctgcggtggtctcagggattgcgggtcatcaacgacgcacgactccttccccgcgccggcaagctctccgacactggccgccgctcgccgccatcctctgcgcctctctcccgcatgttggtgagctccggcactgcgccgtcacttctcgtccactacgcgccggcctcctccttccttcgcgcgcgtgatgccgtcgcccgccctccacacgcccgcgagctccagcgccgctccctcactccccgcgcgtgttggcctcagtcttcctccacgcgcgccgtcactgggtaggcagcgacaacgacgacgccgtggcgaagagcatagggtaccgctccctccctccccgcacgtgctggcctccgtcttcctccgcgcgcgctgccactgagtcggcaacaacgatgatgacaccgtggagaagatattatattttttttgggatgctatccaaaattttgttatattttaattatatttgataaaataaacacatactccctctatactcataaagaaagtcggttaggacaatgtttaagtcaaaccttgggaatataaatcatgaataactctcaagttgttgagtttaaaaatataaaaattatatgaatatatttgtcttgaaaaatactttcataaaagtatacatatatcacttttcaataaatatttttatagaaacaagaagttaaagttgtgttttgaataccgtgtcgctgtcctaaacgacttcctttacgagtacgagggagtataaaaatgttttatttttaaattatttttttacaaatacgacgtttggccgtgaaagtcggccggacggctctactactcctatttaatttttaaagtacttttttaagaactcttttaaagtactggtactcgtagtacaactactcccatgtagtatagcagagcagctacaataggttcactattgtatagagtgagtgaaatgcatggagtcatccaacttgtgcttaaatatttggatcgttaatatgagttaagtgagttatttagcaatctaactatccacatgagcttaccttgtacgcatagcataccgcctaagactaaaaaaactgcatctagacatccgcaaccacttcacaccccatccgttgccttctaggttttcgcctccgtcgttgtttatattcataacttcttgccgccgctgggtttgatgacaaacgagagagagactaagaactagaagaactcatcgaaacagacaagtgaaatgatttggttcacttaatttcaagtatttccaagtgctagctagtgatgtgagaaaggaaaaatatacacacaccgttttctgcacatccaaaagcaattttcaatcataggcagcatgccatgtgtacaaagtatgttcatgtggatagttagatagataaataacttacttaactcaccttagtgacgtagatgtgttttttgaaagtaaagtgatctgcatgacacatctaaacaagttaaatgatcttccatgtactccctcattctcattataagcacaaccataagtttttgtgtccaactttgatcgtctgtcttatataaatttttttaaaaacataagtcacgtataaagtactatttatattttatcatcttataacaaacaaaatactaatcataaaaaatattaaatacaatagacgatcaaagttagacatgaaaactcataactgcgtttaaaataggacagagggagtgttatactttaaacctagctatatcatcacaatccgatgtggaaaagagagaattgaaaagagtgtaaaacagactctaaatatataaccgtaggctccaagagagatgcaaatggaggtttccaccaagagcttgcatgctacttaccatgaaagtgagatactacctccgtaccaaaatatagatatttttagcacaatatcttactctaaaataaagctatttctgcatctatctccttctctcaaccaatcacaatcattcgtcttcacctactctttcttttcaatcaatcatacttcacttactccaatcattatcacctacctttttaatacatgtgacaatctaaaaaatatttacattttaggaaagagaaagtatattatagaatgatgccattgattgtagattgagtgggctgctattatacttttcttatgtctccaccatacctaaatagagctttcgacagcagaacctcctaacaatcgaggcccacatgttatcgataggctcatctcacgggccggcgacgtgccatatgtgaacgggctccatatgcctccgtatggtcctccccagcaccggccagcagctatgaatggacacaaacgcctctcttatgctggccggcatatagagtaattttctgctgtctttaggggaaagaatataccccaccgtgattgaccaagccgatggggaaagccacgcgtgattgccggcgtcggcactgaactctttcggcgtggaacacggagcacgttaggcggagtcgcggagacgaagagcaagtataattgcaacgagtgtggaagtaaggtaactagtctatctggcaattttccatcgccatggattcagttgctagcggttacagcgcctgaaacacaacacattatgcttgcattgtttcaccccgccattgtagaaacggatggaccacaacgatcgccattcttctttactcaccaaggtaggattcggtgctctcacttgcaattccatcttcgccatctacaggtcgcagggtgacctcgcctcggtggccttcgtcgtcgccgcgtacgccgcgctgctgctgctcttctacttcctcggcaagttcgagcgcgcgcgcccggaggagaggggcaaggtgaaggcggctgtgtggtcgctcaccacgctgctcaccgcaatgttcgcgtcaagggtggcgcctctcatgccgccgctcgtcgccgccggcgtctggatcatggcggccgccactgtcgtcggtgggttctgggctttcttccttcatccctgaaattgtattgcagagaccaacagttgtgtgagtttgaaacgtgtattgtaactttggaagcgcatttaagcacattaatgtaagcgatcgaatatgatatacatcctcgttttctttttacttgattttctgctatttctttagccgcagccaattaagccaattttcatgaaaggccataaccaggaaaacaaaaaaaaatataccacccctcacaccccaacaacgccaacacacagactcaggagaaggctagaaacggaccggccgccgctaagcgtgaccgaccgctgctagaccagcaacggaacatagccaagatcgtccaaaacccaacccttacaaccaacacaaaaccccaatctatctaagtctttgggatttagggagagagagtgtgagagagaaaaatggaactcctctccccctaggccctccaacgtggccaacttgcagaagttagggcgccgacacaagaggatatgcttggggggtttcgacaaggggatgcctagacaacctctccaagctgagaagggacgaaacgccgccgctgctgtccgtcaaggtctcaaagagaactgagactgggctttcgcccggcagccacacttgaggggtgagacgacacaataacgtcctcaggacgggaatgacgctcgaacatcatcgttgccctgggttttcacctgtcgtccatcgcctatcgatctaccactgatacaccattgctcgaccgccatctaaaccttcgtcggcgcatgggcaccagtgcaccggcgcccctgtgggccagtctctacgtgcctccgctggcctcccctcctgatgcgcaggccacgaccaccgccgccacgccagtcggcctcgtcgtgccgcaccgacacacgcctcggccacgcctcctcacgccacggccactgaccacgcctcctctcgccatgccggcctccggggctcctccttgcgttgcacggccaccggccacgtctcctcgcgccaccaaccgcgtctcctccgtcgtgccgtccgctagcctcgccggctagccacagccaccatgcctgctgccgaccgcctgctcctccgcgctttccggccacagctatcgtgcctccgcgcctgctggccatagcagccgcgccttccagctcgccgcgaccgcccgtgcctccgccaccgtcctgcctgccgcggccgtcgtgcctgccgccgcctgccaaagcctcctgcgcctccgtcaccgacgccgcgcccgcaccaccgcagcctagatccgacagcggcgacgctagatccagctgcggaggtgctagatctgacggtggcggcgccggatccgccaccatgcgccttgccgccgcacggccttcccggctgccgccggggtttggagcctcaccgccgccatcctggcaggccgcacagtttcaggcaacgtgcttcgacggcggcgagacggggagaggaggggagggtgacggcggccggaggctaggattcgtccctggtggccggtcacccgcacgaggacgacagggagcgttattttttttgtccgtgaactgaagctatataggagagacatttgacattaacagaacatgcccataagcataactcaacttgctggctcaaatacaggaaagtcagtccatcccgcaccaggcccaaagaaaattgtccaacagaaaagtccaaaacgctagtacataggcatcgtttagatccaaggcgcataatcctagcttgacctgacaaagcctagcgtttagaactgtaattgtatcgtagcatttgggggcaagctagcccgaacgggcaaggaaaagcttgctcgcggtggagagccaattcggctcggtccatcgacggcaaaagtaagcccgcaacaacctggtttgtctaaatgagctatagctgaaggtgacaaacaaccaaacgtacccggcggacccctccccggctcccctcccctcgttctcgatcgatccagatcgatcggtgtcggcaaccgccgccccgtgcaatgcgtcgcgcctcttgctccctgcagcctcccctcatcccgcgctctgctccctccatcttgcttcgcgtcgcccgtccagtggtcggcgctcgctgcttgctgctggttcatgccccaggacccaagcagccgtgcggaggcgctgtcctatgccgtgagatgcccactggtcgccgtcggcctcgcgatgagcaacccaggccgagtgcgtccctatccaacatggaggaggaagatgaggtgccgccgtgtaggtgcaacaacctcctgtgatttgttcaaccgttgaatgatgatttagttgttcaacacttgaaaggcttgtgatttgttggtttgatacttagacacagttgcatacttggatttgaactttggttgtataacctgaatctccacaggacggatttcatgctaatttgttggttgatttgaaaggagcgtaatgcaagaatttttcaacacgtgtctaagacactagatcaacttgcggaggatagtaaagaggaaattgctgtctggagggtggctgggattttctcccaatttcgcgagtaatcgccatgactgtctgcggggtttagccctgctttcttttctcgttcttagttggctgggtcctttccttgctaccgtggtatagtaatatcgttgtaacattttactgtattttccctcaaatcttaaaattggttggctattcttttggccgacccggtaaaaaaaaaaacctaaatctccattgcaatcattgcaatcattttggtttggttgtattggctcgcgacctaaacgagctgaccagcgagccgagccgtgctatttcgatatttaccccttagctgatctcttaaatatttttttatttaattaatgtaggcgtcggtccttccgctgactaaccctgaggattagttaatagtactggagtatttgacggggtggttgcgacttgggagtaggattttacggagaaaatggaacaccctgcaatacaagccaaaggaaggcaaggaggagatggttttctcgacgaacatgaagtactcgtaactctctcgccagggagcttccctccccggcccaagcaaggatggaggtgaagccggagctcaatcgatctgcacagggttacacgaggcacttcttggttcttcgatccagctagctttgggatcgatcgtccggtaataagctcctggtatgctcctcttcagtaccccctggccctgtcatgctcctcttcccccctttagttcggattttcgacgccattcctaaatcctgtgacattttcatgaacatgttgtcttccagatggatctccatggttctagctagctatttgtgctttgatgaatcctgattccactatcgtcgtcgtcgtcatcatcatcttttttctattgttggtacatgttcttatatattctggcgcatttcgattcgagtttgtctcctgcgccttcgatgaaatacttacaagtcgatcgaacaacacctgtcatcatggcttacgccaatagctacgtgccgatagagtatagacacatgatgcacgacaggacgacgtgtttccacgtgaaacgtcgtccgcgacaagttaatctagaggcggcgtcgtatttgccgcgtccacacacgcgtggcggtggacaagaacgaattgaactttttctccatccgtctctataaatacacggacacacaaccgcacacggagcttcgctcccaccgtttagcgcatcgatctgcttaattagctgaaccttggattaaccattatttcgacgggccaaaaaccaagaaggcatagaaatccatctctatttcagcccaatataccatatggatatggatcgccacggagccctgaccaagctggggttcggagcactaacattcaactccgcgcttgcaatataccgatcgcggggagacccagccacggtcgcgttcgtggccggcgcgtacgcggccatcgttctgctcttctatttcctcctccggtttgagcgacgacgggatgacagggggaggaccaaggtcgtggtttgggtgctgacgaccctactgaccgcgatgtttgcagcgagggtggctccgcttatgccgccgctcgtcgccttcgttgtctgggtcatggcggctgggacgtcggttgctggattctgggctttttttctcaacctctgagatccaagagcgcactgtagatttgtttacggcacggcctttcttattgttagtggcttgcttatttaagttgcttgtaaccaaaataaatatagactttaggtgggaaaaataaaagaatcatcttgtacttttttgcgggccacaattatagcccattaacttgacgcgtcaccaccaattctctcttccgtggagcatatacgagggtggtttgatctgtcactagaccacgagacgaatttatttagtctaattaatttatcatagcaaatatttatggtagcacaatattatcaaatcaagccaagacaattaatccacaagccaccaagaagaagatcttgacgaccattccgaatacctccgccaagttatttcgttggaattctaatttccaaacaaacaagatttcggataagtaatttaagagaaaaaacctataagaacaaacatacatgtattgttaggtatag

SEQ ID NO: 57562 - DNA, 856 bp, Oryza sativa
  unsure (1)..(856): unsure at all n locations
attcatgcatttccattccgccactgaaaaggttgaaaagtccggcccggtcgttggtgctttgccttaaacgttggcacacatcacatagacccacaaactctgcaatttcccgcttcatgttgacccaccagtatttctccttcaagtctaaatacatctttgtactgcccgggtgaatgaaataagaactttcatgagcttcctaaagtatcacctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaaggtgggcttggcttccaacgcggccaaaaatccacgaccaactatgtttcttaactccagccagttcatttgctgccatacggtagggtcgcttgtacagaggagtggttcctgaagcaagatctatccggaactcaatctctcgcttgggcggcataccaggtagttcttccggaaacacgtctccgaactctctgacgatggggatttctgacagacttatctgatgcagttataaacttctgacaaaggttggaggtgcaaagaaaacaaccggttgttctggtcctcggtacagagtaacagtgcgtctcgggcaatccactactctttgaaattgtgccagccacttcatcccaaggatcacatccaagtaaatgagtctagaagaatcaggggttgaaatccaaaagctggntcgtaacgtaccgtncctgaaccaaccagnggtngtcattgcaaggcattcatgccgg

SEQ ID NO: 57563 - DNA, 8657 bp, Oryza sativa
cgtcctcgtggtttgttggtgatgcggctgacgacccgcgattaatgccaacggtgggcctcctgttttggtctgtcaccttgggccattattttttttgcaaaatagaacatatgaacttgtgtgttttttttcttgtgggttcgttttatttaaggggccaccggggccgatgggtagtgatcagattcagagtcttttatccctatgccattaagaaagttggaggttacgtgtgtgccacaaaaaatttttgagtcacttgtatgccatgagacaaactttcttttacctgtgcaccactttggatggaatcagcactaacggagactaacggaggtttgaaagatctattttgcccttgctctatttcagccactttggatggaacatttggaagagaaatcggcggcggcggcagcggcgactagaggcgcgctgccggatagacgaggcgaggcatcggcggcggcgtgccggcgacggcgaggcgaggcggcgtgccggtgacggtgaggtgaggcggcgtgccggcgacggcgactaccgacggcggcggcggctagagaggcggcggcggcggatagacgaggcgaggcggcggcggcgacggcgacgactggcggtggcggcggcgtgccggcgacggcgtgctaggctagggcactggagaaattgcacgtgagaggagtagtgagatgaaaatgcttcaggggcaatttagtcattttcatacgtgggtcccatatgtcagagctcattctctaacagaaggtggatggaatggcacacgggtaaacgaaagtttgtgtcatggcatacaggtgactcaaaacttttttgtggcactcgcgtaacctccaactttcttaatggcataggggtaaaagactctcagattcaccccctccacttggtttccttttctggcaccgtattactttcttattttggtaaatttaagcaactaaagtttatacacctcaagtttacacatctaaagttgagagaccaaaagtagattcaaatttgaatttgaattcaaatattttttatatatagtatttctatacatctaaagtttatacacctaaagtttatatacccgtttcaaatttgaatttgaattatataaatttgaattcaaatattttctatatatagtatttctatacagctaaagtttatagatccaaagtttataagtcaaaagtttacatacccgattcaaatttgaatttgaattcaatttttttatatatagtatttctatacataaatttttctaacttttgttttttttaaaaaattttgtggtgtactgtagttgaaagagaaaggggaggaggaaggggggaagagggaggagtatagggggaggggagtgcgggtgatcacccgtgcattagcagttccaggtggcaactgtactgcttttggtctcttgatagcctaaaccagagacccaactattttcataactagtatctcttcctatgtggtaagtatacaagcatgcaacagcaaggaaatatagtttaatagttaaacttcaaatatactttttctttcaaattacatatcatcccatctacagtccgattataccattttattcgttgtaattaaatctttataacaagatcttatatgaatatattctgatgaaaagaaatatatatgttgtaaattacttttattatatatgtaagttacatttatcatatatacatatacttctaagtttgattaaattacatcactactagaaaaatgatttttcaggacggtaccctatttttttcgctggcggtgagtttagaaccgccagcgaaaatccgtttttgctggtggtaggttaaaagatccgcttgcaaaaataagcctattttagctggcaggcctcttaacctaccgtagagcccgtcaaaaaaatcatgcgcacttaaaaatatcatagcctattaaaaaatcgccacccatcactccttatccacctacccatccttatcctctcgttcctcctcctccctccagatccaccagacagcaccctctcctcctcccttcctggatggcagcagttgttccttttggtggctccggtggcggttctggtcctcgggcggcggcacgcggcggctccagcacctgtgtgtggcggcgacggcgacggaaggcgagcatctccagcggtgccgcccaacctcggttgtcttgttggaagctaataaggaggccttcttgacaagcctccctcccctcccccttctctttccttatccaacggaagcaagtgcccccgtctgatagtggaaaaaaacggaccgagctagctatcctgaccggcctcgctcccactcccccttctctttccctatccagcagcggcaagtgcccccatcccatagtccccctcccctcccctttctcttttcttatccagcgatggtgagtgcccctgtcccatagttgaaaaaatcagaccgggtcgtcagttcgactggaaaagtacggaaccagaagtctccatagttcggttacgcttaaagatcagacatgcattcgacccagattgaaccagccgagtttagactaaaccgcgcaataaggtttagactaaacggagcattaaaccgtcttggtcggacccggcattaaaacaccttggtcggaccgggcattaagcccctttggtcgaaccaggcagaggagataaatgggccaaattaaggcccattccattgcctttagccccgtactactgtttttggttttcaaaaatcatagaaaaggcttgtggcatggggactcaaaccgggatctatgcgttgagagcggttagctctagccatcctacccttgttcccttatgttttagagaaaatacacattatatatttggaaccaagggtcgcctgggtcaatcaccggttcccttttttctctacggcacatcccaccatctttcccatgtcctaaccacaaagctctggtttgcccccgccgcgcaccattgctggccagtcgcgttgctccatccccacggctctaactgctcaccgcctataggaacgctgcctcccacaactatccctctaagccctcttccctctcccttgcctccattcctacctccaccccaacccgggatcctaaaccctaactcaacatgccggcgccgggtgccgaagattctatagagctagaggagaacgagttggaattgtcggagcacaaattgtgacacaaatcccaaggtctgattgtgacacaaatcccacaattttctatcaacagccatttaggttgtgttcgtttgtactgattgggaaccttcccttccagcatagaaaatggaaaagcacattagcacatgtttaattaagtattagctcttgtacattctttccccatttttttaatatagcgcagtagaagcctctcctgctgtttaaccgtaaaaaaattaagtattagctaaaactaacttgaaaagtgaattaatatgatttttaaaagcaactttccaatagaatttttttgcagaaaacaaaccatataatagtttgaaaagcatgcacgcggaaaacaagaggatggagttgggaaccattgcaaaagaacgcagccttattaattccattttgtttagtaattccattcacggtgctcacagcggcccaattagattcacgggtattgaaatggagacccaattttttttggtatatgtatgtttataaaaaagttaaaaatatatataattagtaaataaacctgtctttctaggcttggctccctctcctatgagggtccaattcacacaacttttatggcctaataatgtgattcgtgaaacaacatacaaactgtcaaagataaatttcttttacccctttctactttgagtacgcttatacgcaacctcaaaatcgtgggccctcccctgcatgacgtgatttttttgctgcttgcattgtaatgattttccctgggaaaactaattaagaggcagataaacaaacacacacttctctaattaaacaacactgatacactcttttcccttcattttatgacaagtgtgcttcaatggggcaaaaagttataagacaacaacttgtgttaccacatgtgtactctagtacgttttaagtggatggtttctagctacgaaaagaattggctatagttttaaggcagccagagattattaatggctgagatgcatgttgctagcttctacacaatccgtttcagaatgtttgaagcgttgactttttagtatgtatttaacgatttgtcttattcaaaaaatttaagtaattatttattctttttatatcatttgattcattgttaaatatattttcatgtacacatatagttttacatatttcacaatttttttaaataaaacgaacggtcaaatatatgctaaaaagttaacagtgtcaaatattttgaaacggagggagtatatatttgttggaagtgaagcatttccacttatgattcactcggtcattgcatccatcctaccatacattctatatatctatgtttggactgggaggtcccaggaattgttgtgctgcagtgacgccacgaaatctgtcagttttcttctgatagtttacaaagttctgtggtttcaccactccgccaatgagaatgttgacttaagggcagggtttgcaatttcgttttgaaatttcggtaattttgtcccctactggaaagctcacatctcgcccgaaattttcggttttattttttttttgcaaatttttctgattttggtcaaatttaattaaaattcattaagacagtcaaaatttcaaataatttcagctaaaaaaattcaacatttccaaaattttggtaatttcggtcccccgggaaagaatttcgaaattgaaagctccgacggcaccggcgggaaagaagtcgcagtctactccagctgctttgtgcaactctgccgtgtactagctagttgcacattttgttgctgcgctgcatagttgctttttacaacaaagatagacctcaaattaattgacatgattcagtgtacatactcgaagtaagaactgatgaatttatattttcggaagagtatttttttacccagcatatacatgtggatatatgcagccatatgcagccatttaagttaggaacttagtccttcaaataacccaatctgaaattcactcttacgtagatttgaactcaatatcctggggtgctacgcaggtcattacgactactcaaaattaatatacatgtatgtatatattgtactatatctgtgcctgtttggagcaatgaactagggtagtatatatgctgggaaggttgtgcatgtacttaaatcaaacggttgaaatgattgttagtaaaagtttaacaagaaaaaaaattagtacatgtagcattgctctttgtataataagtccgaaatatatatctaaaataaatttgtcttatgttacctttttgtttatactggttttatttagagcaagggacatcgacatagtaaacatacttatcttgatttcatatatccagttattctaatgcagctcagctggttaggttccgtgcctatacaggtttaggtcatagacttagtacgagttcttgcattttatgactatttgttgtttcaatgataggcaacctaccaatctttatcagttcaaatatatgcctaacggcctagtcttaaaaagtgccagtgtgtatatttataggagtgagtaatatacgcgcgtgcatataagcatctataactatattgagtttcacaaacaaaaaatatagcaaaattattgtctttacttacccatgttccaaaataaatagattcctagtatctagaaaaagtataatgtgaggattataaaagaaaaacaaaatgctccgaattaataggaaagtagtgctgaacttgtcggttaacagagaatacatatctgttcatctaatttcactttttattctttccattctatagaaatttaggtattaattttccttgtttgaagtaaacattctagattgtatttatctagagactttcgattgtcctaacgcaatccttgttgctgctatattttttttccatttaatttcactatttttttttctaattttctagaaacacatgatgctaacatgaagtgacttttcctcgttctgagtaattgtagttgaatatttatctctatcccaaaaattcacgaatatttgccttgggcccgttcagaacaaaataattcaatattaatattccaatataaaaaatatatattgcccttcaacctataatttcatgatatatatccttcgggcttcagccaaactttccttgctacgaacctttgagaaaaaacccttgaatattgttctccatgccatatttcacaacaaccagcattggcatcattgcggataaaattcacgaatgtacacattaggacaaaaaattcatgatttttaaacatttctccgacccaaaatttcaatagtattagccttgaaacatttctacataaaattcgtgaatgctaaccttaggacgaagaaaattcaatatttttttagcctttggcctaatatttcatgatcttttggggaaaatgcataaatatttttttcactccaatatttcatgagtatttgcactgggatcgacgcacataaaattcatgaatattaaccttagagtaaatttcacaaaactacaggtactttggtcaaattatcacaaaactacagatttaaggtgatgtatcacagaactacagatttaacaataaatttatcacaaaactacaggtttaaggctaagtatcacaaaactacagatttaataataaaattatcacaaaactacagattttgaggctgaaatccttagcactaatgttatgttggacttataattgatcaagtaatgtgattaaattgtcattaaacctgtagttttgtgataactttgttactaaatctgtagttttgtgatattacatcttaaatctgtagttttatgataaatttagcgttaaatctgtagttttgtgatatatcatgttaaatctgtacttttgcgataaattgatcaaattacctgtagttttgtgaaatttactcttaaccttatatcttataattttgtgatttttagccttcagcctataatttggtgagttatagccttcgaaaaaaattgatgaatatcaaacttctgaaaaaaaaagaaaatcttaaaaaataccgctgaaaaaataaccaccttattttttaaaataaaattggtagactcattactttataccaacttaattgttcagtggcgaaccaataaaaaattatgttggcactacgcatacaaattatttaattattgattgatatattaattaacatgacatgaattatctattattatatactaaaatttcattaaatgtcctataaactctaaacattcctaagccaccacatgatgctctaataaactaaagtaaatataagagattctgagaaaaaaaatcgtattacccaaacctatgtaccttattttaaactattagatctatatattaaaaagattattgatcgataagaccgtcagatttcatatgtacaatgcacatatctacttccctcctcacggacgagcatgtatccactttcttcctcacggacgagacgagcccataggttgtcgcctctttttctccatacggcaattaagttaaccgctgaataaaagaaaatcctaaaaattactgctgacaaaataaccacctttttttaaaaatacaattggtggacacattactatgtaccactaaacatgtgacgtttttctaccatcttaattatatctctcaacgtgtatatgaggtctatttaactatagaaataggtaaagctaaatcaatccacaaagatacaaataaatccttctacgaattaagctctttttaattactatcttctgcctaaaatggatcatataattttataggaaataaggaggaatgaaaaaaatactaagaagcccaacaagggatattttgccctcattcaataagtctcattaaatagggtagttggcgaattataaggtggttaaagtaatattggataaaaattaaatgagagatggttggatggtacgagtagtatttataatcccttataatttaccataaaatttaaatatttcgatttatggatggaggtaggagaagcaaacaagagtacgtgggtatgtcttaatttaataaattagataaagaaatcatattaccacatttttaataaaaaatttcttaaacttatatatcataaaatctaaaaaacatttttagtataaaaaatatattacgggtttaattaatatgatattttttttaaaaaaattaaacacatgttatataaattatagtttcatatggaaccaagtggttcatttcttgggacatattacgacatgaattaaagtaatttaagttaacaatttgtaacaacctattatattagaaccccacaagcttacttaatcaactaaggccgccactttaaaaaataacccacttacattttggtcttacttggggtaaaaaatt

SEQ ID NO: 57564 - DNA, 2849 bp, Oryza sativa
aggaaccatgtaagtattagatcatagatcgttaccactcaacgcgctgtgcagcggaagaagacgctgagaagtcgaaggaactctcgcgtagtagcgcgcgtcgatgtagaggaagtagtcgatagcaccggctcgaccttctcctccttgtgcgttctcctcgccgtactcccacgccgatcagcaccgcaaaccagcggcgcctctaccggtatccacacgtacagggacggaacgccacgcgcagatgtgctagcccccgcgcggctagggttttgctcggggagggaagtgatgcctagggtttctcacgtgatgcaatgcctccgccggtcacacccctcacgaatatataggattcatcactcgggcctccaaggcccgtaggactcctattcggatccctatccgaattaagctcatattggatctctatccaatccccttatttcggcccattaagcgtgcgacactgtaggttcatatatactcggctgtaacccgaaaactccttttcggtccacgtgtcaacagaggcccctagcagaacgtattgacctaccgggcatacataaagatcatatcggctgaacctctagtgtatacttgtatgaacccctttgcctcacgatatcgattaagctcaaggttagatatgtgccatcctctaatagctcaatcattcactcgaacctgttgatagattatataacttgcgattgactcctcaatcacctttggcatggccatgcacttccataatctacaacatcgaggggccccagagatatctctccataggaggggcaaatcccatcttgattattcatacccactacatgtttcacagcatacctgaaaactacttttataactacccaattacggagtagcgtttaacagtccctaagtaagctactacaaatgttgagaaccatgataatctcaggtctaaggattcaacaccaacactcaatgagatcactgatgacacaatacatatggctcttgcagtgtctcatgttgggtctatccaacaacatgttcaccaacatgtgtccacattattaatttggtatctctatatcatgatccatgagacatgatcatcaattaatacatgtgctgatcatataaacatatttgttccacatatgatatttgatcagggatcctttagaaatagcaacacataacataaagagtctcatgaaagaatcacatattcattaaccaataaggagttatctatttcaaggaacaatgttggataaatatgtaaacatagtatgtgatacaatcatctctatgattgcctttagggcatatcactgacaataaataatattgggtttaatttgcctcacttctatattgcaccattgtctgtaatcgatctactccatcccacactcatgtgcaatacacataatctacgagatcccactcaccggcaaacaccgatgattgggagagcatttctcttaaactctctacttcaaagtcctgcactaggaaaaggatattgggaaaaaattaatatacttttaatgttaaatagggatccactaaaacaaacgataaaatctactaagacagacgtaaaacattaggtcgaactcttctccggtgtaaaggaagtagttgtgtatagtcatcactgcaagcgaataaggtgtttgggaagtgctacgtgtggcttcccgctgtatattcacggtgacatgtcttcatcatttctcggttgcgacgagtcatcgtcaacatttcgtagcatgcgtggtcaaagcagcaccctttacgccaagtgcaaatcatctagaaaatatctagctgtacacattaattatattccgtacatttgatttattcatgtgcgattttatctctaggttatgcgcatgagatggttttgctagtttacatgtttgatatcaacatttataagttaaaatcaattaagcccacatatgcttatattttcttccacttatacagcctatatatatgatctattcatacattgcagttttctcatacttactacttcctccgtttcatattataagactttctagcattgtccacattcatatatatgttaatgaatctagacatatatgtgtgcctatattcattaacatctatatgaatgtgggctatgctagaaagtgttataatctgaaacggaggtagtattatatatatgtactctctctaacctaaaaatcatatgcgatatgcttaggcatgcatgcagacccttcgttcgtccaacagtttaggactgggagacatgaggaaccctggatatacatatgttatccttcggttgtgttcttaccttcaagttcccaacccctctccctcgttttctgcgcgcacgcttttcaaactgctaaacggtgtgtttttttgcaaaatgtttctatatgaaagttgcttacaaaatcgaattaatccatttttttaaaaaaatagctaattcttaattaatcatgcaataatacatgcttcgttttgcgtgccggagaggaggggttcctcccgaaagccacctttggctcaactattatggaggcagcggtcgtaaggacaagtgcagctccccttctgctgttgctatcaggctgtgttatggtacttcgtgcccttgtacagctccaggtacccaatccgggttgcgtagcccgagtccactagatagtacttgcctgccgcggtaaacacctgtatgttacacgtgatggatgttagaaattgcaaacatataattagtagcattgtacctggaggtggatgagggaaaacatgattgtatgtactcaatggcttcgtgcacaccc

SEQ ID NO: 57565 - DNA, 22099 bp, Oryza sativa
gtaggcaatacaaccagacatgagagtcaggtctctaattaagacaatactgtgcatggactccgtgtagtcacatccatagaccttataaccatacccacggaagaccgtgcactgtattgtcttaatcagagaacttactctcaggtctggttgcattgcctactatacctaacaatgcatgtatgtttttgttcttaggatttttctcttaaattacttatccaatctataatccgattacactattatgcacgttgcaattaaatatttacaacaagatcttacatgattatatttttgattaaaaaatatctatgttgtaaattactattgttaatatgtaagttacttttatcatatatataaattacttttagatttgattaaattacttcttacacattaatagtgctttgagttgtttgatttattattatttttaagtcaattccataatttgtactaattaaatttaatttttagatagactcatgtttttacccccacaacgaatttacttctaatgtcgtgataagttactttctttttgttttaagttacttctataatatatgtacattacttttaggatttattaaatttacttttatatgtcaaagaagtaatttaatggaatctaaaagtaatttagatatattataaaagtaatttgtattttttatcaaaaatatagtcatgtgagatcttgttataaagatttaattgttatgagcacaacggtgtaatcgaatcgtaaatccgatgagtaatttaagagaaaattttatttgaagtataggtgatagaaatatatttctctacttacatgttggactagtaggatcgctgtgcgtcgctggatagagcaaaatcgagagcgcgcacgatttactctcaaaatagggcttaaatttatataaaaatccccgtgtttctgtgtagacatacttctcgagataacactcaaccacacaacaggtatatttcttactattataaagatgtttatcgacgacaaacaccatcaaacaccaacttatggcgtattatgatttttatattaattgttcatgttgggttccatttaacaatatatttccttacatatatctatattattgatttgatgtcctcatagtaggtttataaaaaaggaataagtttactttgggttcctctatttgtcgcccagtccaatttttatcccttgaccgtaaaaccgggtacgacccgtcctccaacttatgaaaaccgggcgaacgaggtcccacggcagttttaaaggcggttttggctgacgtggcgcctacgtgacttgtttgactaggtctccgtcccacgtggcattgacgtggcgtttacgtggcaattatatctcggaaaaataataaaaagcgtggccccagatgtcagctgcacacaaaaaaataattttaaaatggagggggccacgtggccccgcatgtcagcctgactcctcacttcttccctctcccttctctctcttcttccctttcccctctctctctctccttcttctcgggcagcggacggcgcgggtgggcggtggcgggcgtggtcggcggccacccaacggcccctgccggcgacctcctcggtgtgttcgggccttcggggacctccttggcaacgggatcttcaacttcgacggggagacgtgggtggcgcagcataagactacggccgggcgtgcgcccccgattctctcccaccggccgccgcgcgccgctccctaccaccggtccccgcgcgccgccgctcctctcccgccctcccgccggtcgccgaccctcacgcaccgccgctcctctccctccttcctgccggccggcgcacgccgccgctcctctcccgtcggccggtccgacgagctcacctccttcctcgcagagctcccgtcggccgccgtctccgccggcgcgacgcttgcgtcggtcgctctgtccgccggtacaagcaaacgaagaaaaggaatgcaaaagaaaacaaaaggatagatagaggagagggcgtccagcacgtcgaccagcatcaaggcgcgcaagctcgagctcgcagccggaagcggcaagagcgacgcgtcgtcgccggcggcggtgtccatgccgttgtgctgctccgctgctagcagctagtagctagccgcgcgtccctatgtcctccctcctgtgtagttccgtcgtcatcgacacaggctgccgcctcgccgcgagctatgcccccgttttgagttcgcaacatgcgacaagcaccaagaaagtcagcaaaatgccagcaggaagaggatgctaagatctcgatgtaattaaccgctaactaattttgcttgcaggccggtggagccgagcaggcggcggcgcgcgaagacgataggaggagcagagcgggcggcggcgcgcggagcctataggaggaggttgagcagcggccggcccgcggagcaagatgggcagcggccgaagcgggctacaagctcgccgtgatgaggaagaagaggcagagccgagtggggagagggggatgacatgtggggcccacgtgggccccaccttattttttaagcatatatgtgggccccaccatttttagattaattattttttatgcggctgacatgtgggctcatgatttttattattttttcgagatataattgccacgtaagcgccacgtcaatgctacttaggacagagaaatagttaaacaagccatgtaggtaccacgtcagccaaaaccgcctttaaaaccaccgagagatctcggttgcctggtttttgtaagttggggacgggtcgtacccggttttacggtcaagggaggaaaatcggactgggcaacaaatagagggatccaaagtgaacttattccacgatgtctataccacacacgctgcttatttaaccatcacaatctgttatccgaagttaaccgcttccacgtcgactcgaacgtggtggcatcatgcatgtcaccttgtcattgagcaggagattttttttaatggttattagtgttgatctttccctgtttcaagatattttattttagcatttttatttgatccacccaagctttatctttgaaacagtcaatgcattaaatttttgagaaagcggatgaaaaattcatttggagtttgagaatgcaaacgaagggcactaaatgcatccttatgtagtttgagatagtgaaagttttgtttcgtattggcatgtgtgaaatatgttaaaaatggagtcttttagaatgcaggcagtaaattttattaataactatgtgaaatcttgcgcattgctgcgagtgctgcgggtttactataataacaataagcaaaaatattgtataagatagcttaaataacataagcttacatttacataagttgatgtgatttaaatttaaattgtatgtagaatgatgattcaaatgtaaaagtaagatgatatggcttgataagagaataaaagaaggaagataatttagactatatatctaagggtgaaaaaaattaagataacatggcttaatgagataaaagaaaaataacatgaactaaactaagtgaggatgaactgtatatagttatataggatatcataaaaaaatgatatagagatatattaaaatattatgtgaattatgtgggatgatttgacatgcttacattttaattctctaaaatttaataattattaaattgtagataatatagcatgtttgtattatgtttagattattagtgtattataatgtgacatctttgcatgtctatagattcttttgccacgagtttgacagtctggctcatctaatgcaaacagtattggcccatgaaagccaattgtaggaagcaaaggaagatcggttttggatttatcaagacaagaagtaagataattttgaagcatgagttctcatactccaaaactgggagacatgtgttaacaccaaaatttagtaagcccgaagtcatcattggcctagagttagtatcggcttcagagtcttggaatcggctgatgggagtcgtcaagtcactagcagttgtgttttttgtggaatcggatcaattaaaggaaatttatccaaaagagtctgagttcaaggaggatgcggcatggcaagtgtatctattaattaggaatagtttgttagttcattttatctttaggaaagtgtgtttagtgtccataaggactttatgttttccttttatctttaggaaattttctttcttgtcctagaaggactagtatctccctatgggtataaatatatacacccggggtcattgtaaaatatctcaacaatcaatacaactactctcgacgcatcgccaccctctttaccgaggtttttacttatcatccggcggaacttggcacctgacgcggggccacatcggttcagttcgatctccggtgaaggggtaagtcctacgttccgccggccctggcaattgtattggcttcatcggcgtcgttcaaggctgcatcagtacattcaaactcttggattgctctggttcggttgatatatttgcctacctatcatatgcctctgttaatttaatcttagcatatcgatttagctctatcggctgcttctcgctttagggtttctgtcagtatcggctaaatcgtgttgctatattagattagcttagacatccaccaccctgaaaatcagtcaacggcttgattgtctagatattatgtttctttttcatacttagtgttgcatcagttaagtttgatctattaagtcatgtttagaaccataatctctagcctgcttctttgactgctaaaaaatgttccatcagggtttcagccgatgaggtatctagacgttgcatcggcttacaaagattacgtataagtaggatttagccgatcgcaacaaggtttcactgtttatctaatcttgtggattttatgacattggacctcccaccgatgtatgctttaaccttcatatcagtgcttattctattatatcattgctagccgactggtttctactagatattattatttttatattgattatcatcagccgattgtctttatatcattatctacattgaatatatagacgattgctcaaaaccctatcgacatcggctggaatcgacatctgctagtatcggctatcagctggaattacttcatcggcttgtcaaccgatcggctatttgatctattgtttacgtatcttgtcaattgcaggatcaaactaattggcacactcgcacctcactaagatttggacctgcactggagctaagtagatctcctaggccagtgtgtttttcgcatcaacaggtggcagctcgttgctgatggtagccaagaaaggaccaacctagtccaatatgaaacatattgtaagaatacttggtcacaagtgaaagcatgaggcagaccaggggcggatctacagtagaagggccagtgtcaggtgacaccaacgattttcggtaaaacctatagtgaaactgtttatccatatgctataacacaatgatctaagcataattagcatactataacatcgatagacacgttctgacactaacgaatcgattttctggatccgccactgaggtagaccctggttcataatacaagttgggtaaaataaccttggccaaagtgcaattcactcaattagttataaagaccaatcgttctcgatcgttggaaacagttttagagagaacagaaaaaatatttttttcactgtaaataagggggaaagggaaaaaggaaacaccaggcttagatccaggggcgtcctcgggcccgtgcgggctgtgcgactgaatggggcccccaaattttaaaggcccctaaaatattaagtatgtcctatatatgataatattatagactttaattttattaatttgcagtccaaatagtagtaaaacaaagcccaaaacgctgcagaaggtgaaccgatcaatcttccatgtactcccgtccaggcgtccgcgtcatcgcgtatcgccgaagtcccgacgccgcagctcgcttcgtctcctctccctagtcccctctagccttcgtttctacttcatcgctgatgatcggctgatcgccacacccgtttttaattttactataataaatatactaggctactagactctattttaatattttgcacggggacccgatttgggcggtatataccttacttcacgtgcactccaggtaagtaattaaacggtcaaatttcttcggcgataagctacgtgcctatatatagcccatcagtcagcagtgcgctctgcttacccggctgatggacgaacggaacgccgccgccgctgccgggctcgttcgcgcgggtctcctcgttctcaccctcacctccggcgcagcgatctaccgggcagccggcgacgccggcgcgatcgctttcgtggcgaccagctacgccacgcttctcctcctcttccgttaccttcgcgcctacgagcttgcggccgccgcggagagagaggggctcaggcgcaaggtgtggtatatttgcaccgtcgttaccacgctgttcgcctggaaggttgccggcgtgatgcctccggccgccgccgccgccgtctggctcctcgccgtcgccacctccgccggtggcttcgtcgtcctgttccaccaccgccgccgtccatgattagtttagtactgtacgtggcgtatcagtccagtgttgctacatatacgtacgtacggatcgacttcacccttgcgttgcatattcattcgattgacgattggctgtgaatttgtaattgggagtatacatgcatcgaaagaatttcaggaacaggtatttaatttcatttctgaatatataatttattcattattttatttcttaagaaagcatggactaatggttaattatacatttgtactctctctgcaggttatgtacttatgggaagatcgttatatgtatatgtcttctgaatttctgatcgattggatttctctagctggctagctgaaatggtattgtagatcttggagctttcaagcaccaagcctgtctcatctttggatcaaattaatggctcattgctgttgttattgctgttttcaaaggattgaataatttttgtggggcaatttgttggaggttttgctcgtcacgttatttgctacccattttcccatttatcgagtaaattagtactccaggaaacaaagtcacacggaaaatctcggtgacatatatatatatatatatatatatatatatatgtgaaatttagtccatttatagtatattaaaaatatagaagtaaaatattgtacttagaactagtcatgaaaattttctcttgattgaaaggattgttggctacgcatggagtttggtctccgattaaacaatgtttctaccggaagtcatcaaatattctattgaaactttgaaagtcgtggcaaatttccaatgtcctattgtaagtcatcacaaatttctattggaagtcataaaaataaatctattgaaagttatctaagattttgtttcttactgaaattcaatttcctaactatatcatgaatacgaacgatgcacgcgcaagaggaaccaaaacgttttaggcatagattttgttccacgcacgctcgctatctaggcatagatttatacacatttctttttttttaatacaagttagacggggctcctgatgcatgaagcggcgcgagcatcatgcgagtacgaacgacagacgctaaacatgttcactcctacggcctcaatgcttatcagccaaaatttaaattttcaatcttaaattttaagttgattttagagttttttatcgaagtttatttttcaacttttgcttttacatcataaaaaataagaacacgtatataaaatttttattcataaattattttttatttataaatataccgtttcgcttatttctcgaataagcgaacgatggggttctagcctattggaaccgcatccacgcaaacattcgcaatttaggaatattgctcacacccacctatgtgtgtgaagttaagacttaaaacgtagatcttcagattacgaccatgaaaaatatgagcatccttgctttgtttaaaacttatttccgttaattaataagtaggttaagaacaccgaatcttacaaacggaattacatataattctgttagtggtatatgagcttttataaggaaaatcaaaggaatcattctgagtgatgccatttcaaaccataccatttttttttgggtaaagttgataaagatgtgcatatatttagtttcttgccaaattttgacaaatacataagaaataatttactaaaattttggtaatattatcaatttacctaaattaatttactaaaattttggtattgctaaaatttggtaaggttcattttggttacaatctaaacagctaaacaattttatgcacaatacgccattatatgtgagagttgttgagaaaccagtctactctattgatcagcacacaagcagacaaacacagagttatggaacacagaaaatatgagcaagtggaagctttatttcttctggatttgagtacaagctataagaggagaaacaggagaccgaagatcggttgtcctcgccttggaccttctgggccctatttataggcggaggagggtagaggcttgcatcgtaagccttgaaccttctggcttgcgtcgtaagccggcttacgtcgtaagctggcttctcctgtaagctggcctacgccgtaagctggcttcttctgtaagctggcttctggcgtaagctttcttctgtagtaagctttccactgataatttaatttgtcgataataaaataggtttgataactagagtgaccattcctacattagttcttctagtagcttataggttcgcatatcacagtgtcacacggccaggagcaggcgctcccaaattgtggaccaaaaaagaaagcctggatagagaggcggagcccaaaaactctccaacaatccgggcggcccggaaacccccagatctttccgctcctcctcctcgtcgtcgtcttcctcctctttcctcctcctccccgtctctccctctccgcttctctctcccaccaaccccccgcccccacccatggcgctcgcatccggcacgtcctgcgccctccccggcgccgcgcgcccccacctcgccgtgtccccctctccgcccgcctcctcgatccgtttctgcagaggcggctcccgcggaggcagggccgtcgtctccctccgcgcctccgtgcctccaggtagttcggtcaacggtgatgatttgtttctgcgcatgtagttagagagaatagaggggctagctctctctttttttttgtgcttaatttgagttttggagacctgaaaaatggggatggattcgtccgtactatgaggaatattggatggtactagtagcaaatagcagtggcatagcaatagatcgttgatatcgataaggctgtggccgaattcatacgggtctattcggattggaggagtttcacgggagttttggaggaacttaaaatgtttcttgtgaaaatactgtaaaattccagcgttccaaaacactaggaagggtactttccatttaggaataggtttttagtatgcttgatgcagtggctttgaggattactgattgcttaatcgatgacatgcctggtagttaggcattaaagtccttgtttaatccagttctggacatacatcccagctcatgttgctttttctcactcgggcactatgttctgtacatgacaattttgttcccattaattggtactggacctaactatggtttacaaatagttcatccccgtccaagttaaatgttacatatccttgtataagacattatcatgtttcctggtagggaacaatatttctgtgtgcaatttgcattatcaggggatcttatagaagcaattatttgtacactaatttgatcatagctgcgtataatcatgtgttatgtacactaatttgatatgcctatccctacatatggttacaaatttaaagatactcgtacttgggtcactcttgtacaatttgaaactagcgtgatatattcaacatgttggtcaaagtatggcaaattgtaacaccctttattcaggcacgcccatctgccctgtacttatgagcgggtaacactgatcagggtaacctgttaagattaaatgtctacaggctaaattctgtgatttcttgtcaagtatagaaataattaaacagtggagtaaatttaagataatgtcttccggagttaaaccattgattgctttttgcagcagcagcggcagcaacaacatctggtagcattgcacctgcaatttcattgactgaaaaggctttgaagcatctgaataaaatgagggctgaacggaatgaagatctctgtttgagaattggagttaggcaaggtggatgttctggcatgtcttacaccatggagtttgaagatcgatccaatgccagccctgatgattcagttgtagaatatgatggctttgcaataggtaaatttatccaactgactgttacaattaagttcacaaatctcaagtgtcagcagtcagcttgacatgcactacttttcgacctctttataacactcaagtaacgtctaatgtgaacttgtccatgcatgactaaactgatatcaattagctatcttgtttagtttcaacggctttgataataggtcacatgagcttactttcagaatctatttatggctcttcatgcgcaaagtaatctgattttatttatcgtttgttttactggatttcactcaagtgatcttttttccattctgcagtctgcgacccgaagagccttcttttcatgtttggaatggagctggactacagtgacgcccttatcggtggtggattcgccttccagaacccaaatgcaacaaagacatgtgggtgtggcaaatctttcgccaccggaaaagaaacagagagcacagcaacagcctgcaacaactaagctagaaacatataggtggaaatgccatatatatagctcacccttggcaaaatgttctatggatataccacagatgaatactcgaaactcagaagtgtaacgattttcattacagtttgtgtgtatcactgtatccaattggacaaattactgctcgatagaattcaaagatagttaccatgaactccagattttgtctatgatgctgctcatgttgttgttgatcaacaaattcatttcatgtcctcaacatatgtcttcaggaccaagctccagttgcaacttgcaactactagcatatggtagcaagggttaattgccaaatcaatctggtccgttggatttccatcggacggcacaggcagacggaaatcccgtttcaccagccgttatccgagcaagcgacgccactacacctctcgaccacgtcttccctcccccgcggcgaagcaatggcgacctcgtcgccgccgtgcgcttgcgctgctcctctcctccgccgccgcctcctccccgctccgccccgcgcgccctcccccgcggcgccacctcgcctgcgcctgcccctccgccgctcgccgccccccgcgcgcgccaagttcggcaagttcgaggcctccgacgccgcccccacggaggcctccgccgaggaggcggaatcggcggcggcggcgggtgatggggcggcggaacagaaagcggaggaggacgacaggtcagggtcactcccacctcttgccgagctcgtgaacaatcgtcgcatcgtgatgcgtctgtatgtgtgctaccttgcgttgtgtgtatcagctgcttgccgtcggacttggagggcgcgatatggcaatcggggaaggcgagcgccgatttcgtcaactctggtggcatgcgagccattgtatgttgctcattgttcatctgctgttcttactgtcttacactgtttcagtttaaccttacctgtcacaaaagttgtgctgttttcacctggaagttggaatggcatggagtcacttcatgtgtgtatgagtgtatccaagatgttaaatgttctaattttgttttgatcatgcaaccttgtcatgtacttatcattgataatttgtatttggttatactgactgtaggcagagctactgatccctcagttggaattcctcaacgaggaaggagcacaggctgaggtctgggcactgtcaaggatattcctggacacacttgtaaaagagacaggccaggtttggatgcaaggtcgtttagcaatagatgcactttttgctctttcttgacagtttacagttcaatggacctagctctgatttacccctgattcggcagattactgcatgattcttaacgtatcactttggagatgcagaatttcttgtccatgtagattaaatatttggcctgttgcccctatactgattgaattcttgtttacagaaagttaaggccatttttcctgatgctggagcagcggcccttcttaagtatcagtggacagatgcagagtttaagtgcgccaggtgggtattggttcacttacattaatctatgcagaaaagggagatggctaatggtttgcataatactaatgtgatttttttgtcatgatttcttgtattcatgttacttcctagcagtatttacacagaagaacaattatttttttcgtggttaaaacttatccagtttggtacaaaatcctagcagcgaataccacgtaatcacagaaaggatgtagaccattttgtgttactaggaaaaataaaactgtaggttatttctagattagggcatcaaatactactcagaaatgaaaaatcattagttttctactgatattcgaaataaaccaatagcacaaacatccttggttttcatcgtgagaatattccttttttcctctctgtataacagtatatcatttcctttgaatgctcccagtcttaatgcattgactcttaagtatttttttcctctgttatattttcacaatttatagactttttgctcgttaagtttagttggcattaaatttattctgcttaatttttgtgtaaatataaattctatctaatatttaacttgaatttcagcttaagtgaccggaaaccagttgacgttgaagatgaagttgttgttatgattatccctgatcatcagatggtggaatctgttgaacggattgcatctcaactctctgatgatcctgtatgtaacttatacctgatcaatttcaaatattttcaaataaacttgcatagttcatattaaaaataaaatgaaatttcaattgacgtgccaacagccaaacaaagttggtaaggcattgcttgtataattgcaggatcttactgcatttgcataagcaagctagcataaacctacgttcttggccatcacggcatcacatgaaagtgctgatgtagaattctatgctcaaagacatccagcctgttcaatgcactgaagtttctttcaatctactatccttttaaatctgtctattttgaccattatcttcttcatgctactattactgtttgcatgcaaatcccatttcagtatgatatcctaaaatattaccacttttaattcaatgaagataagacctcttgtcatgtggaatccacgccttgttagtggagatgttggagttggctttaatgttcgaaatctgcgccggaatttcctaaggtaagttagtcagatcatctggtccttgttggctttcctaaacatgtaggagtacatagctattcttgctggcatcacaatataaaacttggccaatgggggaaagacaccctccacggtatttcactaagggtgtgtttagttcacacaaaaattggaagtttgattgaaattggaatgatgtgatggaaaagttggaagtttgtgtgtgtaggaaagttttgatgtgatggaaaagttgaaagtttgaagaaaaattttggaactaaactcggcctaagaagagctcaatcggagcccagccaagaaaggtcaccaaagctagtccccctcatacatggggatgccgcctcctatggttcgggccttaagccatgctttgaggcccagcccttacacaagggcctaaccaacttgtcccgttttccagtgctaatattgttctttactacaagtttcattgacctatttcatgtttagttccttctgtacgtagtgtttcacctatctcttgctaattttcattcccaactttgcagcacttttaccactgtttactcgatgagaccgttgccaactggtgcagtctttcgacaatatccggggtttgtagataattattaacttacttatttgtatatgatcaaaatatgtaagtagtgtaataatgcgctaaaggcttatctgtgtttgttcatgttacagaaagtggaaagtattctatgatgacccaaagaggcctaaccggtatttgcttgcccgagaacttgtaagccgacctgatgcaacagacattgaggttaggcactggagttatatattatttatttatttttgttactattaatctgtatttgtgttgagttgagtatatgctcactccccaaaaaatggctagccaaagcatgaaacagcatttagaaactactagaagcatccaacagtcaactcatttctcaatctctagacatcaaggtgactgcacacaaattaggcagtcaaactaccggacactcaattcaagccagaaaacctctgttttttttttataaaaataactatttgttgcttgtcactaggcaaatgctaaaccactttcccataaagacaacatttaaaataagaagcattgttgcaatttgcagataatatttggaggcggcgatgaacaatctgacgaggcaccatcattgatgaacaatgtaatgggcgtatttagttccgtgagccggtttatgagagtaatctccaagtgaaagtctcaaccaagccgttgatgagaatctttttggccatgatccacatcatcagcgatgctgttaatctgcaactccatgggttactagctgctactgtctactagcaagcgatgtctagttcacgttgcaggacgtgtacaagctaccaagatgtgtacttgcacgattgtattgtagattcctgcatctatgaatgatcctaaacaatgttagctcctatataacatttctgtagatagttacatatccttctgtttctgcaaataatgaagatctgaattgtactttctgagtcacttatttgtccatgtatcatatgttcattcatctttggctaactcaaaaaaaagggaggggaggaaaacacaattacatgttgtttacagttaatcaaaacaattcctgtatcctatatagtcaagatgattccctcttatgacacacactaatcaacattgtgacacaagtatatattgcccctgcatatctacaccaaattgtgatcaaatcccaaaaatgttccaatggattcaaatgatgagcataagtatatgtatatcttcagctaattaattaatgtgcttgctctctgttcgccacaggagacgtcgacgcactcgtcgtcgatcctgataaccccagcgatggctgcaagaacatctggctgctcgagctcgccgccgccgccgccgccgtcgacagcgacgagtgggtcagcccgagcccgaggtgctccccccacttgagcccgaccttgctgtcctctcctcccgacgccggcggcgagcccttcttgccgacgtacgacgtgatggcggccgccagcgccgtgtggaagctcgggtccgccgtgatcgccttcgcgatcgtgtcggtgatcacgctcggcggcggcggcgccgccgccgccgccttctgctgcatctggtagagcggcggcgccgagccgccaccgccgccgccgccctgctgcctgcttccgttgatgctgctcagcgcagcctcgaacgacgacgagctcttgccgccgccggcgttgtacgggtgagcggatagcgacgccccgtagctcaagtaccccggccatggcgcgctactcgggccggagccggagaaggtgaagccggtggaagggtacctggtgtgcgagaacctgttactgagggagaaggcggcgtgggaggaggtggcggcggcggccggcgaggtgaggtcgagggtgatggtggggtaggaaggggtggaggtgatggcggcggcggcggcggtcgggaggaagaacgggcggccgccgatgaggggcggcttggaggaggcgtcgaatgcgagggccggcgacgcggcggcggcggggtaggcggcgagagaggtggaggaggagccggagatgagcatggaggcggcggcggaggtggtggaggccatggcggtggcggagacggagagcgggtggttgtgcgtgccctcgtaggtggtgatgaggatggacatgtcatccgcgcatcgctgcacctgcaaaaaacgtgcatggtgagcaccaaacaatttctcaaaatttttcaagaaagtttcacgagtatttgtattgaacttttacaagtaaatgtgcaacaactcaaaatctaaaggcagctttgataattgttccactttactatttttcttttagcgattacatggaaaactcaagtgcactcacacaccaccatacgtgcgcaccatactcacactctcacgaatgtgctccattaacatatactcaaacacatgaagaccaatagtaaatccttacccccactcaattgcttattgaaaacgtgtatgtaatgttcttttttggctagtccaaactatatattttttgaagctatagtatagactatagtaaaagttgtcgacttttgctgcagcatgcatcgttggcaccgatgttttttttattagcttttgatcaatccttttattttagaccgggtaaacttgcattcgtttcaatttggaccacccgactatctcctcaagcatatgaacaatctcaaatacatcggcactacttgtcaatgaactcccatagctatatgtgagaccatttctttgggatatgccaagttgaatgtaaatgaataaaacaaaattgagggtggtccaaagtgtcacaaaggtaaaagtacctgatttaaagtgaaaatattggttaaatggtaaccaaagtgaaatttactcatttaagtaattggtggacagattggcttgagatttgtttacatgttcaaatttaaacggtttcagactttcggggtatcttactgaagcttgtcactaatttccttttaaaaaaacttatcactaaaaagggtgaatagccaaagtggtcctccaagtttcatccaaggctcagtttagtgcttgatgtttcaatctatccatattagtccttcaagttttcattttagttcaaacttatccttgaaccaacaactctcttcataaatgacacttatacccctcatcattcacatatataagagaaaaattgcatgcttgaattttttatagataatacatagtatattatgtaaaacaaaaaaaaatatgtactaacaaatgtatacgatagcaattgcttaagtttcatgtgcacatgttgaaataatgggaagtacatctgtaatgttgtttattcatgttgactttctcttttatagtatatagatgtatacaaattaagggaaaaaaagaatattttcgaatagaaatattgactagaaatagcatatggcatattaagtggacccaaggatgatttcaagccaaaacaaatatttgaaggacctatgtggacaaaatgaaacgtgaaggaccaaattaagccttcgctgaaacttgagggactaaattagctactcaccccactaaaaaaattgggactatttgcaagagagaaatttgaaaggcacctatataagggcccaccaagttatcaaagaaagcccagtaacctaatctgtacggttgggccaaaccagtttgattcgaccaatgaaaaacccggccgcttgcgcgcgccgccgccgggaaaggcggaaatggcggggcggcggagggagcgaaccctacctcgaggcgccaccggcggccggcgatcaacacctctcctcctccacggcatggagtggtggcgcctcgctgcgtcagcctcgccggagtgcgcggcggcgcgtaggcgtagcagttcaggcttcgccctaactctggatcccaaatcccccatgcgggcgtctctccctccaccaatcaggtcaggctccgatcccccattcgcttgtgctctcctggtttctaatgtctggttgcttttagcctagtgctcgattacttgatctagcggattttttggaccaatttggtggcttggatcatatttatggggtgaattcgtaatactcaagcgattaataacttaattagctcgtgtactaccaattggcaaaattcggtggtggataaacagagtactctgaaaccaatagttggatttgattcggaaattgagaccatcaggactcatgacttgttaattgttagttggtccatttctaccaatcaaatatggttcaaactgaatgtaatttggttcaactactgtgcccagacctacatatgtgctgatctatcccattgggtgtagtctctttgttagtttgggaacttggattcaatccattcctttcccgcaagtcaattttttcggtgagtgaatttaaaaggagttgcaatgttgaacagaaagatgcgtaccactgtagctttaaagacatatgccaagttgatttgatcattatggtttgatttattatagatggtacataatgcattatatatacctgcttcctgactgggcatcctgctgccacggtgcaccggtagtaggcgcgcgggcacgggttccccttcgcaatcttctgcccatactttctccactggcatccatcattcatctgcacaaccatacaaatttaatcacaaatttttccatcatatctcgtttattttaccattaccttagcatattctattagaatttagcaagagagaacattttccaacataaatacttatactagctgtatatacaattattctcgtaccgttggcgcatcacatctcgctctcactgaaaccctagccttcttgacctgtggctgaggagctatgtcatcctcggcttccgcgccgacgctcctcaaattcttcagcattttgcttggtggccattgctctgtggtctctgcggtgtcatccctagcatcctcaaagctgccttcagggctcaacgtcatcacatccggctgtaccttctcactgttattagcatcaactctgcagtctgataatccaagagagagacctcctttgatcttcagaaaatcttcagtactccctttgacttcgctactggtggtactcttgtcttccttcttgcatttgctcgtgctcgttccaagtctcagagagacgagttcaggctcctcgatgtcggtggccggagagtctgggagcttcttagctcggccttgctgaagaacgtcatagaagtgcgtctgaagagatctatagtcgtgtgagatgcgcgacagcaacgtcttgagcctctcgttctcttctcgtacttcacccatttctgcccttgttgattcaagcttatcatcctgaccctgaagccataatagtgcaacaaaatgtattagccatatttgaaacaattacatatgataatggtcacttgtcttgtgaacgacatagctaggttgatagaaaaagacattggtataactatgatgcatgctatgcatcctgaccttattttgagctttcatgtttagcaatgatgagtccatacatgatctttctattgggcctggtgaacacacctagaaaaataaactgatggtaagaatagtctagaagaaaaggtaaagtgtgtgtatgaacttaaagaaactagttggttttatgacaattccaatgagtaattttaggacaagaaaattagacgttaaagtttacactgctgcttcttaattatgaagtaaaaagaggcagagaaaatggtagaaattgattaatgaattgatgggtgggtcagagtagaggtacctcctcctttgtgcttgatatgttttgcaaggacttgaaaaaattgccatctgaaattttatcgccatcttttataacctgcaatatatcatagaattgaagatactatatatcagtagagatcaagacaatacacaaatatattcaggctagctacagagaatctataaattaactttccttccagttcatatatatattatccatgatttatcagtgctatctatgtacgcataagaaccagtggttctcaatttttttaagaaattgatgaacaccgcatttcaaaaaaggaaaaatcgatgaaacctgattaatttggaccaaagaactgcatctctgaaaaaaaaaatccctattccacgaactaagaacaagaaccctgaagagaaaactctactagtcctagttgtacttacccaaataaatgatccaacttttggaagaaaggttagaagtttatttttagataaaggaagcgtaaccttttctagaaagataagaaatacatatatagttcagatagaaaagagatccatacctcgtcttttaaccgatcttcatgggttccaagctgcctctctcccttgatcatctcctctttcatgtacatagaagctagctgctttgagtctcccttgatcatctcctctttcatgtactgagaagctagctgctttgagcagcacagctacctctcctcttcttctcaagttcttgtctgccttcagctccttctcttcttccttttgttcctgcaccagtattatggcttaattataaaggcaagccatgtcctcttccgtctcctctttggacttttgcataaattaagttgtaaccttgtgcttacctatgttaggcggtcagcatcctaaatgtcaaacacggccgcactcttgggtgacttgtgtggagaggaaaaaaaaaagagcacaggcgactgagatttatgtggatttcaacgtgtgtaacatgttgctgttttgttgaagggctgattctaagatgtgtgtccagactgcgtacgtctggccggaatatgatctaatagcacgtccaccgttaatgtccgtacgaagcttcctgcaagtctttgccatggccgactattataggaccatgtgttcaagtaattgattgattttgaaatttcagctggactttaggacgatagctaggtccttgtatgatgatcatagtcccctgataaagatggaggggcagctcgagtactagtataatattttaggaaaaatgcttgcacaccatgactggccaatttaatgaacattcacattctgatgacatgctagctagctagttttcagaaaaattggggaaatttgctaacaaattctggttctcatgtctgagttagatcaatgacagcttgtccgtattggtaaattagaggaccacacacatcttaattttatccgaattgattggtgagagtagaggaccacatgcgtctctctcataagtaagaatttatcttgagtgcaaactccacttcattcaacgggctatagtaacatgcatgcatgatactataagttcctagagtagtatctagacttgatcatatatgtcgactagcaatattccaagactttgaaattgaatgccacatcatgatcactccttattcaatctgtatatatagtttgattgattctttgaaaacaaagaatacgtatggtgtttttggaccaggcaactaattggtctggaaatgtgaattgagtatagacagtaggtgccgtttcgagttgtaaccaaacagtctggtgtgctcagacgaaccaaatatgtcaacatcgaatttcagcacaaatttggcaagtgagattgcttggcagagaagcagactggcaaatccagcatactttcga

SEQ ID NO: 57566 - DNA, 8075 bp, Oryza sativa
  unsure (1)..(8075): unsure at all n locations
agagactttnnatggagttgcacatccacatgcnccnnnnnnnnnnnnnnnnnnnnnnnnnnnnnnnnnnnnnnnnnnnnnnnnnnnnttgccagaactttgtggaacatattgtgaattgttgctaatgatcgctcaaatctgtcctcaacttgcctaaccgactgggagccccagccatccaaagaaacaatcctaacgcctcaatacttttagatttcatgctagacttgagctcatacttgtcgaccaatagatcatgaagactaaagaacatatcagaggtcattctaaacatgttgtaacaccgcttcctgtctgcaagcttcttctctacccattccaacgcactcattgttgtgctaacatctctatattccgactggttgcagtacctgtcaatgtggtttgcaagatgtaacgtaccgcacagaaacccggtggatgcataatcgtccataaagtactccatcataactctgccgaactctttgacggaatcttcatcctttgtatccacaggttggagccgcgcattctcctgtaataaaagtaaaacaacaacggtaactttcaaacatcctcatattaagaaatgaatttggaaagacagccttactacaacttatatttaattgccaacattacgcatgacatatttcgcaacacaacagtagccaacataccataaatgacatagctaacagacatagcacctcatagcttccgaagcgtacataacccaaaagatataactaaggctgatacattaacatgttaagcaagcattagaaggtctagttgtcgacccgtgcgaggtgctcaaggagggcctttctttcttcatgattggacagctcaaagacattgatggcatctcgatccttgagcatcttgaacatggcaacccacaagtgtggagtcgcctctgtgacccagcactccctactgagtgccatgatacgctcagccttttcccccgcgcgagcgtcatcatcatccctcctcttctcacgctgtgccgaatagctgtccgttgctatcgctttctccttctgcagctcgtgtgcaccttcaattcgttcaccacggcgcggacggctaggctcttcaacttcttgcttggactagtagccctactccgcgtgcttggtgtgctcctcatgctgtgcgacctcttcgtcccaacactgatggggcttagggggtcaaagtcgtcatcgtcagattcttcgtcatcctcgctgtcctccacatccacaatgggggtggccggctgggttgtgggctatgtaagaacaaatgaagtcgatccgttgacaaccacccccatgaacatgcggtccatttcttcgcgatagtcgggcatcccattcttcaacttcctaaattcagggtggtcctgcacaaaatgaatgcatcggtcagatgcataggaacgatcatgtgtaaaactgcgcaacgaaaaagtgaagtttttgtaccttagtgttgtcatcccaccacttgtctgaagcaaccatggtgccgtcaggtcttcggcccaaaccagtgtctgtacgcaacctcaatatgaaggtccacatatttttcaaacccctgtatttaaatccgaattgctcattgtcgtggaccaaatcagtggtggcataaaaaccctttctgatctccttccaacctgctttactcatgcttccccttatgtagttgccattatctatttgcttgcaatacagctcacaaaaaagtttggtgttctcatttgtccacgtagctgtaatacatttcgcaagtattgtactagctgtacttgacaagttacaacaactgtagtatgtagcaactaatcagatgaaccacttgttaacctcaaatgaaatgggaatccacacattgcaaaacctaaaaacgttcttacctctgtcagccggcgccatgcgctgcgacccctacctcggcctcgaccctgagatgcggctcgagcttgaggccggatgggaggcacgaatacgcctccatggcctgaacctccaaatggcggtgccattggcgcttggaacccagctccaatcgcatgcggcccgtcgactcctgccgccgacatccgaccgccccgtcgcggcccagatccggaagctccttgagcacttggccggcccctcaacccgagcgtgcgatgcacggtacggggagggacgcctacgccaggagggcattgactgccatcccctccgccactgcgaagaaggtcttggtagccgtgcatggccgaccacttgtcgccgtagttgaggtcaagagccccgaagtcgaaccgggagggttctggctgctggaagaaccctcgccgaagctacccgagttgtaggacgtgaggccgccatcacgggagagatggagaggctgcgcgaggaagtcgcgcgtagggatgctggcgccgaatcgatgctcggccccgtacaggaggatggtgctcccgccgccgtatccgccaaggttgttgccgtcgccgaacacgcgcccggcattggcgtctccgtagccgtggccgctgtcgccgttgccgtacccgccgccatcatggccgtcgccgtagccgcccccgttgttgctgtcgccctcgtacgaatccattgcgtgctcccgtcgattccgctgcacgcgccgccacggatgtgctggatctggacgaggaacccttcgattcacccagggtagggttggattacagcggcggggaggacagatgcgacgccgacgagttcgagagagagcggacgtgagggagaagaaccttagggttagcgcgtgtgaagaggcgatgaggaatggataggatcggcggcgtcggcgcctcccaggggtataatgggacaccctaaccctaggctactgttgggccttaaatgtgcaatatggccgaatttcaggtcgctacccgtttagttccaaagtccagactgcaccccttgtaccgatttttttggcactttggccctatctaaacacggcctcaatgtagcacgaggaagcaagagaggctcgagaaactaggttctagttatttgctggtttgtgctttgatgtgtccatcggaagccattgatgcttttccaccatgaaggattctggttcatcgagggactgaatgtattcctttttttttcttatagcacattaggaatatgggacaattgatcgattgaacacttcattctccgcggtttcttttgtttgaaatcacaagtttctccatctacaaatgaaagagacataggttttgtagatatgcaggatttaatttgcaacatcagctcaatcatgtagacagggcatgatttcctcatatggcatgatgactacctgtgtacaaattgttagagtatatatatggtacttagaaatgtatgaggatagtattgatttgtgtaaacttatttcttatatgtaatcttttcttatctctaccacgtatattttgtatatatcggtccctgagcttaatacgtacatgtctaatatttcgtagtatttttctccatttactattctacacaaatatattatttccataggccttttgttagatgtcatttagcgaactgtctcttgaaacgtcatttagccgtgtgtaagagggcttttacagggcatcgaagaaagtcttcaatgattttcgtggcagtgacagtccgaatcgcataagaccagaggagctttgctctgctagttttcttttgttgcacacggctattttcgactcgacacctctgattcatggcagcgttcgtgctgcatacagttcgctcaagcgtcttgcctccttttctatcatgtggttacttttccagatgaatacagagacatttagagaccataggaaaaaagtacgaattacccctaacaatcgggacagtacgaattaccccccccccctccgaatctcaaaaccggacatttgataccctaaactattgaaaccggacaaattacccccttggctcaacacagagtggttttttttttttttttttttggggtcttttccccctaaaccgttggcaacaatacatgggcgccacgtggcaatccaataaaaaaaatattaaaaaactgtgggcccacttgtcatgtactcctacctcacccctctcttttttctctctctcatcagctagggggcacggccgggcatgccgggagggcgagcggcgatggcgaacgcgaagcacggtgtcggcgaccgcatccgtggcggcgacgcgtgagttgcgcgagatggagcttttgcaggaggcggatggctgcagtgtggtggtggtggtggcccgggcagagaaggcagcaacggcggtagagtgggggtggcggtgaggggagggagagacggggagcgacggcgagggagggggtggcgcgagcttgtaggggcaacagcagcagacgacgacgacgagacaaccttccccgccgagccgaggtcgtcctcggccaccgccggggtgccgtgctcgccgagagaggggaagaggagagagaggtgcgggaggacctccgccgccggccgcggtcgattccttcacgtgagcttcatcatgggccacgccgcacgccctgaacgccccctccacacccaccgccggcctcggggtccgctctcccgacggcgctacggagagacagagagaggggggaggccacttgccgtagtcgccgtcgtgggccgcgccgcgtgccatcaccgcctccgcaacgcccgccgccggcctggggtccgctctcccgacggtgccagagagaaagaggggaagagccttgcttggcgccctgccgcagttgccgccgctcgccatagtcaccacagcttgacagacgacggcggcgccacccttcttagctcgcgggatggaggatcggcgtagcctgctcagcccaccgccagcctcgcctcctggcccgcccgccggcctcggtctctgcgcccgcccgcctccggccgcggctcctcgcccgccgcctgtagccatccccgccgccggccgccagtcggtgtccactcctcgcccgcccgccattagcagtcacctttgtgctcgtccgccgcctgcagccgcctccgcgcatgtctgctgcccccagccatcccctccgccggctgccagtcggcgtcggcctccgtgcccgcccgcctctggcctcggctcatcacccgtccgccgcccgcagccatccccgccgctggccgcccgtcggcgtcggctcctcacccgccgccgcccgccagccgcaagatctgtcaaccgagagagagaaggagtgaaaaaaaacgctaaaaggtgggccccacctgtttttatttgtttttgctgactgtatcgccacgtgtgtgccacgtaggctgaaaaccgcttcaaagcgagttaggggggtaatttattccgttttaagtgtttggggtgttaaatgtccggtattatagtttcgggaggtaaatcgtactaccgcaatagttcaggggataattcgtactttttccaattaccatatgtttgatgcatcgatgcaggctgatcgtgcatgcatgtttaatttcttacatgcctgtggttgatcatcaggataccaagtctccgaccacaacgtgttctttatgggaaaactgataaacaaatttcatcacttcagttaaacggaagaaactggatatataaatatggatgtctatgcctgattctggaagccatacagatatacagacaaaaacatctcgagcgagcacctgacaggcatgcacagaacctcccaaatggtatactattggtgcctagaccgatctctgcacgctcttgtaaccacagatcaatctgtagcccgaggtattgtgccgccgactcctgcaaccataggatcgatggtgcaccattcaatctactattcaatatttaatatactaactaagtcacttgggcatagttttagatcttggacccatggtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttggaaaaatgctcgtggcaatctattcgtcaacttgttttccacattggagtatgccgtgggaaaacttagattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggagatacccttctattgtttgaaaaattcctaagagggtaaaacaaatatctaataaataaactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggcaggagacaacctgatcgtcagatctatactacacccggcggattcaaatccccaaacaggagtagggtattacctctcattgagagggcctgaacctgtctaaatcctttgtctccacatccatccacttttaggtctcgtgcgctaccccgttttattattgccgaatccatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtntacgacttcaccgccggcctgccttcgtcggcgccgagtggtgcctccgcctacacggctggcctattatgcccgtgcttgtgggcgtctacgttttacccgccggcttggctccgtcgccgccgattggtgccctccgtctacaccgcttgcctattattgccgcgttgttggcgtttacaatttcaccgcg

SEQ ID NO: 57567 - DNA, 6481 bp, Oryza sativa
taatctattcgaatagccgcgccctcggttatgggcaagccgagcaatgtacccaagttagtgttttaattcttaaaacctgcttaacaattaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaattttcccaagcccagatgaggagttcctggaagatgaaggctttggtgtctagctcgtgcctgccgtcaagtgcctgtggtcgtcgccctagtcttccgctgtttttcgttgtctttgagtgtgctgggccttcgttgcccgtgtaataatttttatttacgcttccgcttgttaaactctgaattgtatcaacttttggtgtaccttgcctctgggacaaggattaatgcacgcacgtcaggaaagcccgttgggttatttccggtcgtgacatgcagtgatcctcgctggctctcccgagcggacttcgctggcagtcaccgcgggtggagattctttccccgccgcttgcaaaacgccgcttttctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaacccatttaatagcagtaataaattcaagaattatggtagtcgtggatggttagctttaattgtcagctctccctctgtttgctggttctgtgtggggttttcagatggtgacgaccaggagaagtgctgccaccggtgatggcaaccaacctgaaggcagcaaccaccaccagggcagcccacctccacctcctcctccgcctccaccaccaccgccagataccaacgccattctcacccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtgggaaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcccgccggagtcgtggcccttaagaaaagagaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatctggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatgtctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccatcgtcagagagttcggagacgtgtttccggaagaactacccggtatgccgcccaaacgagagattgagttccggatagatcttgctccaggaaccactcctctgtacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgaagaagatattccgaagaccgcattcaccacgcgatacggattgtatgaattcacggtgatgtcgttcggtttaaccaatgctcctgcctttttcatgaacttaatgaaccaagtgttcatggaatacttggataagtttgttgtggttttcattgatgatattctggtatactcacaatcagaggaagaccatcagcaccatctccgtctggtattgggaaagttgcgggaacatcaattgtatgccaaacttagcaagtgtgagttatggttgtccgaagtcaaattcttagggcacgtgatatctgctaaaggagttgctgtggaccccgaaacagtgaccgccgtcactgaatggaagcaacccaagacagtcactcaaattcgcagtttcttaggtttggcaggatactaccggaggttcatcgagaacttctccaaagtcgctcgacccatgacacagttgttgaagaaagaagagaaatttgtgtggagcccgcaatgcgagaaggcgtttcaaactctcaaagaaaagctggtttcctcgccagtgttaatcttgccgaatactcgcaaggatttcatggtgtattgtgacgcttcgcgccaaggattggggtgcgtgctcatgcaggatggtcatgtggtggcctatgcctcatgccagctacggcctcatgaaggcaactaccccacccatgatttggagttagctgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattatgatgtgggaattcactatcatcctggtaaggccaacgtggttgccgacgctctaagtcgaaaaagccattgcaacactcttaacatccgtggcattccaccagaacttaaccaacagatggcagccctgaacctaagcatagttagtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagataacagagaacttaaacagctgatacttcaggaagcccacgaaagtccttattccatccaccctggcagtacgaaaatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggttgatatgattctatatgggtagttgtggatcgattaaccaaggtggctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccataacctggaattcgcagtggacgattttgtgtaccttcgggtcacgccattgcggggtgtacacaggtttcggacaaaagggaagctcgcacgtcggtatgtgggtcctttccgtatcgttgcccgacgcggagaagtcgcttaccaattggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtaaaaatcctggacaccatggagcgcaggaccaggaactgggtaatccgtttttgcaaggtccagtggagcaaccacgccgaggaagaagctacttgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaacccttaaagaaggcatttccccctccttcctcctttttggggcgggtttgacccatttccttcctctttttttatttttcccccccggaccattggttcccaaggcttgggcccggttgaaagcggcccccccgccgtcttgttg

SEQ ID NO: 57568 - DNA, 4501 bp, Oryza sativa
ggacacaggcatcttacagaaacgtttcttttgctcaagaaaactaatattctcttgttagctagatctatcattaagaactgggctctgcctgcaaagcttggactatgactagattatatctcctagatccaaggtttatcagtggaccacttgtatggtattctatggaaatcaacaaatcagcacactaataaaatgcatgaccattgaccttaatcataactatttcatggaaatttagagcagtttataggtactgtgatccaaagttagctgtaccatttatctagattaccgagtgggttctgctggtgggggtggtcttcgagattcagactgcctcttatgatgatctcattggtacccttttaaaggtatgtatagttcatggagttgttctctctgttgtttttagatcccaatgcgttgaaatctccattagccattgcctaattagtgctgcatgcatggttctctacttgcatctgtaacagagttttatattgtataaatgtgttcagtattagttggcgctggccttctctttcctttcccccctctctatgtttttttcttttttttaaaaaataactatggcaagataaagagtaaattcattttctctgtgcctgctccattttggaacttcatagttagctcatatatcgcagataagagtagatttgttccacattgtctatataacgggcattgccacctaggtaacttgttcttcccagcatcaagtttaggtaattaggtactgcatcaggtgccgttcaagtttttcttttgaattggtgtgcaggccggcctgcctgactttgcacacttgtgttaggtaacatggtacagttttggctgagtttgaaatctgaagcagttcaagaattgctagaagcctagaaccaggatttttaaaaaccagtccggtttccaactgaacagtgctagtgttaatttgcctcatcaagtttgatttgtcttcagccttttaattaacacgtggaattattcactaatgtagttcatccattgaatgaatcttttgttacagcctgtgtgtcattttcagttgcttatttttctagcccatgatctatctcgtcgtcacatatgtaaactcatgatcatttgactttgaagagaaaataatttgctaactgtcagaatttaggccctgttgaaattacaaaactaaaagtgtcgtaagctgcatttatgcatgcgttgttcgcctatttctgattctgatctgtattcatatgatcatgcatgaatcagaagtcaactcaaattaatttatctaagttgagaagtaaacaagctggttagcttttacaatttgcaacatacgacctgtagatttcgagtactgatcatattggtacagtgcagttaccatattcaacccattgcaggttcatccttcaagttgactattgctagttgtttatttataatttacgttatgtatgtattagttgacttcatcgagtacctatcagtattttcacactttaaggctgtatatttttgttaattataccacatgatgcaaaagatatatgtagttctgaaagtttagctgttctgaataattgacacaagctaagcatgagactcatgcatgcaggaagaattagtactagctaaagaattaattcttttgttcataacttcagatgcagcaattgcaacttcagcttgcaagcttcctctctttctcggaattcacatggtctgaaatggaagcaacattgtgtagacagatacgaagtcagatggcttcggtgatagccattagagaaacagtcggttaatcttgacatacgtagtgacattggtggccattatatcagaaaatatgcaccaggatcacgtagtagctaacatagttttcatgatcccaagaaaaaaaatgtttggcttaggtagccaagaggattgacaagtagggcacacaaagggtagttagatcgaagacacacgagtacaatgagaagactgaaagtacgtgtgtcctgttaattaatttatagttgcaatgatcagaaggaaccttcaacttgacgcccagcttatgtcatgcttatgtgccattcatgcatccatccatccattttatgcaaattaaggagattagctgtgctcttgttggctgcacaacatgcaatcccatggtacatttatagtaggatattattcagagtagaaactagaaagcaatgcttcttcagaggatagggcagacttaaggggttgcatctatggactactttgcatatattgcctttccaattgcccccttgtgaactacaaaattgtgagtaagggatccaatatatgtttgatcagatgataaactttaatattgatatcatcatgggggcggcatatggggccgagcttttcaacgataccgtcaaagtggtgcctaatcacagggcaatccacatggactcattgtcatcggggcaaagaactaggcaaccaattggagattgatttggtttctaatccattttcaaaccggttgcttcaaagcaagtgacttccctcatggcagagtcctttgattttgtattcttgtgtcaactttcatggcctatacagtattgggagtcttcacctagcatgtgacaactgttcccctattgattgagcttttccgttgaactgtgcacaagtggtttccaatggtcaagaactcaaggatcaattagttatattttgtcctcctttcagaaaagaaaaaacaaaagaagcagccctgtttgtccagctcagattctcaattatggaactatttatgaaagtctggtgctgcatggtcgcatcaattaaaaagagaaacttctactgaactatttgcaagttgcgtcgcatgcatggtcatagtcactgccatgacataatttgctagtgtgatgttgaaaagtgctcatcctaattgtttacctcacaattttaagcatgattgacaaaaggatacctataacagggacatttttagctatacgttatatatacccgtgcggtgtaacaggatgaaatatagggaacttggtttgaaattttttttctacaattttatagggacatttttagcttatatacccgtgcagtgtaacaggatgaaatatagggaacatgatttgattttttttctctatacccgtatgttgtaataggataaaatattgggaacgtggtttgatatttttttttctcacgtaattctctcgttggtcaattagggacgtggttcaattttcacttctctcgtatgtttctcgcggttggtcagtatttttggtacattggatttttggagtggtttttctctacgtgggatggtagtgaaattggaaggacatcggtgttttttataatagtagaaaaattccccgtcaaaaagcatcaaagaagtctacgacaatttcatggggcattctatctttgaactgtatgagtaattaatcctaaacatgaatggggttttctgattgggtgtgaaaaacattgagaaaaatggagagaagcatctcgcccaaaaaatttgagttctgattggacaggggacttttatacagtttcgtcactgtcgcatctctttctgccattattttcaataattatagcgtcctgtacgtttgatgattttccatgctgtactttctccatttcaaatatgttcttttcctgttacaatttcttccaaattagttgcgcgtgatggagatggttcatttgattttggctattttctttgcaaagccatgtgagtttggtacgacttggaagtccttgaatttaatgttagagcctgatgctctggtaccaattggagactatccaaacgttgtatttgactatatgtattagtacataagtatatcgaaaccatgtgtcttaaataggttagatctggcgtccatgacctcttacaacattgaccaaatgtgctagctatctagtgtctaatatttcagttcttttttattctggaatatagaaagtctcactatcaatcatcaatcaacatgttgaccttaacaaaatttagtgtgtgattcaagcattttttaatacctgaggcttacatcaaagagaggaatgaatggtcatgctgcctaggttaaattaggacaatgtaagataggatcaaacaagctgggaatcgattccaatcacctagctgtatacatgtatctaatttccaaaccttcaagaagttacaggacgtaatataggataggagaatagatgaataaacaaactgtaccttagtttggctgcaactgcaaaccaatagagcacaaccatgttgacagaaaaaaaaaatggagagcaataagtcagttcattatttagaaacaaaacgtagctatggatcttgtccaagttaatcaagttgccctttaaataggattatctcatacaaacagttgatcatggacatgagtaaagtagacgagcaaatatgaccaaagaa

SEQ ID NO: 57569 - DNA, 1554 bp, Oryza sativa
  unsure (1)..(1554): unsure at all n locations
ggcgcggctccnccgcgccggtggtcgccggcggcgaccatcggggcccgggcgcgccgcctcccgtcggctgtgccggggtgaccgccttcgggcgcgccccgcggctgccatgtggggcccggccgtcagccgcccgcgccctcgggtgcggctgacgcgcgggacccacggcgccggccggcgtaagccgcgtgcacccggtccaccgtggaccgagaggctgccgtgtgggccccactcccgtggacccggtccgcgcgctcctctctcccggctgacgcaataaatatgttttttaaattaaaatttaaatgaagaaattcgcaaatattcaattaaagagcatataaacttcaaatggccataacttggccatttgaactcggaattggaccgttcaagtctctaatttttccttaagaagtcaagaactcatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccaggcctatttacctttgttatgaccttattattgttattgttattatttccttgttcaccctagaataaacaaaaccccaactagtggacactctactcatggtaccactagtatgattttaggtagatgcttcgctgattaattaggtaacattaggtgattttacaactctagactttgggttattcatatcacctggacactatggaatggtttggttattgtggaattggcttcacaccgctccttctattcaaaatccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaagtgggattgggtcggtactcttgtctatggctaggatgggttggaaactatgtcacgtctttcgtctgtataccggggtggtatgtggcacgttggtacacgtgaagaagatgtgtcttgggggtaaagatgtacacctctgatcaagagtataaattctttattttttcccgcaaaaaatttttaaaggggggcccccccgcgccctggttttgggcaagccgagcaatgtacccaagttagtgttttaattcttaaaacctgctcaccact

SEQ ID NO: 57570 - DNA, 1137 bp, Oryza sativa
gtacccacgaattcagaacctcagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacgcgcctgca

SEQ ID NO: 57571 - DNA, 595 bp, Oryza sativa
tacttgtccgaggtataactggacgaattcgagggcgaattcgattgaaggagggaggaatgttatatcccgtgttctagagtatgattgggcgaattcgagggcgaattcgatcgaaggggggaagaatgtaataccccgagttttaaattaatatatctcgcggaatattagagcaaacgcgcaaaagttcaacttttaaaccattgttcgtataggcgatcgggaaccgtggatgcgtagagctcgccgagtagtgcaaaatagactataaatttatagtaatcggagtccgaacgaagtcccgaggattgaataatgtgagccgttagatcttatttagtctctttatataaccaaccaaaaaaaacaaacgaaaaaaaagaaacaggagcgattctcctgtaaccctagccgccgcacctcctgcactctgccgccgccgctgctgttcctctcttcaccggtgccgccgctggtgcagccgtcgccggtcgccacagccgtcgtcgtacgcaaccggtcgtttgtgagctactgttgtttctgctaatttccctgctgctgccgaaccctgctgttgccgatctgatct

SEQ ID NO: 57572 - DNA, 2324 bp, Oryza sativa
tttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattactattaccttgttcaccctagacaagcaaaacctcaactagtggacactttactcatggtatccctagtataaattttaggtagatgcttcgctttaattaggtaaccttaggtggttttacaactttagactttgggaaatattcatatcacttggatactctggaattgttggtttattgtggaattggcttcacaccgcccctctattcaaaatcccctaaaatggttttaggctgggctcggggtgcgtggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacatgctccagggcaaatgaaggctacacgagctgcggcccggtagtcgagatgtcaaaaagcacagggttggtgccctgctgcgaggggctcagttccgtctgcctgtcccgggggttccggccgtaggcgggattgggtcggtactcttgtctaaggctaggatgggttgtaaactatgtcacgtctttcgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaattttcccaagcccagatgaggagttcctggaagatgaaggctttggtgtctagctcgtgcctgccgtcaagtgcctgtggtcgtcgccctagtcttccgctgtttttcgttgtctttgagtgtgctgggccttcgttgcccgtgtaataatttttatttacgcttccgcttgttaaactctgaattgtatcaacttttggtgtaccttgcctcctgggacaaggattaatgcacgcacgtcaggaaagcccgttgggttatttccggtcgtgacaagttggtatcagagccttccttgaccctaggacgagccgtagatcccaagccttagctatattttcaaaaataaaaatcctttattatttgtgaaaacccgctattctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggcggagattccttccccgccgcttgccagaacgccgcttttcttcgcatcggaaccctttaccagcgcttcccggacgaggtgcagcactcgcctaacgt

SEQ ID NO: 57573 - DNA, 2061 bp, Oryza sativa
ataatggtaagcatataatgagcaccaccaagagagggcttacgagaaggcccccacaaatcagcatgtacataatcaagtatacctttggtgcgatgaactgaggtattgaattttaccctcttgtgcttaccaaaaacacagtactcacagaacttcatgttaccctgagtgcagccatccagcaggttcctcttcatcaattctgccataccaagttcactcatatgtccaagacgcatatgccacaggttagtcttactaggttcatctttagaaacaacagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagagagatgagatttctcgccatccctggtatgtgtctcacatctttcagcgtacgtgtcatgccatcatgagtcttgatctgaacggagccaatgcccacgatctcacgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactagtaacaacagaggccttaccatcagatttccttttctccttattctgcagcttccaacattcttcaatgaagtgatttttctttttgcaatacttacagaactttttacctctggatttagaacggcctctactctgactcttgtcacgatcattgctgacgttgtaggttttctgctcagatctgcctctgacctgcaatgcttcgcccttagaggacgacgcatcagactaaaccatacctttcatcttctccctgttttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccacagaaccactctcctgcaacttgtgcgagaacaacttcatcttgatatgcatcttactggttagatctttagacatgtagatcgattccagtttgagccaaagttctgcaacagtcttttcctgcaacacttcttacaaaatatcattagatatatgaagttggatcagcgacagagccttacgatctttccgcttctcctcagcggtccattcagtcgatttcttcttcccgaagctttccagcgcctcatcaagatccgaagtttgcgccagaacagcctgcatcttgacttgccacagcgagaatctcgtcttgtagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaaccacgggcgccagccagcaaaatatcttcactatatctgaggtgaggttacatcgccgcatggcggcttacaagaggtatatatatggtggaaccctaaaagggatgacgatccatatcgttccgctacggcagaagctggcctttattaagtgcaaatgaatttggatcacaactcaacagaaactatcccttttaaaaaataaggttcatacagagaaacgaaactatcccttttgaaaaaaggaatgctagtaggtgaaatgaagaaggttgtacggtcttgtgaattagattatcagtctcttcctcggtacagcacggcccaacaatcagaagaagggagcgaaaataggcttattccagccattagacacggtccaaagagatgagataggtaaaat

SEQ ID NO: 57574 - DNA, 1375 bp, Oryza sativa
acaagtacgagcggaataggatgacgtcacctcatggagcttgaggagctcgaggatggcgaggacgatgtcgttgacgtagcagaagccggaggcctcggacttcttggcgtggtgcaacccgccggaccagttgatggcgatgtcgtgggtgccgtggttgagcttgacggcggcgccgacggaggcccccgcgtaggtctggcagtaggcgtagaggccgtcgaagacggggcagtccgggccgatgttgaagcggcggagggcgcggacctggccgagctgggtctccggggtgacggcgcggaggaaggcgacgtagtcgtccgagtggaagcggcagaggtcgatgccgcgggcggggagcgggcggagcacctccatcttggccggggcgaggaggccgtagtgggcgagcagcgcgtgggtcatcctcacccggtggggcttcatcgggtggccctgaccgtagtagtagttgcccacctccgggtcgtagaagtagcacacccgccgcttctgcgcgtcgccgcacgacgccgacgccagcgagttgccgcccgcgcccgccgacgaggggtccatcgccgccgcctccgccgccgccgccgaattcggggttgggttttttctctctctcgaggtcgaggagctcgcgtgtgtgttgtggtcgggtgcttgctggagaaggaagcgaagcagaggaggcgagcgatgccgcgatgggcgaggaggggaagggggggtttatatacagggggcggagagatggagaggagacggctgtgtcaacaatgggctctcgcctctcggcgcctcgtcgttttccctgcacaaaatcaccgatcattaaaatttaaaatttaaatttaaaggtaattttatgatattttcaatgcaatttttctttttatatttgttttaagttttttagaacacgtgtataaaaaatttactcataaattattttttaaatcgttgatagattgttttaacttgcaatcagctcacgatcaattcagtggggccctagatattccatgaattatcagggtcaaggctaatataatttagtctaaagttaatcataagtctaaaatgatataatttttttatatatgtgttcttagtaaaatcatttctaaaatataactataatgcagaaaaaatcaactctaagtgttattcgaattttggttgtggcataagttgaaaaacaaacgatggagctttaatttcttaggtagtttcctttttgtttctgcaggggtggctcacatagctttattttttttctttgatattccgcaaggtatatacggcgatcatgatggtattggcattcaagagatattttacaactataaatttctac

SEQ ID NO: 57575 - DNA, 9283 bp, Oryza sativa
attcctgcagccccattggagaactttccaccgcccgtttatctatctattattatattattaaaagaatagaaaaaggagtctccacgttcgttctcatggcctagaaattctcacattaatcggagaaaaagaaaaagcagagtccatatagaaatacaatttagaaatagttgaaattcggaattaaaaaaataaggaatattagaagaggagactagagtccatatagaaatacaatttaaaaatagttgaaattcggaattaaaaaataaggaatattagaagaggagactagagtccatatagatatacaattagaaaataactgaaattaggaattaaaaataaggaatattagaagtagagtatatattccatatagaaatacaattaagaaaaaaaatagaaattcgaaattaaaaataaggaatattagaagtagagtatagagtccatataaaaatacaattaagaaaaaaaatagaaattcggaattaaaaaaggaatattagaagtagagtatagagtccatataggaatttaaaactaattaaaattcggaataaacataataaaattaaaagtaatgtttagagtccatataaaaatacaatttacaaataactaaaattcgaaattaataaaaacatgtgaagaagattttaaaatcaatataggaatataatttagaagtaactgaaatttgaaattaaaaattaaagaatattgaaagatgagtttagagtccacatagtaatacaattagaaataataaaaattcagaattaaaaaaaaagaaatattaaaagacaagtatagagtccatataggaatatatataatttacaaataatattaaaaataattaataactaacacatatataaaatacaatatgaatattacactttagtagtttcgtaaagttattgcaaaatttaaaattatattgtcattttaatatatttgaataatataatgagaaaacatatatgctattatatgagagaaaatataatgatgctggccgcgttatttgcgcgggccaccatgctagtttttttaaatatgcccgtcctacagtattttgaaagcaacgtcatctcctgtttcagacgagaaggtaacgatgggcatatttttgcaaaactttgaaataatagtttatttttgtaaatctttaagaaaaataaatatgaaaaatcctgtataatggtatgcgcaacgctaaaaacaacgcgttggattttaatcatgtctaaaatgctcaagcaaagcccagaattagcatactttgcttcgcagctaaaatattgacaattttaacaccggagggagtatgatgcaggtatggtagcatgctcatgcgatacaaacgggttcccgggccggggatgtgaggataatttttttattttttgaactttttaatttttatttttaaaataaatacttttgaaacttattttcaaaacctgaacttattggccatgccaggcatggcaaaacaatactgtcacatcggtttggctggtatgacaacgttatttggtcacacacaccccttgctgacgtcacagaataaaattgttacactcgttatgtgtggctcgtcagtattgtttttgctacgaatacgagctggtgtgagaaaaagttcatattatgaaaataagttttggagggtctattttaaaattaaaaaaataaaaaataaaataaaattaaggcgaggatgcgtgtgacaacaaatcaagtacaaagattccccacctttgcttgggcgtcgatctgtccgcacgcttggtccaaccctgctggaaacgtgggcaataattatctgtactgatgaaggtgagatgggtaaaggtttgtccatttttcaaactcataccatcaaacaaaaccaaatttattttaaactgaactacaaaatgatggccaatataatataatggttttacagtgtaaataattttattttaaattttaagatttaaagcgtaatatgggctgcgggagaactatataacaaaataatatatatcagttgtaaaatttattttcttgcttactattcaattttcttttatgtgttttctgtatcttgtaccttaatcaattattcataagttataaatgattgagatgcatggtgtggttttttggagaaaatgtgaatttacattctcaatgaatcatccaaaaccaaaagctaaaaaggtgacgttgtttagctagagaagagagaattagcattaactatatttagtgaggatggactttgtagatatatatgatttggattcttgttatataatacacatgggcattaaatgtaggaaaagaaaaggaaaacagaaaacagccaagatatggcgtactggaatggatcagatacagataagctaagctagcctcggaaaattgcttagaatattcgtcgacaaataatacttgaatcaaatcattgcgttttcttacgcacgccatactcctgtagatatcgacaggtatgctattcctttgacaggactctatgtactcaatttaatttcaagagtgaagtatttatggtgtgttcagttcacgttaaaattggaagtttggttgaaattggaagtttggttgaaattgaaacgatgtgacggaaatgttggaagtttatgtgtagaaaagtttcgatgtgatgaaaaagttggaagtttgaagaaaaagtttggaactaaactcggccttatgaaagttgtgggacgatggaaacttcgcttcacctttccagtttattttcttatcccattttattttttttatgaagctaaaatcgttttgttagttctatgtttaaaagaagctaaagctctactaccaatctaccaaagagacctcgtatctcgatctcgatcggaacgtgactcagctgacgcacgcaccgaatggggtcatgactgacgagtgttggagccaaacggcatgccagactggcaaaaggcacaagggatatcatatacagtgggcgtcacgctgtatggataattcattttatcgttttatgaccagtagcacgtactccctccgtcccaaacaaaaaaaaataaaagacaaatcctaagttttcgtgtccaacattttgaccgtccatcttatttaaaaaaattataaaaaaaaattaaaaagacaagtcacgcataaagtattaatcatgttttatcatctaacagcaatgaaaatactaattataaaaaaatttcatataaaacggacattcaaacgttggatatggaaatccagtgtttgtcttttttttttttttgatggagagagtatacgcatgtatgtgtgttcatgccaattaaagtgggccgggagaaaagcgcaaatctagggcaaaaattccatcgtacgaaaattcaagttcaaccaggcttggacaccaggttttggggttgccttaatgcaggttatcaaatgttagagctgaaggtatagtactcaacattatgtactgcaggtaaaaaatgggtgttttttcaatcttattaaaatgggtgttttttaatcttattaaatattatattttaagtaagtggattaggatttaggtcctctaatattttgggccttgtggtgattggcaacacggcactatcttaagggtaagtttacagtttatagaaaagcatggatgcctaagaacggaagcatgcctggggtaactaatgcttgaccggttgacattaggcctgtctctaaaatcttgtttaaattttgttaaatcatcgtgtaaattttgtagaaaaccaaaactttgttagttaagcctatgttgatcttaaccctagtcttttgtaatttctaactccgtcactaccgatgccaacgaaaaaataagttggttagagaattgagagacacaaacatatatgattggatataattgacgataatcacttttcccaaggaaacaacaaaactagtagcgatgtgtgaaaaccacggtgtcaatgttgcaatgggaaagagccatcatggttagacaaggtgcatatcaggactacctacggtctactagacgctcaagccagtagattccgtaagagggttgattggggataagccactgtggagtctatggtcacaccaaaaggctactcctcatataagtccgttgagcatattcttcttcttcgaggtaaacttgaggaggtggacaaggagttcaagcaccttagaaaatctcttattttacacatatattgatgtgaaattattccctctcaattttcttcaattccattcaaaccgaacaagtcccgaaggaggaattagacgaataagatttcaatcaatcatgagaaaactcatccccgttgacatagcaatagcaccaaaacccaagtttcaccgtcgaacacctcgggggtttaggttgaaaccacacaccgcttgccattacaccatcaagtacatcacagagctagctagctgctcgcaatctcactatctcagtacccggtggctggtttggcgaccatccatgtgtggaggatcttgccggcgacgtcgtagaaggcgaggctagcctccgccgccgtcagccgcagcgacatgaatccctgcccgtcgtagaagaactccaccttgtccgtgttcgccgtctgcaccccgcgccacgccttcgacccggcccgctcgtcaggtactgaatcttgctgcaatttatttataagttttttttgttcaattcagagtttcagactaggcataaattcagacgaattttatcgagtttgcagagaaattccggcaaattctttacctgtccctgctgctgatgtgctcgaggcagtggtcgtggccgttgaggtagagatcaactccatgtgcctgcaatttttttcatacaaatttacaccatggtgaaaagaagttcagaatatatatttcagatcaccaactcgagtcaagaaatgttggaagcatcggaggtgtggtggtagagtcatgcgtgtatgactccacccataggatggatttaaattccggggttcacaactactgcgtatacgtaggtggcctttcaatagaaatttagtgagatcagagatatatcactagttttcatttattagagtatgtgttagggatgcattcacggaatgtgagcctatataggggtgtgcgcgtatacgtctgccgcgtaatcgaaaaaagaaaaagaaatgcatatactactttgaggattggaaggagatgctccaggagctccttggtatcgccgtgctggctgacgctcctgatggcgtggtgtccgaccacgatcttccacggcgctttggactgctccagtgcatcctccagatcctgaaaacaaaaaaggaattaaattaacacacaagttatgaaaaaaatgagcaaataattcatcaggaactgcaggatcagagcttaatttgttgggattaaatgattaattaatttaccttgaggacatttgcaatgtaggtttcacggggagaaacccctctccagtcgtacttgctgttcttgggatcagtccagtacttgagcacgaacggcgtcgtgtccacgaagaagaaatccgcgatctctgatcagttttaaattttttttcattcaaaaccaaaaccaaaccaacacaaaaatgtgaacgaaatacatataaacacatatccaattcttgatctcaaatggtgccagctaatttaacggatcagagtaaaagatgctaaagattgaatcaagacaaagactctgtcagactgtcagtgtcgtttactcacctgcgctaacgacgaaggacttgatgcagatccagcggctgtcgaccttgcgaagaacagggctcagctgggcgagggcgtcgcccctgtagtcatggttgccaagaactgcatgtttgttatcaatatcgaaattatcaattatcaccatacacaaatagaaaatcaataatctatttctctttcttcagagtaattcagatcagtgcatgaaatttgatggtggcattcagataatcagatcgcattgcatttgatagtgtagtggctgggaaagtgcggtttcaactttgaagttctgtgtttaatttctatcacgctcactatttctttttaaaaaatatttagagagacgtctctgtctccaaattttttttatcgcattgcattttggtgtggtagtagcattcagataagcagattgcattgcgttggattattacttaccggtgtaccatggcttgtggaggctcttggcggtgtagatgtcggagaaggattcttcgaaggccttatcatcgacgccggtgaggccgttcttgtagaagttgtcgccggtggagatgacgaagtcgatgtccatcttctcccctactattcccatctgcatgcacacattttgttgctcatttaattttgttcacttatgtgttgtgcattgggatgcaaaggattggtctcaattcgtcacatactcatatttatttagggcatgttcactttgatgccaaaaaaaaaccttatcaattttggcatagttatcaaaattttggcaacttaccaaaattttcgtatgatttcgggcctgttcactttgatgccaaaaaaaaaccttaccaaattttggcattaccatttcttatatagttaccaaaaatttggcagcaaactaaatgtagccactttctttttgacaactttaccaaaatttggtaagtttgaaaatggcatcaaagtgaacaggcccttcttatatagttaccaaaatttggtagcaaactaaatctagctcttttttggcaactttaccaaaatttggtaagattgaaaatggcatcaaagtgaatatgcccttattatgttgaaaaacgaaaggaggttgttataaactcttcaaagtcaaaattaaattatgttgactgcacacatcctaaagcgtcattcctttttaaaatatactattatcaactgagctagatagatgtgaaaaatccacacacttgcatctagttctatccagggttcccaaaccgtcgtaggtacggttaccgcgcggtaaccgcaataaccatgaaaaaccgtacgaaaccgtgcaaaatttatcaaaaattcaaattattttttaaatttatttgaatctaaggaggttaccacggtatttctattaccgtacctccgcggtaaggccggtaaccgcggtaaccgcgcggttaccaacggtttgggaaacctggttctatcaccactagaataacaattttgtttttttcaaataacaaaaatgttagatatcaaggaggaaattagtatcaattgagtaaagaagataaaaggtgaaaaggcgccctagccagctatgcggctgagttcgggtgtgaggattaacaaccttcactcctagcacctaaaacggaacagttaattagtgtgtaattaattaagtgttaactatttttttaaaaaaacaatatgatttaaagcaactttcctatacaacgtttagccgtttgaaaagcgtgcctgcggaggaaaggtggcgccgaatacagccgtacgtgtagtttaaagtaacttttcgcacattttcttctttaatataatataataccaacaaatttgctctgatttttaatcagtatcttttgatacgcacgtgatagatagtgagtagatactacactctgttttcttccttaaaaaaacaagagagcactaaacatgagcttaatttacaattccacatagcctccaaaaccaacctcctcgttttcttgatttcttctaccttaacccacattgcattacagtatttcataattaggccattaataattaactagccacatttagcaaaacgaaatcatcaccgccaactaatcaatcaaaatcaatcgattacctgcgcggcgaccatcgactggttgtacgcgccgcggcgcccccagtcgccgacggcgaggaggctcagcgacccgtcgcccttgcgcgggtgctccatccgcggcatctccgccgccgcagttgccgcagcgacggcgacgaggaagacgaggagtgtaataactggagcatccatggccgatcgagcagctcgatcgccggccgccggcggcgctccttcacttgctcgtcgcgtggagaggagaggaggctatggctggctcgaggtggaagaagagggtgcgtgcgtgtatttatagggggagaatggcaatggtggtaaatattaggagaaaaaaaaagaggagtggcaatggaggtaaatataattaggaaaacggcacggggacaatgtgcggctgcaggtgggcccggatggggggaatggtgggtggggcccacggtatgagacttggaggttttgctagattgccaggtcacgctttgcctttttgcgcgggaaaataagtacggcacgcatgcttggaacgcatgaattgaacatgttaattttgtctacaatcatgcaacatggaagtgaaagttgtagaaatgagtgaaacaatccattaattaagaagtcatttgaaacatgtaggtggaagtaattcatgatcatcgcaatggctagaaattactttcattatctaaaaccgtaataaaatgattgttaaattctgttattagccgttattgtttgaatccatatgtttgtaataaaaaagtacacctataacgttctatgactagcaagtcgctctacctttgacaagatcggtcaatagttgagtgcagccgcagaaaccacctatgccccaatgatctatgatgctatttcaacaatgtggtcatctatatgactatataatgtagaaacggttggaaataataaaaaaacaaaactacctagattgtagagccagccaaaatatggtgctcgaagctgcttctcatactagagagtctcagcatacaatatttgatgatcaacccctcttttcatgtttggctcacagttgtttcttctcccattcccattttgaacttgtaaggttgcagctcgcaatttctctcagctgtttattttgttcccattgggttcacccctttcggctttcctacctatactttccaaccttcatttaattgattgactagctgacacttgcctccttttcaataaaaagattggaaattcaatctgggtagttagggattaagattcaacactaacggcaaagtagaaatttttcacacaaattaagaaaatgaagtgtatgttttgcaagtaaatttgtatgttgcatctaagctga

SEQ ID NO: 57576 - DNA, 1683 bp, Oryza sativa
  unsure (1)..(1683): unsure at all n locations
gcgtttccaaagntcattgnagngccnnccgcgnggtgggtataggcccccccccancgannacaacccctaatgaaccaatttaatagcagngatttttttattaataatagcagncgcgggggggggggtttaatcgtcagctctctttctctgcttgctggttctgtgtgggggtttcagatggtgacgaccaggagaaatgttaacaccggggaaggcaaccaacccgagggcagcaaccccaacccccaagggaatccacctccaccaccaccaccagacaccaacgccattctcacccagatcctcgcccaacaagccaacatgatgaatactttcctccaccacctccaaaacccgccacaacagaatgctccaccaccaccaccccaacactctaaactcgccgagttcctccgcatccgcccacctaccttctctagctccaacaaccccgtggatgcgttggattggttgcatgccgtggggaagaagctggacactgtgcagtgcagtgatgaagagaaagtcatcttcgccgctcaccagctgcaggggcccgcatctctatggtgggaccacttccaggctacgcagccagaggggcaaccgattacttgggctcgcttcaccgccgctttccggagaacccatgtgcccgctggagtcgtggctcttaagaaaagggaattccgggagttgaagcaaggcaaccgctccgtgatggagtatttgcacgagttcaacaatctggcccgttatgccccggaggatgtgcgggaagatgaggagaagcaagagaagttcttggcaggaatggaccctgagctgtctgttcgtctagtctctggagactatccggatttccaacgtctggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcaacagcagcagcagcagcaacctcgcccagcgcctcgacctcaattcgtggtgcgcgtcccacagccgcagcagcagcagaatcagcaagggactcgtgcaccccgtcctcctacgccaactgtgcagcccgttcaaggccgcagggacgcttcaggtccgcagcggctgtgcttcaactgcttcgagcccgggcactttgcggataaatgcccaaagccaaggcgtcagcaaggccaagcgcctccccgctccaacaacggcgggaaggatgtcattcggggccgtgtgaaccacgtgacggccgaggacgtgctgacgactccagacgtcatcgttggtacgttcctcgttcattccatccctgctacaattttgttcgactcgggagcttcccactcgtttatatctgtgccattcgtggggagaaatcagttgggggtagaaaggcttagaaaccctctgctcatcaccacccctggcggggttatgacagcaaagtattatagccctgccgttcctatagaaattcaggggattccttttccctcggacctgattcttctagacacaaagaacttggatnnnnnnnnnnnnnnnnnnnnnnnnnnnnnnnnnnnnnnnnnnnnnnnnnnnnnnnnnagaggttgacagcaaanaacgtcg

SEQ ID NO: 57577 - DNA, 4078 bp, Oryza sativa
attcctgcaccccacaaatctatagcctaattaatccatgattagcctatgtaatgctacagtaaacatgtgctaattatggattaatttggcttaaaaaattatctcgcagattaactcttatttatgcaattagttttgtaagtagtttatatttaatactccaaattagtgttctaacatccgatgtgacatagactaaagtttagtccctaaatccaaacaccctctttagtaaagtaagggagtgacactccctctatttcgttctatctgtccctgaccatgtggcaaaaatacatgtgtggcttggctttatcagtttcgcatcagcacaatccaatagataactaaaaccccatgtcatgggctatttttgagttatactggatggcatccgcgctttgcggtagaatatatgaatgagtatatgttaaatattgtacaaatgatggatggatttggattgaaatatttttaaaatgatttgagaatgatgatttataatgtatatgccgagttttagaatgtaatagttactatgtttgcatgttgagttttaagtgtttagtaagttgatctggcatacttgcatgttaggctttagaaataataataaatacaatttttacatgttaaattttaggtgttcagtgggttataactaattaataatatatttctggctgacaactcaaatgcaggagcaaattaagccattttgttagcatcatgtccaataaaaaaactaatgggctttgaaatggcccatccaacaatgttttttaacacacacacacaattagtccatttagccagcaatactctttagagctcagtggttgcattgagccctaacaggctgacagtggtagacgactgatcatgtgaattcaaagattgattattcattttctatcgtgaacgtatctgtagttgttgggggtcctaatttgtggttatttttgtacaaaatttagattaggtgtgggtgcaatgcctgtgaccatgtgctcataattttgattttcttttttcaaaaataaaaacatagagtttgcagcaattatatgtcggttccttcatatatgaaatccgcatttgctgaatttctcaagaaggagagttagattttgttttttgagggaagagttagataattttaaaaaagattaattagctcctcaccaaaaaaaaggggatcaagtagcagtttggattaccagatgaaacgacattattcatttctgaactacttgaaacaaaagcatttgtacatattttttcgacataatggataaaaatcagatctcatataagcattagcatatacgcacactgaatatcatttagatagccattataacttatcccatgaacttaggatgcaattacaaacagcaacattcttgcatacttacgtatacaaacacacacactatttatacaccgtgcatcttttgtcacagtatatatatcgataactgaagcagtacattgactgttccaatttcacacacataagcagctaattaacacaataattaagtgttgactttgatcactagttggtggaggttgacttggcgagctgccagctgtacaggacggcgccggtgacgtcatagaaggcgaagctggcctccgccatcgtcagctgcatcgacaggaacccttgcccgtcgtagatgaactccagcttgtccgaggtttgcttaaacttccccgcccacgccctcgacccgcccccgctcgtgatgaattcaagtgggctataatttttatttcatcgaattcgataagaaaaagaatttaaacttaacaccaatggtagctagaatggtaaccaatgtaatagtggtatgtgctaaaggacaaattttacatttctcgaatactaaattttgcactacaaaatatatgtgacacctattgatgcctatcaaattttacatgataaaaaaatgatatttgcatacaaaatataatgcccagtacctttcaagatcgtaaaacttttttggtgctaaagttataattacctgtcaatgctggtgatgcgctgcaaacaatgatcatggccgttgatgtacatgtcagccccataggtctgaagttttcgaaagaaaaaaaaaggagtgtttcggtcagggtttggatttaatttgtgtggattttgccagagaatttgaactcagctcatacgtgaacttaaactgatcgatgattcaatgtatagggtgtaccttgaggacagggaggagcatggcgacgaggtcggtggtgttgccgtgctcgcagccgctgctgatggtgtggtgtccaaccacgatcttccacgtcgcattcgactgcgacatcgcgtctcctaaatcctgcatccgtgcaagcaaccgcgattaaataacagctctagttcgtgtacatatgaactatatagcccgccagtaagaatgctttcgtttgtaaaaatcatttttctagtagtgtatagtttctgtttaagcaaaggcctagtttacccaataacttactgtgagtagagtggagaggtaggtgtcacgaggggcgacctgtctccagtcgaacttgctctcgttccaatacttctgcacgaatggcaccgtgtccaccaagaagaactccgcgatatctttaatttcatatattttaaaaaatgagcaattgttacacatatttctttttcttcttcagacgtatcgtcctatggaaagcttttggatgaattggttggtatgatacgacgatgtgtcatatgcaagtacatacctgagtcgacgatgaaggacttgttaatggaggtccaacggctatcgacggcgcgaatggcggggctctgctgtgcgagggcatctccagtgtagtcatggttgccgagaactatacacatgcaattgcgcatataaatatatgtgggtatgagagatgaggaattttacggtacttgagaaaacatttggatttttttaaaaaaaatattttgatacatcgagttacctgatatcaaattttatattagaaaaatatggtacctcctattttttttttttaaggatagtaaaattaactacagaagaccaatctagatcaagacacataaccgatgagatcttgtttatcattgacatctcaatatgtatgtatatggtggacataatattattgttgcaattattattaccaatgtaccaaggcttctggaggctatcagcggtgtagatgttggtgaaggactcctggaagctggccgtgtcgttgtcgccggtgaggccatcgttgtagaaattgtcgccggtggagaggatgaagtcggcagccaactcctccccgatcacgcccatctgcatttacaattcaagtacacacattgtggccagtctttgataggcatgcatgagctggatggcaacttaattgtcatgcatattactaatcaattttgattttgatttggagggaaatgataagctagttattatatccacattagctaattaatttagctataggttcaagttgactggatttttcacattttggtccttttgaaaaacttatttcgcaaatagacccctgaaaaaacatgtcccagaaatagtcctttttggggcgccagagtgggacggcgccagcctctctggcgccgtcctcctgccaccgtggcgcacgcgaaccgacgtggcaggaggaggctagcgccgccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagt

SEQ ID NO: 57578 - DNA, 6083 bp, Oryza sativa
ctccccctagccacctcagcatcgccccgccacgtgggcagggggacggcgccaaagaggctggcgccgtcctgttgaacgacggcgccagccactctggcgccccaaaaaggactatttttaggataagtttttttaggagtctatttacgaaataagttttttaaaaggaccaaaatgtgaaaaatccagttcaagttgacacatgcagggagctagctagtagtagctctcttggggagacccacccaatcaatttaagtttgtggccaacaataatttgaatattgtccatctcaattaatttgaactcgtttgtttgcttcagaaatagcactatataatagtgacatgccttacctaacaaatactttcggctacttatgtaaatgaagaccccatgcatgataagcttcagggcaccaaacatgcatgcattcacattaataataactaaaatttgttagctagttcattattggtgctcattaataggggcctccaaaggcattgagagaagtctttgaggtcaaccgtagtatggtagagtcgatatcgttcacagactaattaatgttgtacttctccatttgtccataaataattgatgggtgccaagatccaatttaacttgcaaaatttgaccatatatagcctatataatatagttagtttcaaaaagtaatgacttcagatatatcttaaaaagtactttgtaatctcctaaacttattgtattttataaatttattctaatataaattgtgcacacgtccaaaagttgaaaaagaaagttttaccagatgaagtactccatccgttgctctattaggatatcatttatgtaataaaaaacataatcataagtaacttaaatacgaatatcataaatttagttagttttttgtcaaaagaaattatatatcctactagtttgttggtcaaaggtttgtcctaccgaaacaaacaaataaacaatatacactttatattttgaaacggatggagtattaatttgtagacaataatcaccgatgacttcatattttcccacgaaaacaaatatatggaaggttgatgtcagttattgtcacctattctactccacacagttgagccttctcctggccccaatataccatgctgccaaagttgaagctatttcatggctcgtgctctataaacagacctggcagctgggtacgtaaaatattaatttgagatagagacatagagttgcctctagtagatctataatcaaaacaattaatgtctacagtaatagcggtcagcgtacgtagtgttagctctttggcttgtgcaagtgttgtcgatctgtagtggttttattttcttttcctgattatagctttccagggctgttgtcttgtaattttttttaatataaaccactgcactttcaaaaaatataatcaaaacaataactacaacggccagctattacactatatggcagccaacaaaatcagtacgagctacactagtactctatgttcttttgttttttttaaaaaaaaagaatattgtgcttgaatataaagaatattgtctctacatataaaggaataatcataggcaggccgttatacagttattctgcaaaattgccttgcggtcagcttaatcatgcatccacctacaataatatggtttcacgaataaattttctacaataatatcatttcacgaacaaattttctacagattgactgtatatagagaaagccattattaaataaacctacggataagttggttgcttgagaaaatcacttttgtccgcctacaaaaatgtaatatgcatattctaattatgtggtcttaagcaccaaaatataagcacttctaaaatactatttatcttatcaaccattccccatttaatatttttcccatatataaccctaaccactctcccatcccaatcatatctagggccatgcattataatcttttctactcaaccttattctttgttaaaactgtaaaataaacatattttgcaatggagctagggagtatatatgcatgtatatatattagctagccctaattaaaaattactcaaagaaatggggaaaaaaaagagtgcagcggtttgaaagcgtggtcgatccacgatcagttggtctcacatcacaaataagcaatgtacataccggttatacctactagtcctctactacctgtattgtagctctacaagagcaataattgatcgacaacataatacattcgtgagcgatggattgatcgaccgatcaagcattgccgccaccggaaaaaaactatagaggcggcgcctaaatttacttcgttgtcagctacacacacgagctcgtaaattcatttataagttaaataaatagataagtcgggtctcagacatgcaatgtaatgtatatacctgggtggcaaccaacgtctggttgtactgccccttcctcccccagtcgccaacgacgagcaccgccagcgacccgtcctccttcgtcgggtgctccacccgagctagctcccccgccaccggcgacgccaccatcacaccaaccatgacgaccaccgcaaccaccgccgccgccgaccaaccacacctcatcatcattctcctcctcaccaccactacacagctccggcgagatgatcgtgagagatagatgatcgatggagaattggagatggcgatcgacttcgaattttgagagaacgaactcgcgggaaagcctactttatagcgacggtcagctggtgccgatgtgaggctgcaggtgggccccacaccagcgtcggttggattcaaagttgcatatataattatgcctatatccatcgtacggctgtggtacgagccacggatcacccaacggcgcggatggacggatgggatcatcgaagctagcttagctcgtacaggatgagtaattaagagaggaagactgcacgccttgtgtttcgtccgatcgagtacgaagttgttaactctctttgaaacaacgtgcgccattaatttattactgttagtggtttttgtaattgtttcgtaaagccatatatatgtgtgtgtgtgtgtgttgcattaattaatttgtgctggtacatacttgtctacgtgtacatgtgtactatgttttgaattaataataattgattagtttgagaaggctctagatgcattggataaggttaaagttagttgattagggttgcatcaagtgattaattttgggctttcatggccggagagggtacgcttactaggctagggcccagggagaaaatgggccacgctgcgcctaccggcttgattaattattagttagtggttaattaattaatgcatcgtaaaggagcacttaacctctaataaatagttttcgacttttttttatctcactttacacaccacatgagaactgctgaatacggctattactactagtatttaacttgctgggagtatatttttttcttatttactatattcaagtaattaaattcaacgcaatacaggaattcagctgatacatacgattaaggccctgctcttttctgattaaaatttgttagcatgcttttctgctaacggtgtgttttgtatgaaaattttctatatacaagttgttttaaaatatcaaatatatccattcactactggagaagtggtttttagtcccggtttgcaacttcctttactcccgggttgcaaactagaaccctgaatccgggactaaagatgggcatcatctttagtcccggttgaaataaccggactaatacgggactaaaaataaaagtgccacgtggttggcgcttttttttttgctacttgcatatttatttcacaccaaactcaacaacaaaatcatccacaaattgacatcacagattcatccgcaacttcatagagacatctaaaaatcatccacaaatttacatcacaaaatcatctacaaattcaaaaaaacatctaaaaatcacccacaaatttacatcacaaaatcatccccaaaatcatcacaaagtaatcgcctctctgcaaatgcccgccgctcgctcgaggataagggagaaaaagaaaaggataaggaggaaagagagagtggagagaggaggaaagggagaaggaattgtttgcgcgcgaggatgagaggataagggtgagggattatatactcgcgttgaattttaccgggactaaaagatagagagggacaggacgatttctgaatcgggaataaaaattatctttagtccggttggtaacaccaaccgggaccaaagatcataaaagtgaggtgggcttgtcaaccaggacaaaaaatgatttttaatcccgattactattggaaccgggactattgtggttttagaccgacctagcaaagatcagttctccagtggtgattaatttgttatgtttgtgataattaaaacttaattaatcatatactaatgactttctttttttacatgcgccgacttaatctttatcggttttaaacaccacctaagagcaagaagttaaaaattaaaatattgaatatatcgatacagtaacttggctcgatcggtagtcgatgtgtttgcatggtgtggttcagatgacagtaatgtcagaaattttgctatgtcagccatccatctaggcgaggatgccacatcagttatatggaacacccctgtgtaaaaccctcctttttttttattttagataatggaatataatatcccggcctttgctcaagaagagctacagccaattattacaaaatagcactcgagataatagtatagttcaaataaaatagaacacacttaaataggaaaagccaaaataagaagaacacatttattccagcctatctgtgaatctccattcatagttggcataaagttgcataaccattgcaaaaccctcctagaaggggttgacggagcttggggctcctcaccgggagaccgcgcaggcccccctttgccggttcggccgggggcgctaagtgaggttcttcgccctcgatctgtggaatattcgcgagagagcaaatgcacgagacacgggcgatgtagacaggttcgggccgctgagaagcgtaataccctactcctgtgttctggtggatctgtgtgtgaaggagttacagagagctggagagcaagggagttcaggctctaaaacccctcttcctgtttctctcctctacgagctaaggtcttctcagagtcgtccctcctattcttcttctggatctcccaaaaaaaaccccttttttcagtgggcaaggtcctccttttatatctcaaggggataccacatgcaccacttctacctacccttcttttgggtggggactcaccctatcttgaccagaacttggctcgcgccttcgcttgaaagctaaatcacagcttgtccttgagtgaggcccagcgccgtcactcacctgacccaggggatcaccctgtcattccttcattaatgggcggagatttgcaatggccgctgtccgaatgacccctccgatgggatgggtcatacctacctccactttgccggaaacggatgcaacgtgggagcacggtttgtttgccgatgacgtgaccggcgtcagaccagtcacagaccggtcattcttgtccaccacgtgtcagtttagcatgccgcacgtctgtccctcttcatacaatgacttccttgcaatggttgcgatgaagcctggaatgtatctggccgggactggcgtgctaactccaggagttagcacgccggctccggctagggacaagtgcctggaggctctcatcattccgatgggacggggcgaggcgtgtgacaggccgcctgctgccacctaacccacgatctgaccggtctgtgaccggtcacatactgcgaccggttacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggggcgccccagccatcggggcc

SEQ ID NO: 57579 - DNA, 1536 bp, Oryza sativa
ttcaattttgtcccaatgtgtcaaatttagcattacattccctggtgctttagtgaatttaatgttcatgctgttaatctgacgggacaatggcttagttccttgctgcttcaatgtctgcactgaagcattggagctaggcttcaaagttgctatatgaattgtcagagtctgagataacagatgttggcctaaagcaaggcactcaaatgcctaccgcagcatcaacttctaagctctcccactgaacttgacctcctcgccatctgtcactatcgtcagtctcggcaatactgttgtagccaccgccgtcagacttgacctacccgttgtagcaaccgtcgaactcgacttcccccacggcgtagctgttgggctcgacccccatcactacagccaccgcggattcgacctccccagctccccgccgctatgaacacctctcagattcgtttcacagaaaacttatacatgatcgaaataccaaacaatagaaggggttttctgataaaatagggccattgcttacgagcaggcaaacctgtccttcttacgtgaatgcttagttggtggtctactcatcatccaactcagcaaaattagatttgctattctatttagtcatagtccgcacgcacctatacaagtttgtgcaccaaaacaagagttttgtaagtttttacactaaattgcacccacctaacaagtttgtgtaccgcgggcgcaatttactcttttttttcaaagactagctaaatgtatgtgctttgctacgtatagataaaaatgacaaatttcataatattgcctaaataaagagtaacatattttcatgaaaagtatatattacccgcctttttttatagagaataccccttaatttaatttcaaatgtggttatccacttagatttagttgttatgcgatattaaaatgtttaaggggtaatatgtaaaatctacaataagagtgggtggggagtctttttaaggagtatagatcgatgtcattgtagatataagtggaagttctcaattttcatctagaaatattgggtggctaaaagcaagtttatttatttttttgaataggagaaaaactaagtttatccgataacgagacttataaattatactaattaggcaaagacgcaaaacaaggcaatccagtgctcaaaactcatacccaataaatatttcatataactattggggaatatgaccactttctagttgtacaccaattattgcctaagcatttgtttcaacatatcattgataatacaggattaatggacaatctttttaagtacataggtaatgatagacacacagtgctaccaatccttttggcgcttgtacttcaattatctatcatgacacatacctatttacaagtgattgaagaaatgtagaaacgcaacatctctagctctctgcatatgtatggattaaaactgtattagtgttagcatggactaagtcaacatctaaaaaaatacacatctttatagggaaatatggaagtgtggtcatg

SEQ ID NO: 57580 - DNA, 2689 bp, Oryza sativa
ggtatctaccaccctgaaaatcacacaaaaatgtttgattttctagatattatgtttcttttcatacttagtattgcattagttaagtctgatctattaagtcgtgcttagaaccataatctctagcccgcttcttgattgctaataaggatttcattgaggtttcagcaaatgagttatctggacgttgcttcggcttacaaggattgcatacaagttggatttagcccgttgcaacaaaggtttcattgtttatctaatcttgtggattttatgacatcggacattcagccgatgtatgttttaaccttcggatcagtgcttattctattatatcattgttagccgattggtttctactggatgttattattgttttattacattgctatcaatcaattgtatttatatcgttatctatattggacatatatccgattgctcaaaaccctattgacatcggctggtatcggcatcagctgaattactccatcggcttgacaaccaattggcttattgatatgctatttgtatatcttgtcagttgcatgatcaaactgactggcacgcccgtatcttatcaaccggtggatctgcacagaagctaagcagatctcccaggccgttgtgttcgtcgacctagtacgtgccaacacagacccgacattatcagccaaacgtggatttttttgtcaacacataacacatagagaatcatgaagaagactctgaccatgccaatacgaagcgtggcagggaagaaaaaaaaggaagatcatcattacaaataatcttataatatgtatgagtaattgaaacaaaatttataatgaacagacaaacaatccttcaactggctatcatatctgttactccctccgggttgataatacgtgtcgttttggacaaaaatgatatttaaaaatatttttgaccactatttttcttttacaatatatatagaaatatcaatacatatgattttatgaaaagactttttaatactaatctatacatatggtcttcatatgtttaaagtttttaaagtttaataatagacttgttcaaaatgacaagtattattactcgtaaggagtaacttcttattagagtttttaacagtttttattacaacctctgttgatcacagctgaatcatttcctcgttcaagtgttcttgttgtgccatcagaggtgttccttctctgatcagttgcctggctgcttatttctttctataggagtgacaggagtttcacgcggtccatccccagggtctgaaatgatgtaagtaataaactttaggcaaaatttgctacaggatactcaaagattgtggtctttgctgtgagacacccgaagatcgtgtatttgctcgtggacaccgtaaaaaagtggtaattagctactggacactcctcccattattttattattttcgatgaaaacggagagagaaacttaagttaaagacaagtttgtccatgggcccacttgtcaatctctctttctctgttcttcttcgacagcaacgcgaaggttttgccggggggcgcgaggcgctctacctcgctctattacggcctcctcgacctcttccgcgaggcacggtgggggccgttcgacggggaccagctgcatctggcggcgtccatggcagggaacgccgcgggcgacgggacggctgtccgcgccgcgcccgacggcggctgctgcgtcgcgcacggcagcgctgtgcgcgtgtacaaatgagcgatggaggagcggcggcgacctgcgcgtgataactgccttcccggcgacctgcgccacctcttccgcatcgcgcgtgtacaactggagatggcaggcgcgaatcggccgcgtctcgggcaacaagggacattcattgagtgttcttcttcctccccaatctctgcaactgcaccatgatccactagtagttattcttgtccggattcttctctacatgaatggccatatcatgcatcatgtgatcgatcagcaatgagcagcaaagtgtgtatgaggttggctttgcagaggctgtcacggtttaaggatgcagggtgcatcctgtcacaatgatcataagacctcagtcagctataggtggcattggcgtctgggactgcaccaccggcgagcaggccgacttcttctacgagccgccgggctgtgcactcggcgacgccgacaagctccagtgactcgacggcacgagcacgctcatggcagcgaccatgttcccacggacagacacctccttcatcatcctgctggacttccgggacaagaagaacgtggcctggtcgtggtccgacgtcggcacgccggcgtcgctggaggacaagaacgtgctgcacgccatcgcgatggaggacgggcggtgcgcgcgccccctctcccccgctgccgtgccgcgcgccgctactctccgccgccgagctcgccatcgcgtcggccgtctctctccctctctccagcgccgccgccccctgctccgccgccggccgcctcacgcaagtctgccaccacgcctgctcgagagaggagagaaagaagagaaaaagaaaggatgtggggcctacaccgccccgccgccgcctcgccatggctgagccgtccaggctcgggccagccgccgtcgcacactcgcacctctgctctgctgcaaggaagaagaagg

SEQ ID NO: 57581 - DNA, 9802 bp, Oryza sativa
  unsure (1)..(9802): unsure at all n locations
gtgtatatatggatgagggagcgaaatatttagtggagcgcccgagaaaatgtagagtaagccacagcccatgcaggtgagagagaaatgatcacaactttaacagcgatgcgacaaagagaagcaaccacctccttatataattcggcgtatcaagagtaacgagcgcggtatcaagaatagaaagaaagatttactaaggtgggagaccacataaaagagagcacgcgttgaacaagatgttcctgacacatagaaaaatttggagcgttatatatagcccgcttagaccaaaaaccaatccatcttataagaggggctaataaaaagttggatattagttaacccggaaaggcccaagacgcaggtaaattttgaacagagttaaggtaatttgtataattacgtaccctctaaaaggctgatatagggcgcgcttataaaagcaggccctattaggacaacttaaagagggtgatattgaaaagggcactttggtacaccatcattcctaaggttggtaaaatgtacaaaatttcggccaaataacgcagaccccgatgtagaggccataaccgtttttccctgtccaagaggtactcaagcaagaagtccaaattgtgcactgggggatcatcaagcccacaaaagtgtgtcaaagtgggtacagcaggcaggattctgattcatccaccgaatcaatgtccggaaaatgcggaaccatgacccagctttagcgaaggaccacagaagcaaccccatgctgtttttctaaaggtgatctcaggtgaaatcagcgtggaaccggtgccacaaattaaggatatagctggagaacagtacccattcaatgattgaaatcacgccatacctggttaccgccgtcaaggcctaacacgacaaggcattccatgtcctcaaattttgggtatttaaganttnttttacnncccccccccccccccaacacccgcatccatccacaccacccgcacgcgcagccgcacccgcaggaaggacggggacgcggatcagaccgaccgtgccaaacgccaacgccatactccacctgacctcacactcgcaccgcaccgcaccacctcctcatcgagccttgttttttttttctctttcctctcctttccgtcgcgctgttcgctgcctacaaatcgcaattccccaatccatattcccttcccttcctttcctcctcctccatctccaccctcccgccgccgccgccgccgccgtcgccgcggcacactccccgggaccagcagaggccgccgccaacgccgcgggggcaggtaaaaaggcgcgcgagacgcccgcctctgcccgctgacctagatcggtagggtttactcgggcgcccgggtcgttcgtgtatgggggcgtgggcggtgggggattaggctttcggggtcggggggtcgggaaggtgtctgatcggatgatgggtggctctgttctccttctggggtgcggggttagagctagggctgtcgcggcgattttattttattttattttagttgaatttgaccggaatttccacgatttggatgggtttgtattggttggattgtggtaggagtgtttttataggggggttgggagtgagggggggtagggtttgttaatggtttttgagtgatataatctatttgattcctgttagggtcttctcctgggagatttcccggcgcggattttgttagcatttattaagtgtgcgcgtgttgttgttcatgcatgcagctgcggataaggttgcttgaagcagtggaagatttcctggatggcttgtgctgcagcaactgatgattctgctgcgagcacggctgggatgagggacgaggatcgtagcctgtctggcgagtcgttgtccgagtggcggtcctgcgagcaggtggagagcgagagcccttcgacgtccccgcccttttgggacactgacggtgatgacgatgatcctggtgagtaaatgcacttgcttcgcgttacgcgtgttaataatgactaaattatttggtccgtgtcgttgcaacgccatttgagcttaacatgattggttcggacttggaggaaatagcacaaattctcgagtagttagttgacgtagcacctgtatgcatgatgcgtcttgttcagttgcaagtgttagggtcatctaccttacagctgccagcccagacttcacaaaagatctcgatcagaaactggaaatggtcctcgttgcagagtagcttcagagtccagaagacagtatacacgtgtgctctcataaatgagacggttttgtagccttaatgcatagcgtccagtcaggtcatttatggaaatccgtgaattgtcaactgaagttgcttctggttagcaccctccatttcacaattttaatccagctactctgtactcaagtgtgcgttgaccggagaagcagacaatttaagaaataattaatgagggcaatacttaccccatacgttgctacctccattcccggaacataattaacgagggcaatacttaaatatacaatcttgtttcatccagaattcccggaacattctgtttcttcgaaaaaaaacataatacagtcaataatcctatttcatctgttatgctgttcatgttcgcatttaaattctggctggaatttgcgcttctaggcatttaggtacctgtgcttcaacctgaatagcaggagaatcgcatgctgcaaaccaacattactaattgcacagaaccgcagttcttgtattaatcttgtgaacaactactacacagctaggaggcaacctgcaatatagagaattgtgatatgcagacaatcatgatttcttgtaatgctcctttatcatagcttcgtacttgtttctctatttttaactcgcaccaaaatatgtttgcaaacacagtcatggctagataaatgttgtgtatactccaatatgtacaaaaaagatagctgtatgcctgccggtacatttttaattaaaatcaatcaatctacactggtatggtccatgggtccagtgcaaaatgtttcattccaataggcaaaacggaatgtccaccggaaaagtattgacatgtacgcctaataccatgcttaatatgtgttaatccattatttcttctctttccatgctgccttcaagtgtcatcttgactttcctctacaaactcaaattttgaattaatatttgctctatcaacaaggaatccagattcatttaccatctcttttcacgctacttcacaatgttatttggtctcattgtcattgatgcagtttatgttttgtgtacagtagtaaatatgattagggcatttaaataggtggcatgcttgccgggctgttctcacctgaattacgttcatgctagcgtcaacatttgctattgctgcatgaataagtttaactctctttcctggttcaagtcccaattcctggcatgtctgtttttgaactattttagtatttatagagtaaaatgctcttttttcctttagaagttcttttttctttccctattttaacctcatctctgaactaccattacaggccccaaaccttcagatttatttgggcggtatacttggagaattgaaaatttttcaaaggagaagaagagagaaatgaaaagcgagccatttgaagctggtggttacaaatggtaaaaggcttggtgaccattgctatgcatgatttaccaatgctttgcaatttacctcctatgctatccttttgtctcccaaaataaaattccgcatgatagtttttttcttgaataacctttatcctgtagacattagtacttttttgcaaatatgccttctttttcctcttatgttggtgcctagagaatggtattgtcaattttcatctcaccatgtttcctttccatgcaatgcaatcatatacaaacaccgcataattctgtcttatatgcattttttgacataatgtttgttatgtaggaaatgtaaactcgcacgattttgggcattataaaattgttttctgtgatttcttaattgaaaaaagatctttaacaagttttggataacgatgctgctttctttgccctatgttcgccaccacaatattgtgaactgttaggtttacttttctttattgcagccatttatttcatttagatgattattgggtttgaacactgttatctctgctttagctattatgtaaaaaaaaaaagaaacaactgtaaacatagcatactgcatactggtcaacatgtgatatttatttagggatttggcttacatgaccaccaaatattgtttgcttcaggaatctttgctgagggccataggaacaaatctaagagcttcttgtctctttccagtttaaatttgttatttatatatgcctatttacttattccttactttgtctgcttgctattttacaggtatattcttgtataccctcaaggatgtgatgtttccaaccacctatcactttttctctgtgttgctaatcatgacaaacttctcccaggtttggtttttgtagtctttgctgctatctaatggtgcaccatggacctaatatctcatattagtattacactttcagggtggagtcattttgcgcagttcactatagctgtaggcaatatagatcctaagaaagtaaaatactccggtgagtggaatttggcttgttctcttcctaggaagctaccattcttatcttcttgagcttcaggtcttaagtaaattttgtagatactttgcataagttctggaagaaggagcatgattggggatggaaaaaatttatggagttgtcgaagattcaggatggctttcttgttgatgatgttcttgaaatcatagctcaagttcaagttatcaggtagctaatctgtcagtgcgaacaattggtagctaatctttgtatcatggtgcttccaattcgtgtctacttaatctattaggctggttcatttgagcatgtctgtctttattgcttcatgtcctaatcgcgggaacaatatttttgaattttctacaggtagtctgccaatttatctcaaagcattgtttctttattcaattgcattccttttgattctactgtgatgttcccatggtgggaatttatttaatctattccagtttctcatttttttgctctaatttcctagcgttttgtagctcatacagaccagcaagatcacttgtatacattagatagtttgcctacttctgtttcttgttgatatgaattgactacaaactatcatgtaacatcatactgctgtatttaatatgtaagggagaaggtggacaaaccatttcgttgcctcgatcgcccttatcgaagagaattgctccgtgtttatacgacaaacatcgagtcaatataccgccgttttgttgaggaacgaagaaataaacttagcaagctgattgaggacaaaatgagatggtccaggtttgactagcagctattccaatataatatgctgcaataaaaagcaaagtattttttctttaattactgcctattgaaatgagatctttattggattttcagtttttgtgctttctggtcagcaattgacccaagtactaggcatcggatgtctagagagaagactgatgtcatattaaaagtattagtgaagcatttttttgtggagaaagaggttacttcaacattagtgatggattctctgtatacgggcctgaaggtgcttgaataccagagcaagggcaagaaagggagaacgatagctgatttggatgaactgcctgcacccatgatccatgttgacatggacatgtttgttttggccagtgatgttatagatttgcttgagagagcagccttagaaccactgccttgtcaacctgtgtctccaaaggatgacaaatgttcccagagtcgcatgaaggtagggattgctttgatgattgaagcatgatttttttccctgtttaataatctcagtataaatctttatgctcctagatatattatattgggaatattttttgttgtgagtttcttgtattgtatctgtgcatagttgtttggtgatcggtttattgcagagtagaggtttttctactggatttgcagtctgtcttactattctcactgtcataggatggtgcttctggtgaggttaacaaaatttccatggagcgcgaggaaagacgcctaactgagcttggtcggaagatacttgaaacatttgtgctatctcatatattcaggtaaaaagaattatttaggctgattttcttttggttaccgatgtagtgttggccagtaccaatagtcgatccctaggctttgtgggtggtttatgttgagccttgggcatttgaatgaaattatttgacctctaaaattcgaagacttctctaacagacaaactaccgaaattttagaaagctgcgtgtacgaattttgcattaagctaatgcatatacatttttctaacttaaaacagaatagatttttagacaaattgttagctacctaatagtcctactgtgctctttatttgtcagtggaattgaagttgcgtaccaagaagctgttgctttgaagagacaagaagagttaattcgagaggaggaggaagaggcatggcttcttggaaatgagatgaaggggaagcgtgggggtggtgctaatgaaaaagataagcgtgcaaagaagaaacaggtcatattctttatagaccttagttttattatattgagtatcatattggctcttctatgtgcctcaatagtgaagcagaactatagctagaagcttcataagcgattatcgtacccaatagttattgaacttaaattgcttagcgatttttggagtcagcatttacaacttttgtgatttgatttaattaggttatgcatcacaaaagaaaatatttaatcctatatcttgcagtttcattagggtatattttccacatttccatccttccctgcttctactgccaagttgtggtgagcaattttccatgtagttgatgcttagaaccagcctctgggatgttttatttggtcaaattgcatctgctttctcctggatgctgtttagaaactttctgattgtatgtactctgatttttattttgaagttgatagaaattaaaaacacatgttgagttgtactgcacttggccagggtccaatgcaacctttcataaaactgtccaaactggacagatacttggccagggtccagcgtagcctgtaaggcatccattcttggtcatctcaatttactcaggaactatattctttatagtttcttctatcatggattcgtggttccatattactattgctgcactagcatatttctgttgcgagcttaatatcacgtgctaggattatttgggatgaaacgggtgaaggggaatagattggatcataatagaggaaagaacagggaatggccctgaacctaaacggcacgtcgctctccgttgcaccaagaaggcagggccgatgggcgctaataaatcttgatctaatgcctaactgacctgagataggatccctccttatatagatggaggactccttaacccaatcctaacagaccgtgactctatccaactaagctacgtacttatattgatggatatcgtttccattgggcctaggactcccggcccaaagcccatgacacttaataataattattggcttttattattctctgattttactgctgttgtgcgaccctagcatcgggtttcccttgtgacattccaaatgaaaaatgttattagctcctagtcctgagtaacattgaattatcttctgaagtcttgtgctagtgccattctcgaagaacagctcttattctggggttgaaaatatatttgggtgaacatttaatattagtgtgaattgctcaggtacaactgatgtgaagttttatggttttgaagacctcaacctactttatttagggtcactacatagcttcatttcatcatgtcagttgtgttctatttctataattttatatgcattttgatccttagctctccttaatagtttgatgcgatgtttctttctcttgtatcatcttgttttttccactaatgctgaatcattcttttcaggccaaacaaaagaagaacaatcgtaagattaaagacaaggaaagagacgaaaaatttgaagcaaagattctggaaagacttcatgatgaaactgcgattgatgatagtgatggcttatcatcaaagcaggccgaagaagtgacaacaaaggttgaaaacttggaagaaggtgcttcagataggcaaggtgatctagatagttcagaaattgctcaccgaccagactcaggtgacaagtatcctagacaaatgaatggactgagtgatgttactggcaatgcacaaaaggtaaagaaggcctcctctatggaggctaactcaccagtctttctggctgattctgttgctgcaagcggcactcatagcagaggaaataatttgtcagacagtaagaaccgcatgacaccaaataggtaggtgaactctagtttctaaggcttgcattgtgatgctagtaaaattggcatctgctctaactggaactatctgcagagggaaaaatcagcgtaacaagggcataagcattatcagcttttctgaggaaggtgagggtattccctcgagttctactggtggttcggctcgttgtagttctagttgcggcacatctgcaaagttggaccaagataccgttctactcaccttgaaggataaactccgtaagctggggcaacgtctacatgaggtgatacatcttcttgaaaagttaactgcctttgttttgttgtgatatgtgaagtccagctgctctgttttggtcatatgcacgaccttccacggattatattatgagcattgtttttaaatgggatgagtgtcacatatgttgattgtatggaatatttgttttcgacccattacccttgtgcaattcatatttaaaatttattacaaaaggtaaacaatataagtatgtcttccatatttcatgcctatggctaatgactggagtctatgaattttaatctcaattttttcgtcagactaaacagctcttccattttctttttattaatggatataacttgctttaatctgtgtgtttcagaaaaatatggaggggcgaaaacttctccaagctcattttgaagccatggaagcaaagacgagtggttcatctccctcatccagtcctttggatgaaacacctgatgttgtgaagagccctgagcagtctgcagaaggtacaacagatgcaaaagctaatggaacaccaaataaggatgaacccgtgacaaattgcgtggcagaggaatctgtttcagtcatgccaggcacaaagagtactgaagctttatctggcatggcccttgccaagacaaaagttgagccagtttcaaataaagatcatgttccaaaaccaacattgcaagccaatagagcatctgctaattgctcgaaatcaactccagttgatatggagaaagatgttcctcttccttcaagatcgccacaaattaataaacctgctccagttcctccaaaatctccacaagttggtaatgctactccagttcctccaaaatctccaccaattgaaaaagcttgtccagttccccccaaatcaccaccaagtgctaaagatacatcccttccttcagtgagatcacttcaaattgataaacctgtcccagtccctccaagattaccccaag

SEQ ID NO: 57582 - DNA, 1961 bp, Oryza sativa
atatcgatgtatacttaaatcaagtgattgggatagattggtcatcatgccgagacagtataaatcacttagatcgaaatatatgtcaataataagactatatatgtttatagcatagacgatcagatagatctagcatgtatcggctaatactccgatactactctatatcaagatattaaagcaagtgtaatatattgagcaaaagcctaacatacttagatacaacaatatcttaacataaagggcagatttaacatgtcaataaggcatatagaacaaatgaagttaaatcagatacgaacggctgaaactccgatgctattctaatcggcaactagaaggcaggctagagatcgatattctaagcacgacttaatagatcaaactcaactgatgcagcattaagtatgaaaagaagaacaatttctagacaatcaagccgctagaagtttcatagaatggtagatatctcatataatctagatcaatatcaaaatctaacctaatcggctgccctctgcatacagatgttagccgatagtagattaggtggcgatattgctagagattatgtaaggtatatgataactcgatgaattatataaataagatgagagtatcataaagatggaagcactaatcctaagaacacaatccgtcataacgaattttacctcttgttgatgatcgaaatcgatgcagctcaacccgaaagcaagaactcgtcgaaactaaagcaaaaagggtggcgatgcgccgagattgtattgaacgtgtgtgttaaaaattacatagggctcggggtctatttatacccgaggattacaagatatgcctataccggacatgaccactatctctaacaaactctaagataccacaagtctttgcggcagacttttgcccacacttatctataagaaatttacataaaatatcctaattaatagatacaattgccttcccaggactccatccatacgtgacaatcatcttgaagtacattaactgaaccggatgtcgcgtacaagtcatattgtcggaatcggctatatcggcttatttagctcgactcagactcagccgatcccaaccgtagccgatccgggcatcagcagattcatgctttgtttccgaactcgatcttctcttccgactaagcttcgatgtaatcttctctccgaggctgatgttaccaaatttggttgttaacacagaccaacaaggctcaaactgaatttattaaaaaaatgcagtttgttgagaatgatgaccgaaattaacttaaagaaatagggactgtctagtattgtcaactaaaaaaatcatttaattttttgaactgattgtacaagattcatgcggaaacacgcaacaaccttaacctcaccctttttttcccttttccttttcccgtgttcacttaggctccgttcataagtcctagttcctaacttcctccgcctcattttccgcgcgtacgtttcccaaactgctaatggtaccttttttttaaaaaaaaatttatacgaaagttgtataaaaaatcatattaattatttttgaaaaaaaaaactaatacgtaattaatcacattctaatgcattgctccgttttcccattccagcgaacacagccggagctagtcctgcgcatccgcatcttggaagaagaaacgagcaaaatacaacacgcaaaagagtgtttccctatgctgacggctcacgtcttctttttcttttttcgaacgactcacattggatggtgcgaagttctattgataaaacaggaaaaaattaaaagattacaatctgtaaggtcgtaaccaggaaaaacaaggcttaaagtcttcaagataagtttttaaaacgagtccaagccgccgggcagactgcgaatttgcaaacccgtcgaatgccagccagtgcacccacaacttgttacttggcttgaatcaa

SEQ ID NO: 57583 - DNA, 1358 bp, Oryza sativa
aagactatacactgtaacttggttcatgttacatgttctgtactcggcagtacattgatcagactaatgtctccacgtccagtattgcctggacactttggaattcttcaacaaaagaaacagttgtaatttgtaaactcctacagaagaaacagtcatacaacacctcggagtaagtaactaatagcatgcaggaatccgtggcataagagctggtggcctgaagtgggttagttcatagtgagcttcccggttcattcttggcgttgcctggcgcgttgatggccatcgaatttgcatccgcagtctatcgttgataagcaatgtgaagatgaaaagatttgttagagcagattaaaccatggtgttggataattctatatccatataggcattatgcaatgcagagtttgtgctatggatttgcagatggatagagaagacgacgacttacaggaacttgcttggaggaaccaagatcgtctgccatcggttctggtactttatgttcagttgttaatctcttaccatgctgcagaatgtgtaaatcagaaagtgttagttcaacaaaagatcacacaaagatgcaagtccgtgctgcaagaatttcaaagggctcgtttcgcataaatgcaaggtagattctaaataatctggatgagattatgcacaacccaaaaaaaaatcctgtgagataaaaaaaggtacaaccaatgcggccttaaatttcatttagatgaaaatgtcaatacatgatgagcacatgttttcatcagcacaccagtcttcctccacaactcaacagcacaagagaatttcactatgtttctagcaccgatatggataagattataattcacatatagcagcaagccagcaagaacagaattctataaagaaaacctcattgttactccctacgttccatactttcatattataagtcatttaacctttttcctaatcaaacttaactaagtttgaccaaatttatagaaaaaaatagcaaaatctaaaataccatactagttttattaaatcttacactgaatacattttgataacatgtttgttttatgctgaaaatactaatatatttttttataaatttggacaaactaaaaaaaattgactaggaaaaaagtcaaacgacttataatatgaaacggagcaagtatataaataaacccaaaaggggaatgccaccttctttaaacgggacaattgcttatttgaccccgttttgagccctaactaccaatttgaccctactttttaaagtttgcttatttgacctccttttcaaaaacgaagctcccgtatgaccctgttctgttaagggcatcgaacggtgttaa

SEQ ID NO: 57584 - DNA, 11548 bp, Oryza sativa
  unsure (1)..(11548): unsure at all n locations
gggggggggggggtggccacgtcaccctcgggcccgacccccccccgagggggtcaggccacgtgggtgagcgcggctgcccaagcctctagtcacgatactcccggtcccatgtcaccgacaggggtagtgtaaattatatggaacactggatgacaaacccactctttgtgcacattttttcttcaccgattcagacacatatataggcaaaccgagatcgcattcgattgttcaactttacattggatttttttgaacaacacgtataggatagtgtaaattggcatacatcatgggatagtgcaagcacactggatgatttgtcaaaagaacaagctgtagggagttgatcggaatacatcatgggatagtgcaattggcatcaggactacctctccaatcatgtgttgatgctgatgtgcacccttgcccgggtggatgggtgtcgtggcacaaatatcttacatgacaactttagcggtcaaacttacaccttgtcaagttgttgtaccggtatcggcatggtaaatggtcaagtttttacattcaataaaactcaccgatttattatattacaaacgcaaattactctaatcaatattgggagttgagatacaaggtacatgagtggtattgtagataagctatgttttcaatcctggacatccttcctcttagcttgccgacgactggcagccactagagacagagaggaaaggaagtcaagcggatgaaagaaaatgacacttttttttctctactcactgacagatagagaagacaaagcacttccttttttttccttcttatagagtacatgttttcttcttagttcttaaggtgtgggtgacttaagctttgagagatggtttaatgctggtccaaagattgggaattaatagggtaatatttcagtcagattgtttgcaggttgtcgataccatgttgaatggaggttatgcggcaacagcctcaacagctatttacgaagaatgtaatctaatatggagaggttttgatagcacatctattgaacattgtaatagagaagcaaacaaagttgctcatgcattagccatggtagcttttagtaggaaagagtcgtgtatttgggtcgatgaacctcctggctatattctaagtactttggcaaacgatgtaactatgttcaatgatcaataaagctagccaaatggcactaaaataaaaggtgtgggtgacttattatttttctcactggccagatgttctcaaaaatgtctcggttaacgatgtgcggtgcaaagtgagcggtttggaaaaatgaggaatcaatagtatcttaattgaaagtttaagtagaaacaattttaaacttcaacaaaaaaaattaaggatttgcaataagtttcacctgaaaaaagttaaggattttcaataagctatatgtttggaatcatcatatctctcaaacatttatttttcataatagaattcaatccagaccactctgcatcaaagatacatcaatccagccacatattattgatcggcatagcagagaaatagtataatataacaaaccctcatcacaaaacaaccagtacatgtgcagctattggtgatttaatataaaggaatttaaattaaaatttacacgcagttgctcccccaacgtacaccaaaataattaactcttgtcatcagctagctttttttagataatgaaatataatcccagcctttgctgtcataagctagctagctaaccatcatgcaccaatatataatctcgatcgatcacctgacgagcgagtagatggagagcattatgatgagcgccatggcggcggcggcgagcagcatgagcccggcggcggcgtaggccatgttgaagaacctgaccacttcccccggcagcttcgagccaccaaatgcgctcttcgcgtcgtaggtgaggccaaacccggcccccgcccccgtcgccaccagcaacgcgaatatctggcacatagtgaaaattccactagctattgatcaagctcctcagagggtggagcggagctaaggagttgtcgctccaccctcgtatagtgtaatttttcaagatctcgaaagtgtttgatatagttgtaagtgtcaggttttgatcggaccgtcatattgatgtgttattctgtagcggtgagccgtaccaaacgggtatgctgttctagttggtcttgaaattcgaaatgtaattagagctagatgaatgagttaccacatcggcgaagatgaggaacaatgccacattctcgctgcctcctatcatcctcttcctcttggcgatgctgacggcgacgaacgggatctgtagcagggtgtaggcacacccaatgacagcgattgcgaggacatacctatacgatagaacacaaattaattgaaaagttcttttattttgccttttttaccaatacatagaatcgtggcagttctagcatcaccgaaatatatagctagttagaccctttgaaaaagaaaaaaaaaaagctagttgccccacttgtcatgcataattgcgtatgtaggtcacgctcctttctaatgaagggataaatagattaagcatgcttattgaattgaattcctaaacagtacgacttttacaagtactctatatatgaatctcttatgatattgtttcatatttattttcgaaccttataattttgtgtgtaccatcaaataagtatctcaaattattcagctattcaaatcattccgccatttaatggggattttatcagattttcagtgttactccactatagtgatgctgctgcttgtgatggcaggcagcgccagccagctcgatgtctcatatatatgaatatgattcctatcactaggtgctgacctgtaggcgtagacgtccttgaaggtgatcttcttcggcgggaggccaccgccgaagtcgagggtgagcttgtcggcggcgatgacggcgagcgacgccgcgaggagtgccagcgtcaggaggcggagggccagcacggcggacggcagagctgtcctggaagacgacgccattgctgctgctgttgcctcctctgcccgaggaaccggtttttacatgcgtgaccacttattttccgcctgcaatttaacggcggctttaatatggaatgaaaaacggttttcctaatagtggttatctggctagccagctatagaaattggttgttgttcatcgttgagatcgctaagaggttttatatacaagcagctagagcatcggtatctcgcatcggcctgcagggaatttggtggtggctccatccaattgttcattgttcagaacttcagatcgatcgccggccggccgatcgttgttggagctggaacatggcgacgacacattttggctgtagtcttgagatggttggttgttaattatgttgacagttttgatttggtctcgtctgtcttgtccgatatggcgatctattcaaatcgacaagacgtagagcagctgtaccaaaggaccagaggagcaactcgatcgatcgatactttcgatagtgctaagggcatttgtagtgttggttaggtaagtccggttcacagaagtcgaataaacatttgattcgacccctacagcgttaaaatcgattttgggtgggacccatgaaaaaaatcttaatccccaatttcccttccccctcacaacctgtagcaacaagtaattttttatcatcaatgttcgacttctattttgaagtcgctttttcatctgacacatacggttcgcttcccacagtgtgcatagttcggttttttcacgttgaaatcgattttaggtgcgcactggagctgctctaaggggaacaggatctctgacttaagagcaacctacgtcagagcctcagagggacgtccgatgctgcagctacaccgcttgatcggcatcgaacggaggtgaacaagcacccatcccggcagcaaggccctccttacgatcaccatgccgttcaacttgcaggggctcagctcatcgcaaatgccattcactagcaagaagagtgaagattcagcagcgctccatctgagcgtgagctcgaggaggcagctagccatggcccatggctcggccagaagcgctggccccagcgacaggaggtcggcgtaggcgaaccagacactcaacgcggacggcgccgccgcaggatatgctgcgctgcgggcctgcggcaccgtcggcgaagaactcggcggcatatgatgagggaagcggccgggagcgagcctttccgttttcgtgggttgattttgtcagcgtggccgaaaagaagccagatggtctgtcgtgcttgtttacctccgtccgatgccgttacgccgctcgatcggcaacggatggaagtgaacaagcacggtaaattaattggcttcttttgtgctaaggatatgcatggatgatcctaatgcaaaactatccatcgcagcttaatttcatcgcgccggcgttctgtttgtttccttcaaggtattttgggttcgaagtaagtcaaaaattttcaacttcgatcaagcttaagtaattaaggttatagaaaaatttattaatatctaaatcataaaatttactattgagtatactatgtttttatgttatatttgtttttattgaaaatgctattacacttcctataaaactttgtcaatcttttaagaagtctgatcactggtggagaaaccatttttactcccgattgggaaccgctttagttccggttttatcactgatggatggttttccaaccgggagtaaggatccgggactaaagaaacaatagtggtagtaccagatggccccattttcttttttccctttttattttctcccgaatcaagtaggcaaatccccacatcaaagtaacaatgtaacatcccaaattcacatcacaaatcataaagttacttatacacacaaatcaaatacatcacaaaatcgtaaaaattacacacaaatcaaatacatcacagatccaaacaatgaatcatatatttgtatatctcagtgaatcacaaattaaagaaaaaaagaaaaaacaatgccgctgccgcgcttgccacgaccgctgggatgggaaggggaggaggggggatgaggaaggggaggaggtggaggagaggggatgaggaagagaggatagatctaagcaaacggggagatattcgatctgtctaagttgtaactgtgtaggagaggataagtaatagggattatatactacgcgttcaatttgatctttagtctcggttattgacaccaaccggcactaaagattctcggccctctgacatacatctgacaggggatggttaccaaccgggactaaagatcaaaatttttataaccgggactaaaaacaatctttagtctcggttctttttggaatcgggactatcgtggattttgccagaccgaccaaaaatggtttcttcactagtaaattttggacaaatctaaatgacttataatataaggagcagagggaatatgtttttatctttcatccctacgctgtgcaagtacaagatctatctgtcctttgtttgatattgatggcacgaattataccgtgtcaaataaacgtgtcaaataaaagatactactactaaactatgcactgtgacaaaataaacaataagaagattgctaattttcaggtgctgctccctggctatcggactgagccgtcttctacttgtacaccagacatgagaggaaagaagcatctcaaagagaactcgcttgtctaacatcggtccgaagatgatgacagtggcccagattcaggtatccaagggtagctatggtgacgatgggggtaagagagggttgggtggaggaatggctagggttgcagtgggcgacgaagcggcagtagcgtatgcttctagcatgggaaaaaagggtgagttgctagcatcagtggcaggagagccttgttggagtgttatgaggtgggagaccatagtggcgtgtcgtctagcgacacaaatcgtccgattagacctgcaagacgacagagcagatacaactcaccaccgctatgtttggggaggaggggaagggatgtaagaaggggaggggcggaggccggtctagcagaactcggtggcactagtgaggccgagaggcggctcgatgaggtgagagaggggaaggagtggtgatggagctaatcgatctcgacctagccatttcaatcagaccaaggggagggagaacataaggttgctatacaaatcttggcacaatctggaccatccaatagtgactgaaatttgtgtgtatttttaggtgactgtagtcccataaagatgatcaattgtttgtttttttaaaaaaaatgtcacttctggaaagggcaagattgctccatgaagaatatacccctctcatcctagtcttgatcaatctcaatcaatcaccatttaccaagtataccaccatctcctgttgttgttgctaagcacctgtcgaatgagccctccacttcatcggagccgtcaagccccgttggctgacccatctcatatcttcatcttccttctccttctctaccaccaccaacaccgttgttgtctcctctatttctcaagtcaagaaatcttccctgtcctaccttttcttctcactgtatggcttatgactcctaatgacttcaagcatcactgttgtccgaggccgcaccacaactgcctcaccgtttcaccatagctgccgtccattgtcgggcttttgtcccagacatttctcttaaaccatcccctcctctaactggcgacctattctatcaaggttgctggagattggaccaccattaacatctcttcgctgccattagagaaaatacacgaatgagtcttaccgtccatagtcctatttcacctgcctcatcacttatttgaatcagttacgtgaatattatttttgacaattacgtggaactggaagacatacactctctgtcccataaaaaactcaaccctagaagtgaatatgaacatatattatctggagatagtgtatgtccattcaggatttgattatttttagacataggagcatatcatattatcatcagtgatcatttcatctacacacatattccggtttaacaaattgttctttttattcctttttaagataacgggttgcaaatccccaatttttcacaaattcctaatttcaatcgtcttctcgatagaattttttttctcgaacatagcactactctgctactgctcgactgttcctccatcctctctctaaaccccaaacccctacccctcgctgcaatgctccgccgccgccgcggcccgctcctcctcgccgccgccgccgccgccgcggcgggcgccgtgacggctgcgctcccctccggagaaggccgcggcgcagccccctccgtgctccacgccgtcgcccgctcctcccgcgccgtctacacggttcgcccccaaatttgagagacgctaacctctatctctgtgtgtgtgtgtgtgggtgggtgggtgggtaattcggatgcttctcgtgctcattgctgcggatttggttgttccagattggcttcgtggtagtggactacaagtactcgctccgtgggctggctcatgggtcggcggattaccgggataagctctccgaggtttgtatggttgcgctggcggtttgcggattgcacgcgtaagctggttaatggcgatggaaaactgtaatttgtttttttgtttctctctcatggattattaggtaggtaggaatgaagtcattgatttcttcaatgtggaaaatgaacttgtaggattgtgggaagaaggatttattttgatacatgtgaccatgtgacctattgctcctggcctcctaacactgtttcagttggcaaaggaagaacggatatgaggaactttggggataggagaagctgtctcacaatttcttttttttttcctgtacggcatcaaaccaaccgttgttaacagccttatctattctaattatgaattcaacatcgtggtttggtaccaaacagcgtcattgatagctattgcttcttttagaactcaacacttttagttggacagcttccttgacataattttagtttttcgtttcatttgatattttactttagaaggccatcaatcagatatctcaacttttcccatgtcttcgtattttgatggaaacaaagttgcacaatgtgggtgctctgatgctcatttgaatagattatgtttccaggagttccatcagagttagcataacttgattaaacatgcggcatttcgaatgcagttacaaatagcaagagctccagatggttatagatctgtaaatccttaatgtttacttgtatattgtaggttcatttgcgttcagcaaaaaagatactcaaactatgtgaagcgaacagagggttttatgtaaaggctggtcaatttgtttcgtcaataagacaagtaccaaaagaatactcatcaacactctcttgtctgcaagatcaggtttactagttaatttctatcttaatgttagtgtacactgtatagcctcattagtttttttttatttaacatttttgtaataattcaggcaactccatgcaactttcaagatatcaaaatagtgatagagcagaaacttggcaaggatttacatagcatgtaagtattaaaggttcatgattttttaaacttgattgtgttatctgtagtatgcagagctgtggttataggcaggttcggaggatagcgtggacttaacagggttgtggtcccccagaaaattttcctttagctactatgcagcagcaattggcacacaagcccatgtgtggtagctagtagtatgcagcatagcagnnnnnnnnnnnnnnnnnnnnnnnnnnnnnnnnnnnnnnnnnnnnnnnnnnnctcaacagttaggcttagttcgtgaattttgatggacttgccatattagttgctcactgctgcttatctttgtttcttgtgtggggactgatgagagagctacacaccgtggaaagaagtaacaggatctgtgagagcaatgtccattaagcatgtggcagttaggcctgatattagtgtgtaatagattcgtagtgtatttttagtactaaatttggtattttaatagtgtgttaatgaataccattaactttttggtcccccattggtagttcactcaaactccatcactggttataggaagtgaggttttctccattttgtttcttttaaaaaaaaaaaggtgtcatatgtctttatgttgtcattttatggtctcttaaaagattatctaagttcaacatcaaatcttccttaggtatagctaaaaaagggtatcataaacttgttctctactgtatgcagagtgctgaaaagtagagtttgcatgcttttcattgcataaaattatcatataacctgtgatgtacctgatggttactctggtgtggatcattgtcgtcagagtagattgtgcatgagtttactttttagctggttcagtctagacatgccatgggctcttcggtttacttttttaccctttgtcagcctgtgacgtgtgtccttgatagcttgtgtaccttcgcaattggctgctaggatgcttagctaaggttggttgacattagtgctagtgtcatctccttgccatttgcattaagcaatggctatatgaatgcactgactttataacactgttggaccaatttgttcacgtttagctagtagtggtgggttgagtttcccatggttagctctagctgcattcgaactttcatggaccacctgtatcaactaagattaaacttttaggctgagtgggggtgaatgcatgtgttcttgcaagcaggacttacccagggctgtatatttaaaagttgatagctcttgtcagctgtacaaatagctcataattttattgaaattttttgttgattagttgcatagtttccaaattcaggcaataagtgtttaagatttaatacttgagtatcagattcctggaatttgatgaacatccgattgctgctgcatcaattgctcaggttcatcgaggtcggttgaataataatcaggaagtagctgtgaaggttggttgctgtgaacatgtatctcttacctgtcccattattgttctcaaagatattttagtgattgtttgatcctatactgttatgtcttcaccattcaaatgaagcagggtgtaatgtcctgtgctctgcaatacatttatgtaaaccattgaaaatatgtccagcttgatatcatcacactgcatgctcacagtttcaagacagaagtcagagagattgcatttatgtgaaatccaccatccagagttataacttgcacagggacctaacaaatttatatccaccatcccagttctaccttatagctttgcacatctatcaaatttatggatgcttgtcaacagaacttttaatttaaggatggacaactgccaatttcaaactttagtaatttatccaactctttacacaaattacaagttggagtattcttctaaatttcacagccaatgagaaagttggattacctgaaaaattttttgattattaacttaggctacaacaatttctaactttagcttagccatatgaaatgtttatacactaattttacatggaagcagctaagccatccaatatccattgatgtgaacatgaatttttcatctcaattcttttgactcagagcatagcataaactgatctcttgcacctttttttttaaaaaaaaatatagcgatatggttttatcataattttgctagcagaattgtggaaatggacagaagcgaatatttcccctctctttactggagatatccttttatattcaattttgaaatgccatttcatcatttccctataatgtcttgcaaacattgtctttcttggtgtgcatgtatattaatctagaggatttccatcttaactgtgtcatataggttcaatatcctgggcttgagcggcgcatgaagatagacataatgactatgtctttcttgtcaaaatctgtctcttgggtatgttacatgtatcaattttgcgatttccattgatttgcaaattgaatattttgtgcatgcagctcatttacatgaaaacaattttttacccatgcaatttattactatcgtctatacaatattctgaaagaagagcaggtaatgagcacagttcaattatattgtcaactgtcagcttttttaacatcaagattgttactaaaattctaaaaataaaccattcttggagcactagtgtctctggcaaaatccttgtaaaaaagaaagtgagtatgcaatcctaagcaagcaattgttttttttgttgattagcttgactctaactgttttaagtggcagttttcataagcgtacaacgtaaaattttcattgattgtaaagcttgacatgtgccatgatatgtttaaggagtgttatcagtgttttagt

SEQ ID NO: 57585 - DNA, 37921 bp, Oryza sativa
  unsure (1)..(37921): unsure at all n locations
aaacaaaacctggaggttctaacccagaaacagtgtgaaagaacccccaaaacggaccacatggaaagattaagactcttaaacttgcgtaaacaggtcgtggaagtatagctaacaatttgaaccaaaaataacttgtcgtgaaaatttagtcggttaacgttaatgctgtatccaactttattcaaaagcaagggtgctttgtaaacgtcccgttttagctgtaatgttagcaagtctttctgatcaacttgtccgtttcctaagtcttttaaaagaaaactgaaccgtgtcaacacggggtcaccaagttgacgagtnccgtcaaaagtggtgcaggtggttggttttgggcctttaggtcagtctgccncaggtgccatccacctactaccaaatcgtatattaccgatctcgatattggtccagtctaccccatgttcacgtacttttagtctttgacctgactcctgagtatagtgggcaacaaacattagacctgctactgcatagcagtaggtatatgcaactccattccagtacttggttctcagcaaaaatctaccagtcgtaaaacataacgcaaacgtccatttacgtttccatcatactcgttctgcaagcaagttcgctatcagggcaatcagcgatgctgaccactactgtgtttttctctgtgttccaattcttagccctgtctttcagcttggtattattataatccagattattaggagtaagctgaaagaaatagacaacttattgaagtagcttattataatctggagtccagtttattataatctgataagctcatttaggtgagctttttccagattattggatgaaaaattacctaccatgccaccccactccctctttagacttgcaaacctaataatctagactctaataatttaggaaagaaacaactaaccgcttattctactatagattataataatttagcttatagtaatctgactcaataatctagattataataatcataaactgaaagaaacatggccttagccgttgcactggtgctattgtgctaatgatggtttggttttcttccttgagaatttcaagctctaataattttcttgacccaacgcatcattgacgctaagaacggttgcctttttattttccttccgaaactttgagacaaaatcatttctgggcccacccgacagggggcaaggtcagggacggaccagaaaccagaaatgccgggggtgccatggcccatggtaggtccaactccacagccactggccgttggcacatgccgccaccggccaccgctcgcgcgccgtcgcgctcgctcgctagtcgctaccctacctagctacttactcggtttcacaatgtaaattattgtaacatttctcatatttatatatatatatttattaataacaatatgaatatgtgatatgctagaatgatttagggtgtgtttgagaagaaggggattgaggagattgggaagataaccaaaacgaggtgagccatttaactcatgattaattgagtattaactattttaaattttaaaaatggattaatatgattttttaaagtaactttcatatagaaaatttttaaaaaaacacactgtttagtaatttagaaagcgtacgcgcggaaaatagtgtgcattctcactccctatcagctaaatgaacgcagccttacatcgtgaaacggatgaagtatagcattagcagtagcactatttctttggacatccacgcctcgatctcttcctgggtctagtagtcttctcttcttccacgcgcaggcgcagccatcgtcgtcatcgccatcgccgccgcggcgcgcgcgcgcgcgcccgtgactgacttccgtagggggggactgaggcacgccaccccgcgcgcgcgcgcgcgcgcgtgcgcccgcacaaccacgaacgcgctccgaagtcttccttccgggagggcacgtgtggttggggtataaagggggagagaggcacgatgccgcacggcgtcgcgctcgtcgtcgtcgtcgtcgtcgctcctggccggtagcggatgggcgtcgtggtggggttgcagcttgctcgcctcgccctcgccctcgccgtcgccgtcgcccccgggttgctcagcttttccgccgccgccaccgcagcttgaagcgcgccgggcgtcgaaacgaggatgagggagtacgggcccgcggcggcgccgcggctgctggtgtccgactccggccgcgtccatgagatggagaggttctcgcattacgtcggtacgcaacctcgctctactactacttagtaccttcgatcgataactttgtaacttggcttaagcattcaatggattttttttttgcgagagcaatattgcttccgattgattgaatggattgctctccgatgcagtacattgacttgcaagaactcaattccatccacgattttcggaggggatcgcatgctccagcgttggaatgtgtgatttatgttttttcaccttgtcttctttgtcgatttcgtaagggaaattgcgctacaaccatttccttttagtttgttcatcactttgtccaatccaaaaatccaggatacagcgcggaattcgagtgtgctcagcacacgcatctagataggcatattattaatggggtggcgtggagattgattagcggcaacttgggcatagaaaattttgagggggtggaaatggaagcgagacattagattatgctttccactccatgaaacaccactagcgagattccaaacaatggcatattctatgtggtttgagttgtagcacatcatcacatattattcttttgtccctttatgatcttgggaccagcactggtttccccccaccttgtgtccttcttgccttttctgttttctcacaaatatgtggcaattttcagctaggcaaattgggtttgaccatgtggatgaatgcccccacctatgtacgctggcctatgattatctgaggaagaacaagggttacgaagaaaacatattcgcgttcttccaaaacagccaggatcccgagactctgattgtaaagttcatcgaggaactcgacaaatgtatacttggctacttctcattccattggaactatgcaacctatataatttcccaggtaaaggagttaggaccttttgccttatggctttgtcctctattgcttccttatgaaactctcctccactgatattttacgtattgatacagtggtgattttcacaggttttgactgtagaaggtgctcctaaaagaaagctcaggaacatggtattagaggccactaggtaattaatcatccttgagctacatgcttggtagttcaaaatatttaatgcacagtcattgcctaatctctgccttttttttatgccaagtattagttgctttagcttgcagcatcttcttgctttactgcagcacaagtttttcttacttgacttggatgtactattaatcaactcgtatgatctcttgtttggagttctttttgtacaaatatttttgtaggagtatcatatatttacagaatctctcctcatttaatgttgtgttggatctgtctccttgaagtgcttattggttgagttgaattatttattctattgactggttattttcttcctatctgatcaaacctttcactggatcaacttcagagctcaaaatggatattttagcagaaacagcacatttgaagtcaaagcaattagatttagatgataggcatgtgcttaggctaaactatggtttctttatttactcctatagccctatgtttggcctgccatgttcctttgaaaagtacattggtaattacttaagtgcctaaccggagaagttcaagtggagaaaatgcttatagtttcgatccaatatggtctcttatatcttgaaaaacatgtttataaccagttacaattcaatccctgtatttaagtagatgaactctgtttctctgacatcaaaactcaaaatgaggtctagcttctgactctccactaaatacaggaaacagagatttgaaagggttacaagaaacttgaaggtgaccagactattctccacattggtggaggagctgaaggccataggactatcttcccatgttgaagcaccacggagtgatgtgatggtcccagcagcacattgtgatcgcagcccagttctactcttgatgggtggtgggatgggagctggcaagagcaccgtgcttaaggatatactcaaggagtaagttgatcacttccatgctcgacattctgttcgtgttttgtttcatctcccttttcgtgtatgtttctcatcctgtggttcaatattttgttaaagctaaaaacattgatctgatctgccaaccagcaggttaatgaggaggagaataggtgaatgagaaatggcaagatgtaataatcaattaggaggagaaaaacattgcttggactttttaatcaaagccagagcagctaaagaatataaaatacgccttttcagaaagcttatcgtgctgctacctgtttcttgatctgcagagcattctggtccggagcagctgcaaatgcagtagttgtagaggcagatgcattcaaggaaactgatgtaatctatcgagctatcagctcaagaggccaccacaatgacatgctgcagacggcagaactggtatttgttagcagctgttactatactatatatgttaataccagtataccagtcagtgagtaaaacggcacatgaccactacatgacaacccaaaatgtacaattgcaattatttacattttagtgtcttggagatgctgtcccacctcctaaatctccacccctatattcatctttactatacattgaaacaagaaactcaatctcctactccctccgtcccaaaaaaaggcaaactctgggtttccgtgtctaacgttgactgtccgtcttatatgaaatttttttataattcgtattttcattgttgttagatgataaaacatgattaatattttatgcgtgacttgtctttttaatttttttcataattttttcaaataagatggacggtcaaacgtttggcacggaaattaggatttgtctttttttgggacggagggagtatgtacatttcagacataccatggctcattgtcagtgacccctcgattccggtgcaggtacatcagtcatcgatggacgcagcctcgtcgctcctggtgactgccctcaacgaagggagggatgtgatcatggacggcaccatgtcgtgggagccgtttgtccagcagacgatcaccatggccagggctgtgcaccggcaacggtaccgcatgggtgttggctacaaggtcacggaggacgggtcaatcactgaggagtactgggagccagttgaggactccagtacagatgaagaaggcgagacgagaaacaggaagccatatcgcatcgagctcgtaggtgtggtctgtgatgcctatcttgcggttgtcaggggaatcaggtatgcttcagaacttaatcctactccactacatgtctacattactgatactatgcttgttcatattactcaaacaaattctgcttgatcttgcctgtttctgctcacgcttccattatgtcagcattgcgattgactcaactgcactattttccgtgtactaacaaagaggtataagcacaaaatttgacacggttaatcacattgtcaggagagctgtgatcaccgggagagcagtgagggtgaagtcccagctgaagtcccacaagcggttcgccaccgcgttccacagctactgcaacctcgtcgacaatgcgaggctctactgcaccaactccacgggcgccgccaaggtgagcttaccaatgcattccgtgttcggttaccgatgttgttatcggggccggttttataacatcaggcacattgagaaatgagaattcaccatcgctcgctggctctctctacagctgataggatggaaggacggcgagagcaaccttctagtggaccctgaagaaatcggctgcttggagagggtgagccacctcaacgacgaggccgactgcgtccacgagatctatccggacggctcggcggcggcggcctgggaggccctggtcacgtcgccgtcgagggcgccggcgcagcgggagatcatggcggcggtccagaggagcgaggcgcgcttccggaccacgtccacgccctcgtagctgcagcacacgatcactcgtgtcaggttggaattttcttttcttttgacacgatttcaggtaggattgggggtatttgggtgttggttgtgtgtggtggctgccaaatggctcgtgggacacagttcgtgttatgtacgtatcatactgtacattgtatcaactgatcctgactccgttaccacccggcatattgtttcgttttgccgggcgatcgagctgcatcgaatggagctcgtcggagtcatcggtcatgtacacatgtgtcttgtacgatgtattccggatctagacaagaaccaacacatacttttcatggtcacttcagtgaaagaaatgatgaaaaaaactcaatgacacttcccatcgaaacacttgtgtcaagatatatagtttgttcgttgagccaatgtccatgttggcatgtcggacgccgtgcaacctcctggcacatatatatactactacgttctgatactctgattggtacatgctcacctgggtggctggttcttcaggatttggatctgtggtcctgtacctgacacccaccgttacatttctgaatctaagatagtggcaggagttgcacttcaccggtgcaaacgcccgcttacttttcaacggaaatctaccgcgttcaggtggcggacgcccattcgctcagaggtgatagaccacgacaccacgccacgcatggataaccagaccagaagaactaaacacgattcgcgagccacactcctgctgtcactcgttgcatctcacctagagaccagcagagtgtagtgtgctgtgtgcctcttgctagctaagcaaggagatagccggagccatggcgaccatcgccgctgccgccgccgcccgcaccgccgtcgttggccggccgtcaggtaagttcacaaagctatcaacagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcagctgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatcctgcctctatctttttttttttttactgttctgcaaataggcggggcctgcctatgcttgagtgtgcatgtcgaatttggtgtaattaattggagacgtgcatggatattttgtaactaattaagttggtgtttaccttgagtagtagctggctaagtttttcatgaaagtttcaagccagttatgcgttccactatatatagaaaaggttgccacatgcatattcctcttcttttgcttggatactagatgatgaaaggaatggtacacctgcagttgcaaggatggttcccaggttaattgctttcaactctctgtaaagttaaatataaaccagcactaataatgttatgaaataaattaagcaacaacacgaaaaaaaaaagaactagcactatgttcaattgctgcagctaaattgctaatggtataaaactgtcgatgtgtttgtcatgcctagagatcactagaggtttggattggctcaacactgacaaaaaaaaattgacaatttgacccatttccgaaaacttatttcgcaaatgaaccgcgcctaaaattacttatttcaaaaatgaaccggaggttcaacgccaaatgctccggcgttgagcttagccacctcagtgccaggtcaaccagtgctaaatgtcgtgtcaccgtggatggcaggccgactcggtgtgccgacgtgtcaaagtttagcgccacctgactcggcgctgaggtgtctaagctcagcgtcattcaatctggcgctgagcttcgagacattaaggcccacctgccccggccgagagagcgagctctctcatttctctcccttccccgctccatgaaaactacgacggcgatggcggcgttcctctccgagccctaatccccctctaacccatgggaaatcaaggggatttggaggggatttcatgtggaggttgtggagtaaggtaaccttctcaaaatcctcctatattttcttcatttggtgatttgttttggagaagagcatgaaccctaggtttgtcgtttttgtgagacaaggaagatcgacttcatttatcggttaggtgagttctataggttaattttgaggggatttcattcatcggtactgaaccctagttggtaggatggatttggtaggttccaatgtagggtttgggaagaatttttattctcattggcgatgtagtatgtagtgaatcgaatgaatgtgatggtatgaagtttgtgccacattgtctagtttggtttacttgtgtaagttagtcttttagtacccttgtcgttgtttaattgaaatagatgtactaatagtattacttactttgaaaggtggtcggactttgtagatggagagagttgttcatgtgcactatggtggaagtgtcctagagtcgagtaatggtggtagtcagttcgatgggatgtcggtgaagatgattgtttttcaatctaagcctaccttcgaggagcttttgtgtcgtacgaaggatattctgggttggtcggacaaggtggtatccattcaagatagatatgatatggggggagagcctatttcacataagcaaatgctagagttgaatggagagaccgaatgggaggcatatgttgagatagtgaaggaatcacggttcactatgtgcacttagttgtcgtggaactacgaacctattttgttaaatgtgcttctgcttggaaactggtttgggatgcttctgcatgggtgtagggatgtttgaaagtttaaatgctaatttctgaatatacctcctccactctcttgcgagcttttccctccttgccgttgttgcgtgatgtggagaacggcaacacctggtcggtgctctggagagcacctttccctttgcgctggggtggtgggtggttcaagctgcccgctccgacgaaattggccatggcagatggaccaagaggtggagggaagccaaggggacgacgcggtagcgttgcgactcagaacaacggcgctagcggcggagatgaggtgatacgggtgggacgcgtctggaactctggatctgatgggtaaagtgaagtggtgtgtgtttcttacttgttgctgaagaagggaaggtaaatgggcttaggcctaaactacagtgcagctcgccactgtatacttaacaagttctagtgattcgtcgaggggcttaacaactcatgtttaccatgagtagatcgatgttatataagtatgtgttacgatgctaaaacaatttctgaaagttgaaatgttaatttctgaatagaaagaatctgtccatgcaaagatcaaaataaattacaattggtacaatcatatatttcaatggaaagggatgaaattcaagttgaggtgatacataccattggaattgttgcaagatatgaattaatttcccttcttcatatatagatagcctacctttgatgtgtttgttatcctgttcttttcttgcatgtactgttcacttttcaatttcaattgcatctaggaattgaacagtacgatgttttatgatctttttagtttcttggcattacttcattacaatctataactaaactatttcctcattggcgtttgctccatacatgcacattacttaaatatcccgcgtccagtccgttgcaggtaccgtgacgcatttcgctaacctagctaaccgcaacgaggaattggaggcccagcttcaacaacttcgctccagcttcaacatcctccaagcctttgccactcccttcgtcgctgtcctgatttgtatcatcgccatcgctgcgtggcgtttcgcttaatccgaccggctacaagttagccacaagtatacttttgtgtagcatatggtgctaatgccaatatggtagtactataaagacaactagaggtgaacgcgcgcttcgcgcgttgcaccagtggtgccaggagaggaaaatcattgattacatctgttggttctggtaggtaactgaaacaaatgctatttgcaaggtctgtgaaggtcaagtataggctaacgacatggtgtgagatttaggtttagtgtagtgcaaaaaatgaagttttgtgacgtgagcatttatattgaaagttgttatagaggctaaaagctaatcacaacatatatgcagattgtggacagtcctaaatagcaaaatgtgccacatgtttgatggcaggatagacagtacatagtagttttatagtggtagcattgaaacagttctgctagatgagcacataggagtataggactataaaactatattacacatggctaaattctactaatatggtttggatgccttcaccgaattcacacaggggcccttttgttgatgtgcaaatggaagtgcaatatgttttgctatgatgaattgcttcccccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgttttttggtatatattcagattgtaagaatcaaagaagcaattgccgatgtcaagtaatctgtgaatgaattaactgaaggaccaccagcaggtacaaatttagcccaatatgaggaaattaattaaacatctcaaatagcagggggggggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttatttagcaaagaaagttggaatggacggtattgtaggattgtaaaggtcaattctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagctagtcaaataatacataacttagttaaaatgggattttaacctacagggcagcactcatcgtcctaaactgaagctttatcatcccaaaccaatagttatattatcaagagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaagggcataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcacttttttttatatcaagttaaattctgttgcacatcgtggggatgtcatgataatttaatatgttcagagttaatgtctattatgtcatgataattaattttttttatagagttaccaatcttcagctataacttgcaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgaacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctgtataacctttatcaaatgcacttgtatatttttggtacaacagtaatatatagcagcagtagtagtgattagtgtgattagtgtatatgtttagtctcagattctgcatgtaaaaggtcatctaatgtcaagttacaaacatgctcgttataaattaattttatagaagtcactaccttcaaggggcataattagtaatgaacaaactaaaaatgcaaagccacagtctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatcagcatgctacaatggatcgtagatgaaccccttaaagaaatgcacagccaaattgacagcaacactaccaaagcaaagctcgccgccatcaaagtggggtcacattcggtggagatgcaacctggttgtggtggcagatgaccttagatgctgtgccagaggaccagtagggcagcacggccgtgacgcaaggggatggaggtggcagcatcctctaggagccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggacggagctgacgaggagccctccatgcggcagatccagcagcacccgccgtactggagaccgccgctgtccgaaacggtacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctggcttcccctcacttcagggcggccggatctgccggcgaggaggccggagtcaccggatccgacagtcccggcctcctcgttggcggatgcggcgcgggagcgagaggatggcgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagtgcacaacgttagaactaaggaccagggatctataacaaattatcaagtaaatgaagggtgtttttgcaaaatcaccaacgacgacacggacgtgcgagagctcacgaaaaccacccgccatccagcgcctcgctaacgcgtcggcacgcgcaggtggccacgccagctcaaaaatctccaggagccgcaaatctcggcaggtttgtatataagcgatggtaatggttcagttattgtaagtattgtcctggtatcctccaagttgatgtgcacaacttatgctgaatatgacttttgtatggacctcgtcatgtaaggctgtcagaattagcatcacttttgcacctatggctgttaggcacttctatggaccttttttttttgcggggttctatggaccttcttatgtatggctaagacttgttctctagttaagtactgcttctatatatgttaaatggtttgcttagttgtgactttcacttcgcaacattgctttggttgcgcactggttatcaaccgaatgactgcatattttttgctgtgttcacttaactccaaatgtgtcagaagtaaacatagttttaagcctgtcaaatatatctcagcgccaaaccacccggcacggaaccagccatactcagtgccaacctatttggcgctgagatctagcagagcagccagccataccataatgctcggcacagctactaagttccccccttcagtgccaaatacaatggcgctgagcttagccacctcagcgccgagtcgggtggcgctgaactttgacacgtcggcacactgagtcggcgtgccatccacggtggcacgacattcagtgccggttgacctggcactgaggtggctaagctcagtgccgaagcatttggcgctgaacctctggtttatttttgaaataagttttgtgcgcggtttatttgcgaaataagttttctgaaagggtcaaattgtcattttttttgcagctctgaagcatgtacaagcagtagagaattgtgccctgtgtcgtccctccagtaatcaccctacaaaagtgtaagtaatggtccaatggggaatttggatggataaaattatgagggccaattaatgtagttaccaatcagcgattcccaaccttaagcaagtttgagtttactcatctcacgatctcatgcatcctactatgggtgtgtttagttcacatcaaaattgaaaatttgattgaaatttgtctaaacaagatttccgcaatactaaaagggggtggctatcaagctggaaaagtggatggggttgagaaacaaagaattttatacaggttcaggccttcttaacaagaagtaataccctactcctgtccggggattgatccaccgagtgtattattgatcgtatgatctgggagcagatcgtgccccaagaggcacccggacccctccttatataggggaaggggtccgtattacaaaatacagtccatatccctaacggaataggtagttacagataagattcaatcgtaaccgactaagatcccgagtatttccttaacatacaagtttggaatttaacccaagtccctttaaagatattctatctatacatggcaccccatacctagtcggattatacatgccgtgtaggtatggggtatccataatctccacagtagcccctgagacctttacagtcaacaaaatagttttctctcgtaatcccaaacgataatccgagcactccaacttcttctgccttggtctcccgagtatcaaaatcaaagactgtgaatggctgaaaatagaaaaaatcaggtgcatcgactagatgcacctaattaggtgtagcccccgactaagtgattagttaaaaaaactaaacatatagtcaaggtgtaaataacatccaaccgagtggttttacaaccgaatcatccaaagtatcatacaactaagcatatgagacgtttgataaaatatccagccgactgctttagctttgatataccaaaaatggaaatataaagaaacccgagtaaaaaatactataaggtccataatccaacacatatgacaagaatccgagtaaaaactctcaaaaagatccatcaaatgtgatataaatcgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgctatagtgcgaaatcacttcggtgaagctagggttcacaaatcccctccaatccatcctccaaagttccacaaaaatcttccgcgcaaccaccgcatcgatctcctatccattcccggccatatttcaaaccaaatcgcatcatccaatttgcatccatggcagaggagagagaaagctttgaaagtcagtgggtgccctctgatgtgacagaggaaaacttgaaggagatggtggcgcacggcgttcttccggcaaaggagatcattgggtggcgtccggcgtgcggcgaagcatttccaacccctgacacacatgaggtcgtggtattttctcatttcttctatggaagattttctcttccaacctcaagattcttccgggggattttggaattttatgggattagtttgcatcacctaaaccccaattccatagtccacattgccaattttatccatgcttgcgaggctttcctgggtataagaccgcatttttccctgttccgtcgcatcttcttcctcaagcctcagccaaacaagagcaaaccatgtgttgtcgggggagccggtttccaactaaggggaaccttgagccaaaaatacttttccatgcccttcaaaacttcgaataagggttggcatgcaaattggttctatgtgcaaaatcccgagccagcgcttcccgagtattcttgtctacctccagtatatcaagacacctggaactcgcttcccatgggagatgaggtggcccaagcacttgccctgatcgatcgcatgctgaagctcaaagagcaaggtctgcaaggagagcagatcacccggcattttattaaaagccgactagcgccaattaaagagagatcccgcacaacctttgagtttgacggcaagcatgaccctaaccgtgaagatctagattctcttgagtttaaagtcatgaaggagagaatgtacaaaatcttctcgaatgctatcgtggtcagttattcgcacttgttgccagtggtgccatacaacgccttcaaccctcctccgcgggtatgtatcaaacatctcagcccttctcaaaagcatgcttttatcttctgcaaagttaattgaaagcttggaatatcatgcccaggaatttgccttgatgaagtcggatcctccaattgctcaacatcgctcgccccgtcggcagactagtcaggcgagtggagtacaaaaaattcggtccgatactcaaccaaacacctcgaaatcgactaaccagtcagactcccgtaagaggaaattggtcctgagcgatgatgaaggtgatgatgccggcaacaaaggggtgaccgaaaaacagccaaggcaagccaatccaaagaagaagacatccagtcgtcccataccaaaaatcaggaaatcatctaggtacaagtcgtttagcaatttcctttgtatcgccagtcactcactattgaagtagtactgatagcatatctcaaacttgcaggaagccatctgatatagatccttccggaaaagaccctgagccgaatggcgcggagactagtccttcaacagaaaccaggccgaccgccgaaggtcgcccgagtgataatcaaccagcaaccgataatgtagaggccagcaacgagcccccgactggaaaccagttggccgaagctgaagccaatgttgaacaggagcccccgactagagaccagtcgggtacagaacaaaataaggacatcccagaagtagaaactcaagctaacagccctcccaggaaggacgctggtgttgacccgggatccaactctcctgttaggataaaaggacctgctcatccccgaccggaaatcataacaggtaaacaagtcctccaaatccgttttgatccaacaaactttcttcaattgtctcaccattattcatgaatatataaggcccaatgattggtgacaaagaagaggtcctccggatacgatcggctgaagattctcgcccacccatattagtcaagtggtgagacgatgaaatgcatccacagggaatcgtgataaataaacagaaggaagacgaggaagtgtgtctgctgaaaaagacacttggacaagctacccgtcttgtaaatgtaagtctctttacatacagcttcaatcatcctgtcggccactttactgaataaagacgcacttgtaatgcagagaatccatcttagaaatgaggcaaaaactgcaatcctcgagaaattggttccccaccttggaaccctggaagcaaccagagatcaactgcgtgaagccaaggagcttgctaggaagactgagcatgaccttagagaccggatcgccgagctccaagactccaactttgagctaagtggttcatcaaaaggtaactctcatccttatctgatttgtttcatgctgctattcatgtgcgattaaccagtggaaagcaatatagtgaaagctgccaagatatccaagctagaaaggcgaatccaggctctggagaaagacaaggtcgaactggcaaaacagagggactcggctctgaaagatgtcgaaggtacttgtagctgaaacttcaaaaaccactctcatcttcatgcccagtcattgatgtgaatttatttgtacagatcgcaaaatcaaatcccaggctcaattcgacatcttggttaacaaaatcaagaagcttgaaggagctagagatgaagtcgccaatgccgctacgccactcgtccaggccatgtttttcaataacaatggtccgagttcaattgatgctgtcgaaatcttcgacaagcttagaactgctccggatacatattttaagaacatcaaagaagctggaagtatgggggcaagtctagagttggcgatgaccaagtccttgtacccgaagattgatattgatgttgttgacggcttcgcagacgggacaagtgaggaagccgcccttgacctcatcagtgatgcgcaaaaagctgccgacaagatagccgctgatgtagttgagaggttacaggacaacgatcttaagccgactgggtctgataactctaatgattaaaaaactgaatctgattgattgtgtattctgatgataatgatgatgatgatggaggcacaatttgtacaatactgatgaatttatgctgtgcttgatgatttaaactcagctctagatttcttaaaagtttttatcaaaccttattgagcctagaacccgcaaaagttgttaaaaactttcagtcctcattggctaagctaaaaaatcaaacaagacaatgataaatcaagtaagcaaattgaattgataaaaatcacactccattattattatagtagcccccgactggtaactcaaggaacaacttgatgttagtagtcaaagaggaagatacaaaagtaatgcctaagcataaaaacgacgaagatgctcaatattccaagagttgtcaacatgagtaccgtcttcacacatgagtcgataagaatctggccgagtaacttcagaaattatgaatggtccttcccataagggagatagcttatgccgatctcgtgtagtttgaattttcctcaaaaccaggtctccgactaagaaagctcgtgaaagaacgttgcgattgtgataacgtcgtatcccttgtaaataccgagccgactggattaaggctgcttcacgggcttcttccagtcggttgagatcatccactcggtcttctccgtagcgctcctccttgaagttacgaaatcgcaaagacttgtccataccattggtcgaaaactcgtacttttattccttaaagtaccataccattggcgcgttcgacttgtccattgctcatgggatgcgctacggaggcataacaaattttgatgccgaagtcttcaaaggaatctttaaatactccgccggtgaattgagtgccgttattagtgatgatccgattaggtaccccaaaccagtgcacaatgttgatgaaaaaaatctatagccttgtctgccgtgattgtgacgactggtttggcttcgatccacttggagaatttatcaacagctacaaagagatgagtataaccaccgatagcttttttgaatgggccaaccatgtcgagcccccaaaccgcgaacgaccaagataacgggatggtttgcaactcctgagccggtagatgagtctgtcgggtgaaaaattgataaccctcacatgttcgcacaattatgtcagcatcagatacagcggtggcccaaaaaaaaccctgccgataggccttgctaacaatggttcgtgtggcagcgtgattgccattgatgcctgaatgtatatctcttagcaattgccttccttcctccaaagacacatagcgttgcagaatccccgatggacttttcttgtacaattcggccttgtgtatgccataaagtttgctgcgcctggagattcgctcggcttcgtttttatctggagggagttcttgcttggttaaaaatttaatgaggggctctctccagtcggcttcaatcatgcttacttcttgagtgtccgtggcctcgactatttctttcctcggtacagttggttcataaaaatgttcaacaacacgtcggaaggagctgcttctcgttttgaaccaaaattagccagtctgtcggctgcctcattattatgtcgaagaacatgggtcagctcaaggccatcaaatttatcttctaacttgcgtacctcctgccgataggcggtcatattatcatcaaggcaggaccactctttcatgacttgattaacaaccaactgagaatctccacaaactatcagacgccgaattcccaaggagatcgcaatccttaatccgtgaagtagcgcctcatattccgccacgttatgggacgcagaaaaatgtatccacaatatgtagctcaacctctctccagtcggggagattagaacaacccccgctctggtgcctgaaagcctctttgacccataaaaatgcatagtccaatactcgatcttctctgcaggcgtgtcttcttggcacttggtccactcggcaacgaagtctgctaaagcttgggacttgatcgaagttcacggcttgaaggatagatccaaagacatcaactctaaggcccactttgtgatccgcccatatgcttcgtggttttgaagtatatccccgagtggaaacgatgtaaccaccgtaacgagtgatcttgaaaatagtgagataatttcctaacggtaatcaaaacaccatataacaacttttgaacctgaggatatcttgtcttggagtcggccaaaacctcgttgacgaaatagattggtcgttggactttttgaagatggccttcttcctcacactcgacaaccaggaccgtgctcacaaccttggaagtcgccgacacgtataacaacaacggctcttgcggatgtggtgaagctaagactggtggagtagtgagaagtttcttgaagttttcaaaggctttttgtgcttcaggtccccactggaagttgtcggttttctttaacaacttgaaaaagggcatcccccgctcgccgagtcgtgagacaaatcgagtgaacgccgccatacatccagttaacgtttgaacatctttctgggaactcgatggtttcatgttgatgatggcgttgattttctccgggttggctcgtatgcctctatgggacaccataaagccaagtagcttccctaactgtactccgaagatgcacttttcagggtttaatttcatcctgaaagcgcggatgctcgcaaaggtctcttctagatccgtaatcaaatcatccttctgcttggtcttgacaactacatcatcaacataagcttcaacgttgcgaccaatctgagttgaaaagcatctctgtatcatgcgttgataagttgctcctgcattctttaatccaaaaggcatggcgatgtagcagtaggccccgaagggcgtgatgaacgaagtcttcaagcagtcggactcctttagtcggatctgatgatatcctgagtagcaatccaaaaaactgagtaactcgcagccagccgttgaatcaactacctggtcaatgcgaggtaacccaaagggatctttgggacaagatttattgaggtcggtgtaatcaacacacatgcgccattgccccgtcttcttccgaaccaggactggattggccagccagtcaggatgtaggacttccttgatgaagcctgctgctaacagcttggtcaattcctccttgatcgcatccttcctatcctgtgcgaaatggcggagtcgttgctcgataggtttagcatcttccttaacatgtaaagagtgctcaatcacctctctaggaataccaggcatatcagatggtttccacgcaaagatatctttattattttgaagaaaggtgatgagcacgctttcctattgataatctaactaagcgcctattacagcagtcttagtagggtcagagggatctagaggaatcttctcgatcttggcatcgccttctccgccttttgacatcttggttgcagacacttctccttcggttgcagtgaacgcagccagtcggatttcttctcgagcgagcgcaatctcgcgggtctgagctatctcccaactttccttgtcgcaagtgacagcttgcttgatgtcactccgcagggatatgactcctcggggacctggcattttcatcatcatgtaggtgtagtgcgggacagccatgaacttggctaacgccgggcgtccgagtatggcatggtacgctgtctcaaaatcagcaacttcgaagcaaatattctctgtgcgaaagttctctcgagtgccgaaagtaaccgacagagtaatctagccgagtggagtagaagacagcccggggatgactccgtggaagggcgcattacttggcttcaattccgtgcgagggatttgcatgtcgtccagagtcttggcgaaaaggatattgagtgcagtgccaccatcgatcagggatcttcggagcttgatgttgcaaaccactgggtctagtaccagggggtaccgccctgggtggaccactcggtcagggtgatccgagcggtcaaacttgatagttgtttctgaccaccgaagatattggggcgtgtcgggctgaacagcattgatctcccgttcagtcagcttttgctttggcttggattcataagccaggggtccgccaaagatatggttgagctccttgcgggggtcttggaaaccagtcggggcatcatcttcatcatccttcttctttgatgtgctttgatctctgtaagtcgacttgcgtgcgttcttggcgtattgctctgcgaactgtttgtaaacgaagcagtctttggccgcatggttggaatttggatgatgcggacattgagagttcatgatcttgtcgaaagtgttgacgcgcgaacattgtcgggaggatggtgtagtggttgccacaagttcctcgggcttacgcttgcgatccttgtgattggtacttccactccctcctgtggtcggcgtatctttcttcggcttccaagtggtgcccgactgcttagatgcggtgacggcatcttcggcttttgcgtactcattggctttctcgaacatctgcttgactgtcctgggaggcttgcgtccaaacttgccaactaagagatcatggtgaatgcccttggtgaaggcggcgatgatgacgtcgtcggtgatatcggagatcttgttgcgttgctcggaaaaacgtcggatgtaatctcgaagggattctccggacttctggacaatgttgtaaagatcgaactgggtgccagggcgttcaaaggtgccttgaaaattggcaatgaagtggtcgcgaagttccgcccaagatccgatcgtgccacggggtagcccgtgaagccaggaccgggcagaatccgctagggccacgggcagatagtttgccatagctttgatgtctcctcctgctgcgcgaattgcgagactgtagacggtgagccaagtctcagggttagtggtgccgtcatacttctcgattccagtcggcttgaagccggctggccaatccactcgacgcaggtcgcttgtgaaggcagcaactccatccacgtcgtcgtcgtaacgatctggtgaatggtgggggatgtagcctcttgccgcacggcgctgattgatagtttcgcgaagatcgatgggacgcctgcgatgtggggagcggggacattcagctcgacgctccctgtgtcggtcaggaggcgagtgaacggattgctcgtcgtgatccctgctcctacgactggttccggcgccgacgacgctgaggctcggttggtgatagtcttgagattgaagaggcggaactcggctgccagttggcgtgcggacactcgcggagttaaccgggaccgaagctgcgatcatggtcttggtctggttcaagatgttgacgacgtgattggcctgattgagtgcgtcttccttgaggagggtgtcgaggagggtgatcgctgcaaccacgttctgttggggggtgcgaaaaaccgccgtcccctcgacatcttgttgcccgatgagttctcgtgctcgtcgcccggcctccaagcctcctttgcagctcgctcgcgctcctgttgctcacgctgcagccgttctcgctcttgtgcttggcgctcctcctccagtcggcgacgtttggcttcctgtcgcacgcgttgttcttcttcttctcgggcttgacgctgtttttccgtctcgttgtcggccatgaaaatgccgaagtagagggggcgtgtagtaatcttcatagccttcgtcgaagtcgtcgaggttgcggtagtcgtagcggtagccgaagtcgtcgtactctacgatctccgttggtcgtgagtcgacaccgggggagctgaggtagccgtccaactgtttcgtcgaaaccgtgccgagaggctggagtatgacaccgacttccctagagctagactggatcggggccagggcggatcccgcctagacctacggggagatgacgctcttgtggtgaaaacgacagccaaatcgttgaggagtttcatcaggattggcggataggctctattgtcttcatcgggtcgtgttggagtagattggatctcgtccgagtggtttggggccaactcggttgagatgatcttggggtagatctcggccaagtttggggtacgaacggggcggaaacctggtctcttcccgactggttcgaatccgagtcaagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctcccctcccccctcttcgcctgagtcgagtcgcctcccccaccgccggccaaccatgctgccgccggccgcccgcctcgcggcccgccgcctcctagggctcgcgacctcctccgcctcggaatcggccgcggcgcgacgcttgtcccgttctccggtcagtgcccccctccccctcctccaaatgcctctgtatctcctcgctgttcgtcggcggagctttgccgtcctgatctctccctccgggggcaacgtctcgttgcagatctcctacgccgccgcgggctgctcctccaggctgttctccacggcgcttaactacgtacgtgaggcgcctcccccttccctcggatccaccccctaccctcttccctgatctgtctgttttgtctgaggatgataatgagtcggatttgtgggtttgcttgttgtgcagcacctcgattcgccggaaaacaaccccgacatgccgtgggagttcacggaggccaacatgaagaaggtgctgttgttcgtctcgttcattcatttccctgtgatttatgttttggattggaacagtggctggttttggagtagttgtggcagaatttgttcagttttgttttcggatgttcagaaatggctgttagggtaccattttattcaggactattagataataatataatcttacgttggaactggttgctggttatttgagaaggggaaacgttatctgtcatgtaaaacctttagaaatgtgcaaatctgcaaatgtccaaatgtaatagagacgtggggtatagtgttctattcctttgacatgggatttaggttttgtgaatacggtttatatcaattgtatcagctattttggttatctggcctaaaatctctatttcaataactaattcaggttaatgagatattgtctcactatccaagcaactacaagcagtctggtattattccaatgcttgatcttgcccagcagcagcatggtggatgggtgccagttgcagcaatgaatgctgtaagtcccttttttatgagctttcgatgatcaactgttttccgcctttaatgtgctatatcctgttttcaatacttcaattttcagaaagtgatgtacctcaacatttgttagttgttacaacccacgttagctatagttatattggacttgcttagcagacattcataaatcaaaaccttattgcactggccttgtttctgttcacttcttcgtcctactgaagatgggtgacactaggaaattaggagccttaatagtaagaggcattggagaatgggggttggcaatcacaaaagaaaaagttcttgtcagcatatcagttgacatatttatataattataattacaattgagttaatctcctcaggactaggactattacaataacattgctactgggagtgttatagcttatgttacattttagatattttgtacatagacccaaccaccattccaccaccactgtgctcacaaaaagcatttctgacaatactattttcatgtcttggactttcagattgctaagatcgttgaagttgcaccaatcagagtatatgaagttgctacattttacacaatgtttaaccggactaaggtatctttgcatgacttagtattttgtacttgttaatccctccactagcatcttttcaccctattttgccatgtaggtgggtaaatatcaccttttggtgtgtggaaccacaccttgcatgattcgtggttcacgtgaaattgaagaagccttgttagaacatcttggagttaaacggaatggtttgtattattcacataacttatcctatcaactaagaataacacttcctgatttgttaccacaaacggtcttcgagcatgtgtttctcttgctatctctgtgatagcattaacatttttctttcatttgcagaggtgaccagtgatggtttattttctgttggagaaatggagtgcatggtaacttcgagatctataattttctgtcattttggatgcttgcaaataggtgttctagttgagttaagtgtttaactatagccaataggaatggtctgtaggattttgtcagtgaatgattcagtactctaatgaaaaaacataagtacaaggcaactttttattcagctttctgttatatgttcacagggctgctgtgtgaatgctcccatgattgctgtggccgattattctaaaggttcagagggttacacatacaactattatgtaagtatacacattgatgcatccgattatctattgttgatgacttatgctagtacacgcggtggaaattttagtagaaacatcacagcattagtaagaattagcagctggtgcccactcgtgttagttcatgtttatgcacaaaatgaaacattgtcaactgaagaatataaacttgcatgttataggatgctgggcccctgggtttctatacttcttagcaggcgtctttggagaaataatgctaacatagctacatttttttgctaaacttccatgctatagcagtactgtggcactgaaagcactaatgccaacagagtaacaaaagacgagtggataaaacttaacaaaacctgcctgccttttgctgagagaggaagaaaagacttatttgtgtactgtaactgagcatttccatttccccttttcaggaggacctcactcctaaacgagttgttgagatcgtcgagatgctgaaaagaggagaaacccctcctgtaagctttgctcttgaacgaaataattcttttgatatttctagcgacaagttttactcagtttgatgttatagatatcaagccccaccattggtttaggttgcgaactgattttgatgattgtgatgatttttgcagcgcggcacacaacacccagagcggaaaaactgtggccctgctggagggaataccaccttgcacggtgagccgaaacctcctccgtgcagggatctagatgcttgctaggtttgctttgaattacaggcacacaaataagttgggccacactatgattatatggtgtggaaactggaacaaagcaaggcgatgtgttgtttgtattttgatcttgttttgtttacctctgcccgcatcttttttctctccttttgcaccatcagagaaatggtacattgataatgacgatatgttattttgtcagctgacatgaggcggcagtggtaaaaagatttgtattcgtctttcggcaaagataaaactcttggacattctctttttgggcattccttttcagcttctgattagtgatgagtgcccattaaagcacgacatcatcgcgtgttacattgctaatctagctgtttgatcttttagcagccgttcatgatttgatcatgaacattacattcttctccaactaagttactctagaaaaggttagggcctgttctttgtctgctcggatgatggattaagtgtatgacaattattcaagaacatgaaccgatgaattaaatattacagggttgaaagttgtattttaaaaatgaagttctaatatatgttgatgaagatttttttaaaaaaaattatagcgtttaaaaacttggaagcgtctcctcgtaatccattactcgtaaacaaaaaaaagaatacgacctaaacagctaaggccatgtttaaatcccacccaaaaatttgttaccccgtcacattgaacgtttgaacacctgcataaagtattaaatataggctaaaaaataactaattacacagattgcgactaatttgtgagatgaatcttttaagtctaattgctccatgattagataatgtggtgctacgataaacatttgctaatgacggattaattaggcttaataaattcgtctcgcggtttcctgatagattctgtaattagtttttttattaatacccgaacaccccatgcgacactctatgtactacccgatataacacgccaaaatttacgaccctgtatcaaaaccaccccctaaacggctaaactaatttcggtgctttctctcagggaccattttgaatattacgcgttattatttggacctacctgcaaatatctccttgtctttccgccatcagctttcccctcctaaacctctccccattccctcgcaaaaccctcgtctcctccacactctgctcttctcgcaaaccctaatcccacgcgcggccacctcccatggcgcgctcgacctccctcaccgaggcggaggcggggatcacctgcttcgcctcctccctcccgggcttccgcggcgtcctcaagcaccgctactccgacttcatcgtccacgaggtcgcccgcgacggctccgtcgcccgcctcacctccttcgatctccccgacgaggtaagcttagccctctcgaccccgattccgcggctccctcccgggatccccgattttttttcatcgcgctagctcagctccgccgtgtatcgcagtgcgtggatgtgagtgaggaggacaaggcggcgccgtccgccgacgcggaccactcgcaggccctcgagtcgttccgtgcgctctgtggcgatgcggattgcgacgcgttgaaggggctcctcgagaaggcgtccgcgggggctgaggctgatgtatcgccggttattctctcgccggacgccgataaggctcatcgatcggttggtttgatcccccagttccagtttctggttgtttatgtggttgagattggtggaaatggtgtgatttgggcgtgtttttggctgtaggaggtgcataatttcttcaagaggagcttcaagtttttggtcaccgacacggtcgaacacaatgatggagttcagagatgcattagggtgcggctgggatcaggagctagggaagggcggggtgccggtggaaaaagtggtggtgggaggggaaggaagaggaagaacatgggtggttctgattggagagatgacaggccatttgatagcagaggatcaactagctggccaaatcatgttgggaagttcctaaggtggtggaattcagcttgaattgatagtttctattggcctggtatctttagctggcctttgtactcgaatgtgttcatctgacttgctgtgtattttacttggctaaacttaataaaaaacatctaatctatgtgtataaatttgtataagaaatattatgtttttgcttcgtctaattttgctgttaattagcgttataaccggagttgtcattctggtgtgctgaccaggtttcacctttgcaaagagaacaaggacacacaagaagcgttaggagtaattgggaaaatgttaggacttcaggtatacctcggttgctaactcataacattgtgttcttgtttctactgaatgctttgattcttcttttttaccttccttcgcattcctagttgatttctataccttttgcaatttgcagtcacgttcattcgggtttgcagggacaaaagataaacgtgctgttacaacacaacaggtacttattcctcatgtgcataccatctcactcaattttctttacataaatcgtgtttttgtacaatttgtttaaaagttcgcatacaagtatgcaagaaatactggtataattttaattaaggcataatttatggtattatgatgttacaaccagatgagataagtgaagctgctctggtttggaatactacatgtagtattgtcttggcaaaggagttttgtgaaatgaaactacaagatcatttttctttaactagtaccgttcatagtttttagtcttttcacctttagtttgtattgcttggctttgttctcatctctagcctacccagcttggttgagattaaaggctggtgttgttgctgtattttgcatagtgatttttagtctatttgacagatttgtttatgttatctcactcctttttcatggttgtgatcctctgcatgtaattacgttttcttgcaatggttacttttctgattgttttcccctggttaggtgactgttttcaagatatcagccaacagattggctgcacttaataatcgactatttggaattaaagttggaaactttaggtaggtgataaaatgcattatcctctttgttgatatcattgcaatgtaattattctaaatactaattatttttgcattcctttctagttatgtgaaggagggacttgttcttggtcaactaatgggaaatcgatttacaattactctgaggtacttgttttttatttctccttttagtttaatgtaaaaaactaaaaatgttctctagtgctctaaaaaatgatttgcactaatcttagagctcatggagggcctgatttgcagctacatattacttcactacaaacagtactatatttcacatgcaccaaacctcttcttttcttggttcaagaaaaccaaacaaatggagagctgatattttcctgcatttcttcaggggtgttgttgcagaatcagaagacataataaaggcttctgtggagggcttaggaaagaatggatttatcaactactatgggttgcaggtatgaagccagaaccttttcgttatgcttcaaaacctaactggtacgtgtttacttttgaagctcatcaagttcatcttttttgttggttagcgttttggaagtggttcagtacctactcaccttgttggagctgctttgcttagaggagagtggagaagttctgtaaatttgattcttgatccaagggaaggagatatccttgatttattttatccaatcagcagttgcatacttggatatatagctgtgccaacttttgttcaacataacttaatactccgaacagagagatgacataagggagatgcgtgaacattacaaggagcatggtgatattgatatggcactaagaaacttccctcgacatcttgtagccgagaaggctattgtaagtgtagttcttttccttcattacttaacctggaattatttaaaacattggctttttagtttttattcaagttatgtaatgtagatcacattatttggggaagttaaactgatattctttcatgcattgtttccagcttcaatgtttgaagaaatgccctggtaactatctgcaagcattaaagagtataccaagaacattacgaatgatgtatgttgtttaactttcttcgtcttttcatgtttctttacattgatgggttagtcaatttctgttacctcaaaagctaagtagattttataatatacaaaattgtattggaattattatagacattagtcatgaacagtagtagatctgttatatgtacctgtttttaaaattgttctctgctgctcaatatacataccgtttgatatattcaagcttttctgttaccctttttctctgttctgttttgttgaccaatttattaattctcatattttgcttatgcgtctttcttatttgctgttgcctcttttatgaaggtacgttcatagttaccaaagttacctctggaaccatgctgccagtgccagagttgaaaaatatggtcagtgcacttcatccttctacagctactcagttttagttgaatcatgatgcagtttgataattttctgataacggctaaccttgacctttttcttcaggcgtgttaccttttgtagttttatatggtgaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttctgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatattgaatcacattgagaaatatatatggtgtgcttatttctgtaaacatgcagttcgcaagcattatttcctggaaacggaattgctgacatttatcatgaattggctaaaaaggtgctactatcctacaaaatttattttatagtttattcagaagtacttcctttgctttgccaggaacttgtgcattcttgaatttcctctataacccttctgttgctaaacgcaaaaaagaaaaacacatattgtaggttattggttgctagatatgtttactgtgaaatgtgtttagtttcccttttctttttgtggataaacgatacttctgtaatgtcacaggtttaattggctaatatattatgaatgaattacacaatattttttaaagtgaaagattaaatccaagaaataggaatcatattgttgatttgctttcatgtctcaggatggcattagcttgacagagaatgcacatggtgtcaagtaagtttctttattttactgtaaagatcaaaggcacctctaaaagtcaatacttagtatatgtgctatgacaagctttatatctttttgttctgatatcctactatattctcattctgttgtatatattaccttggcttgcatatttcaatttgctactttataccctaacttctatgctatatgatacaaactccatttttaagggagttttcaattacaagcatgaaaggaggttatcggcgggtgttccagcggcctattgattttgagtggtatgccttatcccattgacttttcacttcattagatgaccaaaatcatcaccttttctttcgtataaattctagccctgttccactaaaaaatgctttggtgtgactgtagggaactcatgacttatacagatgacacagcatttttagcagaaactgatttggatgttctgtccagaaacaaacctacaaaagccaaggaagtaaatgagactatatctagcgcgatttcaaatgctcaatcacatgattccaaggtggcaggaccattggatagctctatgccaggtagtgaaactggcttagtagaggaaaagtctgtcggtagctcagatatgttagcaaggaaattggccataaaattagcatttactctaccagcatcttcttatgctacaatggctattaggaagttgctgaagacttcaacctcggtatgtttctcaactaatattatattactattcttttactagaatttaaatgatgttaaatggactctgtttatggtgttatgcatagttaagaatgcatgcctacttgagaattcaaatacatttaattatggcagttgcccaacagtattgttaatattttaggacgtcaggagaaaatattgctgaatatttcaatatatatgctattgctctaacatgttaacaaataacaacattcatttcataattaccttctgctcgtctgcaggtcacgtatcagaaaacactcgattgttaattttgttattgacatcaattctttatggggaatcttccaagccgcatcttagaggagttgacatagttaagcaacatgagttggtatggtgtttgaattgtgtttgtgtaatttttatcgcgtggcactaagttattaacttataaatcctgatctgattattgcagtattgcatttaacagcccaaatgaatcggcattgagatataccatgctgctcggcctgctcccgttcggtgcatactgaattgctgatgcacgtttgtgctattgtgggggttaaaaacttgttttgccactagaatatgtg

SEQ ID NO: 57586 - DNA, 1685 bp, Oryza sativa
gtacagtacttcatcatccgattttaaaaagcgatgttaaatacataaacttgaaaagtcaaattagtggttagactacaaggtgaaatgagcaattaccccttcttatattggaaggaacacactgaaagtctaaaactgtactctctctgttccaatttacttgttatccaggcaaataccgtgcaaaccatgaagatgtgaaagattacatggttgcccttgtcagatacatcttaattatcttttcaaagtagatgagccaattatgaccgcatcaatatgtattgctgcattactgtaggtagggagggaataatatcgatcacctttaaaatttctttggatcgagaaaacgacaaataatttaatataaaattaaatcctagaacgacgacgatgagtaatatgaaacagaaggaagaacatgaataagcagtgcacattctagttgttcctgcctctgcttaaatccttccatggcctttctccatttgagttatgcatgtcccggcgacataggaggattgtgtcccccgtttgggccgcctgaaatgtactcatattaagtatggacttgaagagttggagtgatatcaattccaattaaatcatatgtacaaaagaaaataatattcactctggttaaaaatatgtgtccttttggttttcaagaaaggtaatgcattttttaatgtaaaatttagtatccttaagtacatcagttacctgagggagaggggaccgacctgagaggtgacgagcagcaagagctccactggatttgtaccgtcatctaggtttggagcctgcgacaacagcgaggttgagcgaagaacggatcactgatgaggggtgagctcgagagcctggcaacgtgccgttctcctcttgtcgctgcagccaccgcctccttgacgtctgttctgtcaccaccgccgtttcttcgatggcggcggcaacagagggcgcagcagcggccatcgacgatggtgacgaaggatgtagtggcggctgtaacaccctaggtaaccacgtacctagagtgccacaccaaaatacactcaaaacctaagtcccaaaattattagaaatttcggtaaaatctcccctaaaaaatacggacatccacgacaggcagttataagaaaaatcagtaccgatataatccacacaatacaaaccattctagctccacaaattccatgtgaaaacaggtagttataagaaaagtcaataccgatataatccacacaatccaaaccatcctagctccacaaattccacgtgaaaataaggaccagaactttaaatgacctttacaagttctacgcaaaacttgtgctatgcataaacatagtctaaaactaaatttcaatagtgtgcaataataaagtgtagtccaagggtgctactcccgccccatgccgatcaatgtcattaggtacctaaaaaccaaattaaacacaagagtgagtaaagaatactcagcaagtacaatcttgaactagtaaacatacgcatgatttatgcattaagaaaccaacatgaagggttggatttactttatttttaaaccaaagaagtcaaaagatagtagttccctcccgggcaggtgtgaatatcctcttagcattaccggtaagccaagcaagcgtaatcagcgcttcacaaggatcatgaat

SEQ ID NO: 57587 - DNA, 1048 bp, Oryza sativa
atctatctatctatctatctatctatctagctagctagctattttctatgtatgctaattggacactctgagaaagtttctactttaactgtaaaaatagtggataaatctagccatccctaattataatggcttaaattacaagaagatccccatataattttatcaatcaataatatcaatcaatattggatttattaaaccgagaaatgaaaagtcatataaaagagtattagagtgaatcctgcatataatttaattttaaggactaaatttaaagtttaaaaaatgcttatcaaataattttttttgaagtacttaaaaacattaattatattttccccttaattattcaatcaagaaagctaaaattaagattctatggcaagtatgactttgtatttatttactcttaatctttggagctattaaattaataaatgaagagtagcagaaaatagtgttttcatgaatcatatgtataatttttagtgctaaatctaaaatttaaaaatacttataatttttttattttgttctgaagtacttaaaaccaatgtttacacatatatatagtactatgtactactagcctacacaatggaagatttatataagcaatacttgtcaactttctttcgaaaaggacattatattttaagaacaatttaactaaccaagtgtacactttgtgtcaagttcttcaccctgcaagtattattcacatctatgagcatattcccttctgtaagcgtagggagctcttccaaatgggcaaaccatagcagtcaagaggctgtcgcgttgctcacagcaggggataggagagttgaaaatgagctagttttggttgggaagcttcaacacaaaaaccttgtgagactagtgggtgtttgccttgaggacgaggagaagctacttgtgtatgaatacttgcccaataggagcttggacactattctttttggtatattatttgtcttttttttaatactattaagtttttttttaacattatactccctccgttttttaatagatgacgccg

SEQ ID NO: 57588 - DNA, 9835 bp, Oryza sativa
cggcgtcatttattaaaaaacggaggtagtactattaagttcggtatatattcatcactcacaatgacgcgaaatctcctttatatttattggtggcagatcaagataaaagcaaggaattggactgggagaagagattcaggatcataagtgaaattgctcgagggctacagtacctgcacgaagaatctcggttgaaaatcattcaccgggatctcaaagctaacaacattctactagattccgatttaacccctaagatttcagactttggcttggcgaagttatttggaggggaccagtcgcacattgtcacaaatcgtgtagctgggacatagtaagtgccttctcaaattcaatccattcattctgttttatcttactttctttctttgccaatcatgtctctgtcactgaactcgaggcaagataggtcagaccaattttattaaaccttgaaacgatgtactccctcggtctcataaaaaaccaatttagtgttggatatgacacatcctagcactacgagtctaaatcagattcgtagtactaaggtgctagattttttttggacgaaaggagtactctggtgacgggatgttccattacaagaggcaaaccggaatagcctccgattcctccgaagtggaacaatcttggtcagctcatctctactattgtaaaaattgaagatgtttttgtcggtattttggtatgtcatccgtgtatgagtcggtttttaaattcgtttgcttttggaaatacatatttgtatttgagtcggtttataagatcgttcacttttggtaatacaaaaggtatcatataagaaatctgtttaaaaaaactcgcatgctaacttgagacgatcaattgaactcctaactacagctcatgattttctatatatatataaaaatatatatatatatatatacacacaagcgaactcctagagtggatttcatcttaactaaaccatataacaataataaaattaaaatagacttcacccgttgcaacgcacgtgtatttttttctagtatatacatgtattcatgccggagtatcgatggaccacatgaactctttaagtattttatttacttttaagataagagaactcttcttggtgacatggcaaatggctgatgtcgcttgcccaaattaaggattgtttcatggatttatgaaaaggtcaatttagaaactgaatatataagacaatcatcttgcttttcattcaaaaaaaaatttagaaactgaaatccacgtgcgcttgtctctcgtccccgcccccatgcaggatgcacggattaagcatcaaaatatgcaaaaattatttatgtactagtgaaagtgagaaaaaagtcatactaaaagggaattgcagtaaaaaaaattgctcaggcatctatgtaggacgaacgaattaaccatcaaaatatgaaaaaaaaattatgtactagtgaaagtaagaataaaaaataaaaaaagctatatgcagaaattgtttatgtacctgtgaaaatgagaaaaaaaagtaacaaaaaagctcaggcgtccatgtagggcgcacatatataacatagtccgaatttatgattgctttacgtgtacggtcgagtacacggctaaatctccagctcacgatctctgcttcagatgtcgcgacctagaaacataaggtgcctccgaagaggcaacacgttgtgagatggaaactcttttatataggtcacaaaacatcaaatctatcgaggtgggacaaaacttgtggctaatacggtaattaactacctgcgcagccaaagagcgcgcgccgccgctgcgtttcttcctccgccgtccgctgctccaaatgatttggattggatgcgttcatagctagcatcgatctctaatcttaattccacatgttaatctccattgctaattacttattagcattacattacttttggataataatgtaaaccattagtactaattaagaaacttaattattacaactcgcggatattaataacctggtgaagagaagaactcgaattattaggacacctagcttaactgctacatcatcttgttcttgtagtggccatctggttgttcacgcgctgcgtgcgcgggcgaggccggcgcgtcgacctgaacgcgcgcgtgcgcgacgtcgccggcggcgccggcgccgtgctcctcctcctcggccctctccaccttctccttggtcatggcgccgacgtcgaaggctgccctggcgacggcgcccacggcggcggacacccacgcggcgccgcgggacgcataggggctcgaagccaccacgctcgccgcgccctgctccgccgcggtgaccgcgacgcgggcgagctccgacacctggaaccgctcgtccacgccgcgcacggcgccgcgcgccgccgccgtcccggcgctgaacttgtcgctgagcccgaaccggcggtccagcgacgccacccgcgcgctcgccgtcgacagcagctggtgccggtcgtcgaacgaccgcgcccgcttcagcgcgtccttgctcagcacgaagcccttggccagcatcgtgctcaccacctcctccgccttcttcaccgccgcctccgtcggcgtcctcggcgagcccgtgtccttgtacacacacaatccaaccccatgaattagcaataaccacatagttatttagaactcgcaatggagcttccaaaatatttctttccatagtcaatgtctcagttttattaactcgggacagcaaaaattttgaaaaatactatcgcggagatacatgagttgcaaaataccgtctctgagaatggcatgtgggacttggacccacgtgttaatgacatgtacgacggtattttccatctccgtgatttttacgatggtaccaagcaaactctgatttttgacaaactccgtgttctttttataatggtaataggcaaattggcagcattaattaattgcaatagaagaacatgagctctctcaaagtctcacctgtctgtagaagtaggcttctggaggtagcacatagtcttccactggtgtaatgttcactgaagcttcagatatgcttgctccctgaataataataataataataataataaaacaaagatcatcaaagcatttcaagattgcacatttgaaaacatttcacaagatttcaggtaaaatagaaggtcatgaagaataaatggaagaagccaatatggatgcattcagataactcacagagagtagcagcgcagtgtctgctccatggaactccttgaaggtcacataggcaacttgtgatgtctctgattcccttcaaattagtaatttgaacagaaatcaatataacatgttgattcatgaataattcggcattatggagagagcgtaccgaccttcgcatttccacgtattcgacctcaccggagaaggagaagaactccttgatgttgtcagcagtcgccgacatggagatgtttgtgaccttgattgttcttgcctgaataaaataaaaaacagaaagaaaaacatcaacacatctgtgaccctcattgttaagtaaatcaaaagcattcattcgaatcaggatgtggatatatattatatatgttgggggcaagaattaatgtgtcatgtgcgtcaaagagagatcccaactgaatcaaacgtgtggcaagatcgacagacagtgagactgaacacacatcaaagaactcaagatggtgtgatgatctgaagaaggcagagaggggggggggtgtcagttcagtgtcactcacatctgagacatcaatggtccaattgggggaggtgctgatgagttgatgaggaggagatggtggtggtgatggtgatgaagtgctgaattggggaggagtcacccctatcctcagatagcccgggtccagccggacctgcagcaggagagacatgcaaatgtatgatcaaaattgatcagggcttaatttgtttttgttttgcaaaactggaagagttttgtaaatcaataggcagaattctagatttgtacagatccatttgacatgacatctgatctagcgtttggatccacaaggaagacagacaaatcgcaatggaatctgaacaaaacaaggaagaatggcaaaaggggagctgtgtgcattctttcctacgatccttcctatatccaagaaccgaataatcaacaatgcagtagtgacagggtttgtttggtttgtgatgatgatcactcaccgccatgaacgactcctgcatccactgatccaagctacctaatgggcgtagagcttgtttgttcactcgaaaaaacctctcactctggatcggcgtcgaatcgttgatcgatcatcaatgttattactctgctcactatctcagagagagagagagagagagagagagagatcggacagagaggggcgggcaaaatggtaaatagacacggcatccggcacggatggagcagcggcaagttcgggtttcagtcgtggtgggtgcaggtgcaagtgcatagagcagcaaaaactgcgagaatcctcttgctcggtagcccgatttgaagaaaaaaatcgggctccttgctactactgcatgcatacaagataagtggagtagctagtttatttttttttgttctcatcactttaaatattttttctcctaaattacttattcgacttacgatccgatcgtaccattgaatacgttgtaattaaatccttacaataagatatctcataattatattttgataaaagaaaaatatatgttttataccgttaaaacttattgttttatatgtgatagcgatatgtttcaaagtgtaacgtttcacaaaatttatttaactatctgcacctactctctctcctctatatccatgcatggatttaaaaaccttcaaaatgattttttttctaaactacttatttaatttacgatccaataataccattgtgttcgttgtaattaaatcttcactacaagatatcgcatgattatgttctgatgaaaatttggttgccattttaatatttttttacataaaatatgaaaatatatgtgctattatgtgaggaaaaagtataaccgtgctagccgtgcaatatgcgcgggccaccatgctactttcatatatatataagagagaaataaaacttgtgctgcctgccttaggcacagtttgattctggttataagcttacctactctctcgtttttcataagcgcatgtttcctaaattgctaaatgatattgtttttcaaaaacttctttatataagactataaggggtttctttaaaatttaataaatccattttttaaatctataataattccaagtatgtttagcccaccaataagctcaagtgaaccacagcccgattaacccatcaaaattttcatcgctagataggccaacttcagggccggtcctatgattttgatgggcactaaaagttatatataaaattttatgatatatatagacgctaattttacttgtaaaacgaaaacaaatacatctatatattaaatttaacatatctggtaattatcgagaaataaaatcaaccaaaataacaatatatttataccttggaactaataccattacattgatgaagaaaagaaccccgtcatatccattgtttctaatgaaaagatacttcttcaagtatttcttaatgcaaaatcatcgataacggtattaagatcaatagtatccaagatcgggcgacgaggcgatgatgctccaactcctctcgtttcagcgtttctgctttcagataggccatagacaggtactagactattagtattaggtattggctccccactatcatgggcccccaccatcatgggcccccgacggtcgcctcggctgcatagggctagggccggccctggccaacttaaaaaaaaacgacccaactaagagcaagtataatgagctataagcttactataatcttatgtggaggggagaggtaacaaaaaaaaaattaaggggttggctctcatagaagaactagcttaacacaatccccaaaacaaatgtattaaatatataagtgagagagagatgagaaggaagttgtagtcaaccttataactaatctattatatatgttggctttaagaaaagctaatagtagaaagtgaactatactattatccttgctctaagtacagctcatctaggacactaatagagatccaatctacgcggcacgaatcacaaagctccccctcttccattcattgctcgccctaggggtgacaaaatccgagttggggaccagtccccgtcgggtcatattttcaacccaccggtctatcaggataaatctcacgttattatatttcgatggataaatcttcgcgctctatgttgaggaggaattgcgtagaaggcggggagcctagtgtacgctcggaaagatatactctctccatatactttggatagttatattttatcttagcacacagactaaggataagtaattctacttatcatctatttaaacatgctactagtcattcctcgtaaacaagcgattcattaatatttacatttttcgatgcccatgtaaccaatcttgtgtgaaagaatagagagtcacacattaaattcgagaaagtcattaagatgataggttgttggattgaaatataactattaaaaataaatttttcggatttgaaaatatacctatcaaaagtagatggagggagtatttacttgggggaggccgggagggggtatttactttcgccgtgtttagttccaaaataattcttcaaactttcaacttttccgtaacatcaaaactttcatacacacaaacttccaacttttccgtcacatcgttccaatttcaaccaaacttccaattttggtgtgatctaaacaaagcctttgttaggttcattaactatcatgtggtcacaggatcccatactctagctgccctcatatctgtttatgttagcatatgaatttttgtaaatgaataaaaaattttaagccgttataatttaacttcttataagcctacgaaagttttattacaactagctaaatgcatgtgttgtaacgggagttaaataaaagaacctcacattacattttaaagcctcaaaaattaaataaaattactcatgtcatattatttgttagggaaaattgcaaaaaccaccccaaatgtcactctgagtttgagatgcctcaccataagaagatttgttacaaatccccacctcctaattcaccttggtttgatttaggcaccttctctccacacgtgcgtgattcctgaagaatcttgtggcgaaatcagccgagtcccactcggcaggagcaagagattatgttgtttgttctgtataatacgatcatttcgttgtgttatcatggccatttcactgtgtttttcatggtaaactaactatatattccaaactgatatcatatgtactgaactacatatccgtttttttcggacgtaatgagtatatagaaacatttgaacaggaagcagtaatcatatagccagattatagctgcatggcttcatctgttgcaattagtcatatgacccaaaatagcaggttttagtacagtttaatcagcaattaaggccacacaatctaatgcaaaagggacctgttgacaaatcatcacgatgagcaggacttggctaatttcgccacgagatgctccagtaatcacgcatgtgtaaagagaaggcgcctaaatcaaaccaaggtgaattagaaggtggggatttgcaacaaatcttcttataggggggcatctcaaacttagagtgatatttggggtggtttttgcaattttccctatttgttattatttttacatcacttcaaatatttttctcgactttaggttagggaaggaacaaaattccacattgagggatctacgtgacaatggtggtggactggtgggtaatgccgtggtggtgcattagggtgtggagtatagaaaatggggggtatttaactttttgccacttttaagatgtggcaattaatcatttgtcgctcgctgtctataacatgtgggctcaaatgtgtatctaatggtaaatcttttatcacctctcgtaattaattattcaagaaaatggtagccatcgaatctgccctgcacgaatctcaatgctcccctccctcctgttcggcacagaccccgctcgacgcccgtcccctctccctctcccctttcgcgcgccccgccccgccccgccggtgcagcagcttgcttccagaagcttccagaaatggaaacccggccaccgcccaccggcgtacgaccccttccgctgcgtgggccccccttctcccgtgggccccacatcccgaactcaaaagagaaaagcagaaaccgcctcttgttgcctccctccctccctcgccgagtcgccgccggcgctccccttcccctcccctccccggaattacttgctccccacgcaatcccccacctcccacctccacctcattccccaatccaatccgcctcggcatttcgccgacacctcgcgcgcgcgcgctcctctcctctcctctcctcccctcccgctctgctgcttcggcgtcgtgacgcgctgccatggagcggccgagcaaccgggactggtcggactgcgacccgacgttctccgcggaggccaacgcggcgatccgcgcgctgcgggacacgggcgcgggcgcggacgcgcgcgcgcgccggctcgcggcgaggctcgtcgagaggtaccccggctcgccgctcgcccacaccatcctcgcggaggggcaccgcgtgcgggggcgcctggagggggcgaggtcgagcctcgagcgcgcggcggcgctcgcgccggggtgcccgcgcaccgccttcatgctcgccgccgtgctcacgcggatgggcctgttcgacgaggcgatggaggtgtgcgaccgcagcctcctcgtgccgcagcccaccgacccggcgcgccacctcccctaccggaggaaacgcatcgtccccaaggacgcggagcataggatcgcttatacccgacaagggatccgtcggctgcgtctcggggccgagaagtgcaggcgaaccgcggttccacttccaccggagtccgcgttgcccgcgccggactggccgccggaaagcgccgaggccaacctccaggtggctcgcgatctctggcgcggcatgagcgaggaggagcagcaagccttcctgaaggtgagctttcaagatatgaagtcgtactgccgctcaggaggggagctagagatgataagtttgctctcggatgccgagcacgaccagttcgtcaagttatctgcgtcgtcttcgtgttggacttgccctttgtgcgggttcaaaattatccttgatgaagagcgcttcatggtgcacatggagaactttcacattgagcatgaggagtacaaaaaattgcggtcatcattacctaaaagaatccctgacaatgagatggagcttctcaaatcatggagatgggaaccgatgccaatcgatggagatgatttggcagagaggacagagatcttgagcaagcttaagaaacttgtttctcagctcattgatatggaggccgtctctctgtgccttctgtatatcatgcacaagttcataatgaggcgggtcaggccggtgacaccattggtagtatccatgtgcgcgtgctgtgggatcagacagttgagttctgcgcacctcaaggaactgtatgaatttctccagaagcttacacctatccttgcagattat

SEQ ID NO: 57589 - DNA, 1727 bp, Oryza sativa
aatgatcaaactcggtagaagaaagtaaatgattagcaacaaacatgtcaattgctgttgtttggaaaacatcatacttgaactcccagcattgccgaaaaaattgataaggctgaacaagcattcggcacacttgtcattgttttttttcagaatatttggctggagaggaacagaagaatctttcagcagcaacagaaagacaactgcaaatcgccttcatggcaattcagaacatcacacagatggagttgccaatctctgccgacagaattaacctgcagaaatttatgtacatcaattagatcctaacagttgttttctttcggttcttgtatcaggacacgtaatttgaacctactcagttgatattcttcttaatataaatcaaggcagatctcctgccagtttctcgaggaaaagaaaaaccctccatttgcatcttactaaaagatgaaaagacctggacaatctcccgtggtgtgcacagtctgcagacccattaatcatcaggttccatgtaaaactgtccggcactcaggcttgaaaccttctgtttatcatgaacaaccctgtgtgccagataacccgagatcatggtattccaagacaccaagctttgttcctccacggctgataaaagccgataagcactaactgcaccttgcatacatgacaacaggtgtttaccaagtgacaatgctgacaaacttgtgcatgctgacaacaccagcgaaatcattcccattaggttcttcactgaacccaaatatcatttctccaacagtatccaagggcatggtgtgctcatcattcctcaataacccagaatccatcgcattgtaacgctagcaattcaaacaagccaagccaatgcaactgctccccgtgcttgaccaccgcataagtaaggcaggcagccatgacagagctctggggctggcaacccttcttcccggaggggactcaaactcgtgcctcgcctcatcatcttccccgcgctgcgcgagcccagcgaagagggcgttgaagcgggcgacggtccgcttcggcatttcgtcgaacaccctgcgcgcgaccccgaggcggaggagctcgcgagttcggcgccagctcgtagcgtaggcgcaggaggagaaagcccgaattggcgaggcgggcgtggacctggatcgtggaggcttcgtcccgggccggagctcgactaggtgaaggccttgagcaagcagggttaggtgaaggcgggacggaggctggaggagtaggcggtgagggtttcttgtcggagacgagctctgatgatttctttccacgaggaggaggcgatggtggccgcggggcgtctgccattggaaacgcgagcgagctcgcggagatgctgctcccatggcgtcaatggcggcggcggcggcacggcaacggttcgcgtgggaacttcgaacggggagataaatttgcagttatggggctgcagaagttataaatttcatatactagatacttttgcatcttgtcagtgaatatattcaatttacatataagtataagaggagtatttgatttgaagcaagttgaatattgttactactccctccgtcccataatataagggattttgagtttttgctcgtagtgtttgaccgctcgtcttattcaaaaaatttatgcaaatataaaaaacgaaaagttgtgcttaaaatactttgggtaataaagtaagtcaaaaa

SEQ ID NO: 57590 - DNA, 717 bp, Oryza sativa
tacttgagtgctgaaaggtttccaagtgaggcaggaatggagcctgccagctgattagaaccaagacctagtccaacaaggccagcaagatcacctatctcctctgggattcccccagtgaggttgctgaattgcaggttcagagtcatgaggtttgcaaggtttccaatctctgatgggatgcttccggtgagggtgttcatgccaaggctgagtaccctgaggccgcgcaacgagcagagctccggcggtatctcgccgtggaacctgttgttgtacagagcgaggatctcgaggccggtgcagttggcgagcgacgccgggatctgcccctggaaggcgttgtcactgaggttgatgtgtctgagctcagcgaggccgccgagctccggcgggaggacgccgtgcagccggttgccggcgaggtggagccgcctcaggtatgtgaggttgccgaggtccggtggcaccgtgccacggaggccaagccccggcatgctcacagcgccacgacgcggacgcggcgccggcctctcgcgccgcacgccacgccgcgccaccggcacacggggacggaccggttcccccacgtctgcggcggcggcgagccactgcccgtcgacatgcgctccatgaacgccgtcagcgcgaggccgtcgtcgacgtctaccgccgccgcggcggcggctgctgctagccacgccagtggccataccg

SEQ ID NO: 57591 - DNA, 946 bp, Oryza sativa
acttgctgtatttgcagattggctctgtacaagttgaaatgctattaattgatgctgaggtagattaccagaagaaaatgcttttggaagcctgtaaagtggattatcttgcagccattttacctattgcaaaggcttgccttcgggttagtacagtacttctatcaccaactgaactcgtattcactttttccataactttttcttatgtatgatatttaatgttgacaggccaaaatgaataataaccttcgtccaccaaatggtcttgaactacaagcacctttgaatattattctccgggtaacttgtgtttgcctcgttcagttttttatatttagctattggtttacttttctctaattttctctgactatctgcagtctttgtggcacataaggcgattccatgatactctccagaagataccatctaaatgcactgatgttaaagatggaaactctcaaattgggaagacattgtgtaaaatctttgattcttgggataatgagaaagcgggcaaaccatgtgacccgtgtgattcaacaagatttgcagattttacaaattctctggtttataaaaaggtctgttgcgttcactatttgtcccacctatctaattgcaaatctgtggcctccagcaaacagtaacaacgttcttttgtaaccaaattgtaaccgtctccatgttgtctacactctactcttagatcttagttatatcagataagttgttaatataaataaagtggatgagcttctattccttatgcttgttctgactccattgtccccttgagcaactcttttggccattttgtgcacctcaatctgcagttctttggagtagattagattaaaatcctgtttttctggatagaatatgacagattaaattctgctgatgatcctgtcactaatttgatccatgaatcacctttatg

SEQ ID NO: 57592 - DNA, 719 bp, Oryza sativa
atactcttcttgtatccccttatatctcttcttcgcttcgctcgttcacgcactcacgcgcacagtctttcagcacctcttcctcctcgcccgactggtgcccctaaccttgccacctgaccagaagacgtcaatggtgcttgtaatccctatacctgaccggcctcctcccccttccacccctacctctcttccatcctaagccagtgtgggtaccattcccctatgccatcgggtatgattcaccaccactgaccgccatggcctccctcatccatactgctagccctacccaccgctagtgcttccattcccgtagctccgccgccacgcctttgcccatcgtcaacacccaccaccaatctcgccgccagcccatccttctaagcccagaaaacccactttttcccatccctagcccactctttaggctgttgcagtaaaaatattactattatggatgtgtgtggagagcgtgtcttgagagtaacaaaattactatgagggttatgagtgagtggtgggagaaggtcgtgaggcatgtcacgtagctatgtagcatgtagtgtgccatgtatgaagttctccctctttcttagatataaatctgtagttatcgttagcattctttgcaatgtggagaatgctaagccgtgaaaacatggcaataggcttgtgtatacacatgctgccgagtgcagatatgctacctttggctg

SEQ ID NO: 57593 - DNA, 1131 bp, Oryza sativa
caccactctgtgataactatttattgctggaatggaaattttcctatgttttggaggcaaaatcaaattggtggaacaatcctgactgaaatacaggcaaattaccaaatcattggatcagtatttctccttatgtgttgagaagtagtttaattgtattatgtcaaggtccttgaggttaactcctgcatgctaagatatgacacatcgactctgctagtctgcatcctaccttcaatggatgaaaaaaaatgcaatgatatctcaattattgtccagttgcatcaatgtattgcgtaaagcatcagtatttgattccgctagtaaaattgtgagtcctcttcattagtaatgattttcaagccatgggacagaaatcctttttgtcttcttttggtagacataactggttattcccttctgtttgttaatccagaacattatattcttgaacaatctgtgtttgttagctccgtaatcttatattcttatgtcctttattttcttgagtctgacttctgctcctttttcctatgctaacttatgaagacttctgtcctatgctaacttatgacttgtctgggtgcagagtgtagcttatgatcgatctagtgctccgaaggatttccaggtcagtggatggtatgaaggaccagaggatgattcagacaaggaatcacgtgtggtgacaaatctaggagagttttcttatgaccttgagaagaacaatgcacagaccttccaactggagagaaccgcagattcacgagtcatcaacatggttcggcttgacttctgctcaaaccatggaaattcagaactgacatgcatctatcgcttcagggtgcatggtagagaacctggctctccttaagctgctgcagtgaaagcctgatctgagagctgcatgcctgagtttgacaacatcctcaggcttcaatatacccagtaagacaatgattctagtccactggattgactgttagaagatagaagtgtggtgcggctccatctgactcaggttgattttactctgtatcataatgccatgaaaatatgctgactcgcagttctgctagctagatgtcacactgtttgtatctgctcactctgatagtctgattgctcttt

SEQ ID NO: 57594 - DNA, 1109 bp, Oryza sativa
agacatccatgtatgttttctgatagtattcatatgattggcggttaagacttaagacatgctattagatacatgattaatcgtgtttttcatgttttgtattaatatttttagtcattattcaaacgatgacaatctacgcgagcattccattcaagaggtatcccatatcagtatatccttaccctaccagtcacttaaagagatctatgtgctcaaaatctattgtccttcaaataggtggatatggagacagaagacactgatggggccagtaacacagcaactagtactgaagctgaaaacacacagaaggctgtgtgtgaatcactagataatggacatgatcaaggtacagattcctattattcttcagtgattagtgttggcattcctttgccacaatttattgtaacatttaaaccttcaaaactatgaggaaatactgtaagttactttacacataaatgtagaaagcctttttcttgttctgttgtgttagttagtacttataatacaaccaaatacttatttggcaatactgatgaaatgtggagagatcaaatcccctgcaaaacaagcactgtgggtttgaaatagatggttaaataagtgcaacagacaccctgccattgtgaatatcaataatagtaaacttgtactattcactgtaccatgaatgtggacccactgttctgatattgtagtgcatgcatcagcagtagcagactgttagtttgatttggaagttatccttaagcattaaaattataagaaacactataacggattcttagtgaaagtattaaggacatgttaagtcagacctgtaaaattctgtttagacatctcaggagcagggaagaagtgggactcgtcagaagaagacgacctggatggctacaaagagctaggacagagtaaatggtcaaaagattttgatgaggataccgagaagtctgaccatgcagaaggaagtacgcatgctctttctggattggctcaaacctacagcacgcatcgaaaaacagttacctggggagatcgggtatgcctttttgcttaaagggaaaaaatgcattgttttcttgcattttgttaatatcaaa

SEQ ID NO: 57595 - DNA, 6862 bp, Oryza sativa
  unsure (1)..(6862): unsure at all n locations
ccgcttgattgcgantctnnnnnnnnnnnnnnnnnnnnnnnnnnnnnnnnnnnnnnnnnnnnntgtgactttattctatttgtttaattagaagaactttggcacaggccgagatgcaattcatctcccttttaattaaccctccaaaaaatgtctaaccaagtcgttttatatgttgcttgttgaacctataaatgaaaaatgcgtacagttgaaacatatactagataatgagttgcacttgtgatttgtcaacgagaaactgacaatcaccaaagagacacattccatattatcaagcaatcttaagttctcagcacttcacatcaacgatgaacactacattgtgtaagatcgtaaagagatttttccaccctaaaagctagccaatgaggtgagacacattggtgtccctcagctgttcaccgtacactaacagttccttaggtatacggatctcgcaggcacccacggtccatcgggccttcacatactgtgtcccttggaccagagatattgaactagccagtctctgataccaattgaaggatcgtaaaaggtttttctcatcctaaaaactagccaatgagatgagaggtccccccacttatatattagagcaattttatgtaggatcgaatcacaataactaagccaaccagaggggggtgaatggttggtatacccaaaaaccgaaaacttttagcggaaataaaagttactctcgaattcgacggaagtcggtctgaccgagattgatatgccggtctgaccgctcggatgccgccggtctgaccgctcggatgccgccagtctgaccggtatagatcaaccggtctgaccgccgaagtcgcctgccgcacctgctacctccgccagtctgaccgccttgctcccgccggtctgaccgccgtcttgccgtcggtatatcgccggttggaccgccgaaactcagtgaaacacaaatcgaagaactcttaaagtggatgacgactttattgattctatctgtgtttacaaagtgcaccaacagcactccttacaaaaatttcaactaaactcgaaaccctaactcaaaactcaactcaattgctctcaaaagcgataccgggaagcctcacgctcccccactatttatacccaaggtaggcagcctaaagccacgaaccaaactcatacttagagttctaaataccttaggaaaccctctagtacaagaaacaaactttacataaccaatcgtaccaaagttggactccttccaaatttaactccgcatcccatacgcacacaatacctccatcgtatgccatatggaatctccatcaaccacgtgcatcaactctagcctaagtatcccgcatgatctctgaccaccacgaacgtcgtcttatccccaagccgactcccggtccatcaccgcaaatactctcccgaggcatcgagtcacctacacatgaaataaacaaagaaaccatattccgagaacaagctatctccaacttgactcattagtagcaaacaacagtattacatatgtatagtatccatctagaagccataatcatgaaataatcacggatatccaaacaaacaacccgaaaccgaaaccgacacagagtcagccggtcagaccgcgggctggccggtctgaccgcgcgcataccgccggtctgaccagcacacaattcccggtctgaccggtcacataaaatgacagcacctgtaattcacctgtaaattcaatcatctccaaaaccacttcgtaaataaattccaaatatcaaaaccaataatctccaatgccaattgttcatcacagaataataatcaaaaacacctttgattttacattttatagtccttaatgaggtactatgaggtaccaaaaatttagtgtaagatttggtacctcatagtacttaggtaccaagaagtaccaaatttacaatagaaaaagtggtacctcctcaagaaccgtaaaattgttctatatattaactctcttactcttccacaactaatatgaaactattcaacacattgtaatacaattgaatgaatagcactaagttccaagtcacactcgatcactcaatattccaagtcacgctgatcgctcaatactcaaaattcgaaccctggtcatttctacgagaaatcagcgtaccggcggtggttcgacgacgagaagtgatagcatgcccttaagttaagaatgggattcatggggaattcaaggtgaactgcgtcgatctgagtatggtccagttcatgttagctgatcgcattccagtcctgtacaactcccttccgttctctagcaacgacaagggaagtgatcgttgctgcagtcccttctggtatgtgtgtcaggctgtgagccgatgagagtgacattgaccatctcagcagctcattggtaggaaaactcagcagagtacgtccgcattgtgtgcatatgcacttctgttatggccgaaatttaagtcctttctacgttgattatttggatttgccgatcggagatgcatgtctgaaaactttcgcatgtgctccatgtaaaaccttgggatgtgcttcggtcctgaagcttgaatagaaaattagtagtctgtcacttctgtcttctgagaaacattgttggtttattagcttatcagccacaccaaatttcaaacgcgatacttctcatccacggaagaaatgatgctgggcagatttatgtaattaagtggccataatagtttggttagtagtagcgttcatcgattatttcaccatcgattgaaccgatgatcgtatcaatagaacagatcgatttacagatcatttcgaggccacaacaagattactttcacatgcttggagagcacactagaaacaagaatggatcatgtcacagctgaatcaaattgaaaccactcaagttacaacatccatttttgggcagcaaaaagaaagcaaagacagggaaatttttccacctctcaactaggctgtgaagagatttgcttccattcagcaagtctcccgttaccaaatctcgggccttcaacctgcctgatcggacggtgggaaatatgcggtacctccagttacatactttccaatgagatggtaccggctgtgttgagagtggtggaagtgtaattttgtcttttcacatagataagttttctccagctgaaataaccctagtttcgattccccttgtgtgtggtagcagcggcggctgcgaggtagcgaggtcccatggccgcaacttggtgatgggcgtatgtggctgcgaggtagcgagggcccgtggccgcgaggtggtggcagcggcggcggcaggtgggtgaacgaccatggcggcgacttggtgacaagcacggtggtgccggccgcggtgacaaggtggtggtggtgccgccggtggttggtgcgtcggcggccgaagttgcaaggtggtggtggttccattgccgcagacggtaaaaggatgggggcgagtgcagggggaggaaaaatagtgacagatgagaaagaggcggcgcgcggaggggaaaaagagcaaacactctgaatagatgagaaagcggcgacgcgactccagagatgcatggtttcgcttctcttctatgttttccaatcataccccccttacgatggacggccggatttgtttctgtacctcccgatacaatctgctacacggcataaaacctcagctgtgaaatatgatatgtactttgattatactttatcgtatgagcaattttacggtccttaaggaggtaccatgagataccattttttctattgtaaatttagtacctagatactatggagtaccaaattttacactaaatttttgataccttatggtacctcctaaaggaccataaaattgctcttatcgtatacatgtgacaaattaaatcgtgtgttactgatgttcatgactaataatgttttcctttctcctcttggccggttggtgtagcactatagtgctagtactaacttatagggtcactccatgtatacccaaactgccaagtgccaatttataagcgtagtagctgctactcctttggaaaaaacccagcactcaaaaacagtaaaccctgaccatggtcttctccctctgtcagtgagaaatcggcagtgagaagagtagaacattgcatcggtggttcgacgatgaaatgcgattgacttgagaatgggaagcatgggtaattcggaaagaacggtgagcttaacacaatccagtcccgctcaagatcattcttggtgcacgaacaatgtagcgattggtgcttgttccactcatctgcctcagtgaagagccggttcgattggtttgtgcgatgatcctaacttggcgcagacctcaacaaagctagcatttcatacggctggtcacattgatgccaggacaatgctatttatctctagcctcaatttacttccgaagggactcgtgttaagctgtttgtatttgtttaattagaagagggctatgacgaacaagcgggatgcagttcatttaatttaatttgggctagagagcaaagcagtgccccttgtaataagatgatcggtttgtcaatcaatcggattgtatccggtagaaccatcaccacagggaacatatatccagtgatcttgctcgagtccaacgagcaagttgttctctacgctgcttcaggatttgcaattacaagaactttcaacatggtccatgtaaaacttagatgtgcttgagttccaagcctgtaatgaaaaattaaagtacctcgtggaaaatttgaaggtaccaaaatttcaaattaaactatgaggttaggtttacactagaaaatatagtactttaggaccataaaattaaagtacctcgtggaaaattttaaatttgaagattttctacgaggaaataccaaatttgaagtactaccaaattttgatgtagaaagtttgatgtactttaatttggtaaaccatgtatcttcaaattttgagtatgtcgcaataaacctcttgtggaaaattagatgtgcttgagatacctgatttattggcctaaatggtataatcataggttctgggaggtaacaaaaattttaatgtaaaatttagataccctgtgatactttctttctcaagaactgtaaaatttatcaccaccgtgtaccattataatagcccgtgatactttcataagttcataaactgtctatagatagcattatattatattatattatattatattgggcacttgaataaactgtacatgggttggtgtatcgcttaggccccggttagttcgcgaaatgaaaatttctggatgtcacatcggacgtttgactggatgtcggaaggggtttcggacacgaatgaaaaaactaatttcataacacgcatggaaaccgcgagacgaatcttttgagcctaattaatccgccattagcacatgtgggttactgtagcacttatggctaatcaaggactaattaggctcaaaagattcgtctcgcaatttcctccctaactgtgtaattagtttttgtttttatctatatttaatgcttcatgcatgtgttcaaagattcgatgtgatgttttttggaaaaactttctggaaactaaacagggccttcaagttccaagttaatacccggcattcaatttacctgcctacaccttcaccaataaccatctatatgccttactccatattaagggcagagttaacatataaaaaaaattgaagccaggcatccttcctttatttttctttcttctttcttttaggatgttttctttgtaagatgacaagagttgagtgttctattgggggtccgatgacaagatgctctgagaatgggatgctttgggaattttagtcatactgatttgtcaagttatgtacactggaagcttatttagttcgatgtgcttgagattggtttgtgcgattttcttgctcaaagtttgttgcccttgtcaatttttgttttagcactacgaggagaggcttaacgaaaacatggtgtaattaacatagtttctacaataactatatgtgtatcttcttttttttcagaataaattcataattaagtctcattcttgtaataatatgattgggtaccggatattgtctgtgtcatttacgaaggcccgactgaaatcacagaataaccagccgacctagttggcatggcacttaaagttcaccttgttattccacatgcctctgcaccttcatactccctccatattttaacgtatgacgccgttgacttttcgaacaacgtttgatcattcattttatttaaattttttgtgcaaatataaaaatatttgtgccatgcttaaagaatatttgatgataaatcaagtcacaataaaataaatgacaattacataaattttttaaataagacgaatggtcaaacgttgattaaaaagtcaacggcgtaatacattaaaatatagaggtagtagtatccataaaagaagctactacttgtcctcggaaaggatccaaattagtgacaaatttcaaaaacttgttcatatgtttctgtttgtgtatgatggtagaggtggtaagtgttaagcgctgcatcagtggtttaacgatgagatgttctaggaatgggacgtgttgggaattcacatccaacatggaactaaaatcaactctcaattcgagatgccatgcttacgggttgtcgcatttggtgtagatttcatcgatttcattcctctacgattctaccactgtcattgcttgtgtgacttggggagccaacccttttcccagcttctgggtgtatttcgatttatttcctagtcatga

SEQ ID NO: 57596 - DNA, 891 bp, Oryza sativa
gaagttgcagcactgggcattttgatgttgaaaggatatgatctcccagactgcagtatacttcataacccacatagatgtgtttctgttgtggaatctgtatactgtacatgggagtattgtccatcattcacattttcgataattgcagcatgagtaattgtttttttcatgtatttcactatttatcatttgatgtagtaattttgctaaatttcttctttattggacagacgtacatatcaagcatgttgaacgcatttaagaagacccttgatgaagggaattttacatttgtgattggtatgacatattttaaatattgttgctttaggatgaattaatgatttaatgatttaattcatggtggtggtcattactttggtggttatgattatgttctgcctcattatttatcataaatttcattgagtacggaaaaagccctatgcaaactttatcatatattcattgacatcatattatttcaatctattggcttttcttcatgattggatctttgtcttattaagttcaatgtttggtggccattttctgggattaggacataggcaatgggttcctagacattgggaggatgacaggacatccatttgtactagtggtttatgttttgtactgtttgaaacattcaattaagcaacaggcctacaatggcattgtaccgggtgatgccttcattcttagcaatggctgatgctggatttgtggtaactgacttgtttattgctggtatccctgcccgtttttagtggatgaccgcaatctgcgggtagctgattttgctcaattttgggcaagtgcgaaggtaaactctcagtctatgttgcgtcaactgtgagaatttacattgcttgttggagctttttg

SEQ ID NO: 57597 - DNA, 5855 bp, Oryza sativa
  unsure (1)..(5855): unsure at all n locations
tataggattgacgtttgatcatgccttatattacgggatagagggagtatatggcttgataacttgtaattaaatgttatttttacagtttttctctgtcctttaattgaaaattatcgtgggggcttcctccacttgttttctggtcaataacctagaatcgccacgtgtttagtatggtgtatattacacggtactaactactccctctgtccagatggagggagtaactagtaataaactaaattgtagtcactggtaccatttcttcagtgaattttcagccaacaaattttgtggatgctactagtttgattttgatttgaatagtaaaaaaaatgacttctgaatgggtgagccgcgtcactgcaaatctgaaatgccgttacgagacttggacctgtatagaagtacatgtcctcatcggttatccatatttactaataagtcacagcggtttattagaaaatgaaaataaatttataggtgttcttagcgatttaaatgtcaacgctgcaaaaaaattcattgaaaatattttgaagtcaaatctaaaataaaatttgaaaattcaaattttgattttggttttgacttattagggtaaccaatggcactcacagagcctcctcatctgccagactgctacagccactatgctgagcgcacgtgtaccacgctctggatttatcagcttctcggttcatccaaagagctgaatcacccctctctctctctctctctctctctctctctccacgtgagctacccatagcttccacccccgatcagggcttgaattaggaaattttagaatcagtctactttctatgaatttggttaaaattttattcaaactcatcaaaatttatttaaattttaaatatttctgttccgaaagtcccattagaaatgtgcaaaacgaaattgctaaccctgtttctaatccaatcaaataaaatagttgcgccgtagtcattgtcttgttggtgatatcatcaagacgagatttatcttctccattcttctttgacctgcaaagttcaatcttttgctcgccaaattgagaagaacgtgaatccggatgaatggggatatcatcgagacgagatttatcttctctgttcttctccaacctgcaaagttcaatcttttgcttgccaaattgagaagaacgaggctatccaaagtggtctaaaccaaaacctgacttttgttcctcgtcagtcttcggcggcccaagaacagctaattcagctccattccttacttcaacacacctcactaactttgtgcgaagacaagattgagtgtagtctaaaacacaagaacaatttgatttcttctttagccttataccagaagatgatggaaaatttccaggtttggccacactggacctacatctggacaagctcggcttcttcaagagtcaaattctttggatggcttctaacaatgaatagactgccgacacgagtcaaccttcacaaaaaaacaattctctcctcgccaacctgtgaactttgcaagagctgcccagaagatacagaccacctctttctcaactgtcccctggtctcagccttttgggatatgatccaggtagcaccctcgataacttctatggatctgcttcacaccaacaccatggtgggtcccattccggccctgcagagcaataccttcttcatcctccgttgctggcgcctgtggaatcatcgaaacgaggtcgtcttccagaaccagcccccctccatggctcggctcattagaagttgtatctaggatgctcagctctgggctcatcgctttaaacccctgcacaaagctgtcctgccactttggctttcgctgtttaattcttctctagcgcttctctaattcctgttccttagcacttttgtttccttttgtttctccttttggtttggcctctggctatgtacagttctttgtatttctcttactttgttttaatccaattcaggtggggtcttcccccccccccccccggtgttctataaaaaaaaattgagaagaacgtgaatccagatgaacgggtgagcagaagatattgtgaaactctatgtgtaattctagtacggtacactgtaccaattggagtcattatatattagcatttcttccctgaattttgatccttctcagaatgcaatgcttttttgtgtggattttgtgtgtgtttcatctattttcacatgattcatcgttttcatttttttttcaattattgtgaaagggtgagccatgtcgctgcatgtcatggaccgtggctagatgcagtacagccactatgttgtgcacaaatgtacacatctgtcttcgtacctctttgtcttcgcgagttgtccatggtttgtcagttccaaacttccaattaattatcggctatcccctctgtcttaaacaaaaataagttttgtggataaatttgaaaacatgcttatccaagttcaactccttgtcttgccaatgatatcgttcagagcctctcatctagttggtgtgtcattgtgaaagtgctagctagtgtacctcatcatcaagtgcctataaataaactagcggcacctacccctctttaaagaactactatagcactagtagatataaaccctggccatcgttcatctttctctgaacgtggaaaagcagcggtgagaaagaacaaaatgtttgtctcggcgattcgacaatgcgatgccctgagaataggatgcacggggaatttgagatgaagtccaaataggctccaatcggcacgctagagctcaagttagcatctcgcagattcgtgatgtcgtagacgactgtgatctagctcattctgtgtgtagagcatatgatgtggtcggcaccggcagtgttgcctgacacacggcgacagtgagcgcgtcctcgcgtgcgtgagacgatcgtgtccagcaaaacacgatcaaggcacgcatcatgtgataatatcctctccaatctagatttggtttcctacagtgattcgtgaagatatagcattataaaaaaaaagttaacggtgtcaaatcttaattgggatgtgcttcagttttgatcttgtacattgaaaatttgcgatagcgtgaaacatatgcatgtttcaccatgggtttgctactgatatggtacaagtacaacataaaataaaaaaaggagaattattaaaggtcgaacacgcctcctagatcactgtactctcttctcaacttgtgatctagtagaattattagaggtctaacacctcctagaatcaacaagttgttatatcctaggtggttgtgcatgccgagttcgagtattgccaatgttttttctttcacgtgcgtaggaaatgaaacgcgctggatggtagaaacgaagcaatctagggtaatgagaatatgggatgcatacacgcaggggtaagtagatccttgataaatagaaggagactaaaacataaaaaaaaaagtagaagtagtgttctatctccaaaatgccaataatattagtactgaagggagaagtatatgtcatggaaacataaaagtagcacttctccctaaaaattgaccaagatcattttataccggatcacatttgagctatttttttcgaaccctgctatacgtacgatgtgctattcgtacgatggtgtcattcaattactgtccgaccagtacaatgtaaacacagctaacagacgcagactcatcacgacatgaatcacatatactatctctatccaaaaatatattaattttttagctaatctggactagcttatatttttaggtcgtatggagtatctcattttcggtttctttaaggggcatttgcatctgaccctaatttaaagttcaactaccaatatgaccttactttttctagtttacttatttgaccctacttttctaaaacgaacctactatctgacctattccgttaagttagcaatgttaagtttggggtaaatagtcccttttacccttgcttatttgtccatattatatcttgcttatttggccctattatgtaagaacatgtatatattcggatatgttgacaaatttgtaataaatttgacatatgtttcacattcaagacaagtttgacagatttggattcaatttgataggtttttgacaaattgaagtgaaccgcagatctacccgcaagtcggcgcccgcagatcccctttctccacggcctaccgctgccgctggtgctccctccaccagccgacgccgctatatcatcctctcgtgcgtcggcgttgccaccggcgtcacccctgctccctcggcgaaccgacgccaccgttcctcttcctgttaaccggngccgccgtcaccgtcgcacgccagcacctccggttccttccctcagcacgccggcgccgccgcttcctccccccacgaaccagcgccgccactccctcccctcacggcgcctttgacccctcccctcaccgcgccggtgccgccgctcctccccctgcgagtcaacgccgctgccaccgccgcacgccggcgccgccgctccctccccttacggggcctccgctcctttcccctagcgtaccagcaccgccgcttcctccccccatgagccggcgttggcgctccctcccctcaccgcacggacgccgccaccaccgccacacgccgctaatcccctctgtgcacgagccgccactgccgccagcacaagccgagagagagacgggataagagtgtgatctgatctgtatggacagggtttggatgtggatatggtttcttcaagggtattttggtcattacgagaagtaattaaatttcttttctttttttaagtgaaaacttaacggtgcggtgaaaacagggacaggcggagctttcatttttgaaaaacagagttaaataagtaaactagaaaaagtagggtcagatcgatagtttggtttcaaaatatggtcaaataaacaattgtccctttctttaagaaaaagtacaatagcaggctataagccagctataaacatattttaaagagataaagaaagagagagaagagcagcgggctacagatctgaagccagctgcagcgcggaattcaagacgtaatgtgtgtatgataagtgggaccatgtattagtagtatagtaagcaactacttattatatgaattggctattatattgattataaataatttagagtcagtagtagtgggtcttgctctagctgaagaatcaggtgagtcgcgtcgctgcgtgccgtggcgagacgccggccgcgtacagaacctctctctgcttgctccccatctgctacagccactgtgttgtgcgcacgtgtagcacgcgctggacttatctgctttgctcgtttcatccaacgagccgagctaccccatcacctgccgagctgctgagctacccatcgttcgcgacaagttccaatcagattttcagctggtcactgtcttgctgctgctgatatcatcagcacgagatctttcgtcttctccgttcttctccgatctgcaaggttccatcggtttctgctcctcaaattccactacctctcttcttgattgggaggaagccaagaagaagtcaagaactgcccggttgctttcaggtctcttgaaccgtttatgcggctgccagcttgcgatagtggctggtttccgggcgtcgtttgttctggtcatcccatcaattggcaggtgtgtgcttcttgttttcttaataaacccatcctgtattagcagattggtaannnnnnnnnnnnnnnnnnnnnnnnnnnnnnnnnnnnnnnnnngnaggtgcntccnncagttccnnccccgtt

SEQ ID NO: 57598 - DNA, 11656 bp, Oryza sativa
aagtatcttttttccaagtggaattaaactattttcatgttttgacagtaagccacatcacctcgattcgttcaagccatcggattgtacataataaacatttgggtagctatcaatcaacacgtagcaatcaacattaaacgttttaccatctcagctaaggcaacgactaatcaaagaggcccaccttgccatctctgagttttgaaacataaagttggaataccaacagcaacgcatgtagcaattaagctcttaatcttccactaaagctattttatctcctgtaacatgcgaatcagatgaacagtcagccttggttcctttatgcgctgttccattcactgggaaagtgggaatgctgttcctcattcatcaatatacccatttatagaccgaatgtaacatttgttgttcaccatcagcgctcggcagttctgctgtgcatatatcgggtgaagatcttctaccataatgtcactatcattacagtcactggtatgtaggtctcacctttctattgatacacatgtcagtgtctataatgatagtatcattatgacagaggatgttaacttattgcattcagttgatgcatctcagtatataccccctccacttcttaggttgatgcttcgacggagcaacgtgcacaatccactttggtcatctctcttgcttgcttgcgcatggctttctttttccttttctttttcttactaatcttactaatttcatttgttgtttagttgtagaatctgagaaaaaggaaggaaggataaagtagcagtttcaatttcttaactttctattgtttgtgaaggttgcaggtatcttataaagagaattaaagggttggtgcattactattttcacggaccggttaaaataaataaggatactttttttttgtcagtaggttatagacatcttcacctgaactttaggaagtttctacttcacaaagactatagtttggaataagcaactacatatatagcatcgttgagtgatcaccatgccgtatattgtctaccaattttatttcttgctacatgctaccattctatttgttgtctctgtgttcaactgagcttggttccacgtaaataggaaatgatctttcacttaaacaaccaagtagaatacaagattaaactgtattccattatgattcaaatttcagttgcttattattataacattgtcaaagtgttcaatgcataacagtacaacgggtgcacatcgtctgccgttcgttgtttcaacggcattgtgccgttggccagtcccaaccgttggtttgaaatggacggataagatcaaaataacccacaaatctatcatcttcataaagcattacgcatatttctctccagggaatacggattactccattcaagaagtgaagaacactcctaatttacgttgaatttgttgttctgtaacttccaccttgacatcaattgatgacaaattaacctatcaaaaatttagctttgttgcatgaggcgacaagctaacagaaaaaaatctttttttttcattttttttgaaaccgatatttttttcacttttacctgtgtcacctggccattttgtttccgtttactcaatgatggaaacattttagcggtgatgccgctctttccttttattcaatcgggacaggtcagaagaagaaaagaggaaagcatcgatcctttagcccgtcggttcgcacatcctgatcatccattcaaagtaacggttgggattgatcaacggcacagtgccgtagaaacagagaatggcagacgatgcgcacccagcaacgtgcggggtatcctctagttattattgtaatggtgtgtatcgatagtgagttacttgatgtaaccatgtgtcacacctagaaatttagcccaaattttcatactattttgtgtaataaatctctatctaggactagccaggtaaacaaaatgataaatataatatacagatccaaacgtaaataaagtaaatacttacagaagaggcatttagtcctcgcaccgaaaagaaagcagcaacagcggaaaagacgatcctagcggcgcttcagctccactccacaagcaaaaactcaactggggtatgagctttattcttttaacatcgtcttcagcttagaagcgctacactctaaaaagtgggaacaataacaaggctaagtacaaccaccatacttagcaagtcacactaatgatgcagacgtgtaaggggatataaggatggcttgtagctatttgcataaaggcagttgtaaagcattttattgagcaaaacagtaaaatagttgagtaattaaggtaatattaaatctccactgatcaatgctacaccacattgaacaagcccaaccatcctacctgaactacaccagttcattaactaattattaaggatgtgactaatcacggtgaatctggccgatcgcccataaccgcgggcacagctatttgaatagttttactctagccagaggtgcacaactgtacccacaagacacaatccaccggcaagtcaccgtgcctgcacagacacgtcaccatgtcgagtgattatgacaagacccttcatataattccctatgaccaatcgatgccgcaccacaggtttcgttcccgcccccagcaggcagcgggcagcctcccctcgtgccacggtgaatccgcaagccgatcaaccaaacaccctagtcgacccaactccatcacgcccaccctagcctgggtacatcagccagaggaaaagctatactacaagtcaagcagttacccattcccgcttgtggcaagcgctgtatgtcttacagggtttcccgtgaaccggtccttaactgccatgggcgcgactagcaaaaccatgcacccacagcccacctttcactcgcattttagttggataattacgaccaatggatcatggccggatgtctcgagcacgcagctcgtcaagatactagatgtctaataatgtaactatcccattatgtgagctagtggtaattaagcatggctaagcatatataattctagctagatcaacataagtatcacgagatagataaagtatcatccaaggttgacaaaggacagatatcaagtaaacatggcacaaatgagcagataggtaaaccctattcccaatgtaattagcaaaagatgcaatttatttgcaaatagtaaatatttataaagtgggctaaatatgctcaaggggaatgtgtgacttgccttgcttcttcactttgatcttttgaactcttttcgtcgcgatcgcggacttccgaaacgatggattctcacgctggcacgcaaaacaaggaaaaacactaataaaaaccaaggaaacagtacatgaaaagtaaacaaacatgtatatctcaattttaaatgaattttgcaagttgaatggctcaattagtagttcgtatgaattagatataaattttagaagttttgagccatttaaatgaatttctagaattaaactgaattattgcgcaaataataattaattttgcaaaggaaaagggactgctgacgtcagcaagggagaggggcgccgcaggcaagcgggccccactggtcagcagcacaagggcgccggtccaaggtaggggatggagctgacaggtggggccgccgggtccacctgtcggcgaaggagggataaaggaggccggttgggggaggaaaagaagacttggggtgaaaggggagccgaggccagctgggccgggagagaaaagggaaggccagccgaagagagagaaaaggggcgcgcgggccgctggatgggagaaggctagggccgaaaacagccaaggaacaagagggaggttttactttgttattcaatttatttaattgatgatatgaacttttgtcacgcccggaaattcactaataatttccgaactaatttgtgcataaaatcctcgtccaggaatcagccgaggtacacaaactgacaatttaatatataaattcatcataataataacgttacatacttataaaagaaaagaaaaacagcagcggaattaacggtctagcgatggcttcagctccactcccacaggcagctcaactggggtataagccaaacgtcttctccttctggatcctttttcttcaactgaggttgattgattattacaagaatgagcatatgacatactgaacaagccacacagcaaatatgcaagtgcacaaggataccaaatgatggcataatataggctcatttgcaaaagcagcatttagcaaaacatttaagagaagtaaaacagtggagtaattaatcagaaattttaatcaatactgaacaacacacccatgctgcacaggcccaaccatcctgaacaaccgtacacggctgtacagatctaactccaaaccaggagctaagcaaattattaccaggtataacatccataattattgtgagaggtgtgagactagtcacgaaaaacattgctcaacccgcccataaccgtgggcacggctattcgaatagttttactctggccagagctgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgtaatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcctaatagtgtgctaatgtttctaagcatggctaagcaatcataactaatatctaactgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgcaataatcggtcttcaattaatcttctgaacactcctgacgcactcacgaaccttcgcaacgacggaaacgacaagctaacacacaaaacgaagaaaaagactaataaaaccaaataaacagtaaaaaacaagcataaacagtacatgtggatatttttaacatatagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcacgctcgaaccaaacgacgaacgacgacggccggcgacgaggtctagcggcggcgcggcttcggtcgacggcggcgacggggctccggtgaccggcgacagcggggtcaggcggccgggcttctccaccctcccgcgcacctaacggtggtgacggcgaccggcggcgacgacggaggcggcggcgcgacgcggatggagctcggccggcgacgatggcggggtggagcacgtggcggcggcgctacgaggcacgggagatcacgggagagggggcaaacgaaagaggaggactagggggtcctatttatagccatggaaggccgggatcgagcccacaacgacgggaaaaactcgggaaagtttagatcttcgccggaaaaaggaaaggttgaaccgcgaaattggaaaggatttccatataaacttttggggatttcttggggaaaaggaagaggagattgagaggattccattcccacaactaatttggagaaaggagcaacgatgtggccggattggtgggaggaggcggcggcactgtgcacgggctggagagcttgggctctgtctggaggtagaagaaggagcactgtagcgacagggacaaaaaacagacttctatgcgggctgagaggaagggagagagaaggggaggcaatgggctggattcggcccaagctgaggaggaggatttttattacttttccaaataaattaaccaatgagatgatctttcaattgttaaaaatactttcaatgctcaaacaattccaagaaaaatcttgaacatacttagacactcaaagtatttaatataataatatccagatcatttgctgattaatttattatttaaataattgctaaattgttctttgtattattaacattaggaattgagctccgaaaattccgagaaaatttcagagagtataattaatcatggagaatttaatacaaattaaatccatccatgctttaaattaaggaaattttatttcccacatttaacttcacttgtaaattaatgaacagttaatataaattcgattaataatttattaaataatttataaatcctgaaacggaaattcaggctgtgacaactttgcatcattaaaattagatattgagctctaaacattcactagaaatttcagagagttcattagggcacagagaatattacaaaatatttccggccatgatttttaaaggaaaattttattttcctccagaatttcacttgattaaattgctttaacttttatttaatttctagaaaatgaattattaaatgatttttaatcccgaacgaaaatcggggcgttacaccatggttgctattgatacaaccgttgctcacatcaaagataaaattgtctaagttctggaatccaattcagtcgcttgcaacaatgatttcaaacgactgccaaatgtgcatacgacctccgttctagattcatgagtacttgatagaaagcttttgaagtcctctttccaatgaatccaaccttgtccccaaattccatctcagtcgacgacaaccaaagaaacaaggtgttgtgtcaccagtaatgggcctatggacctttaacgttgtctggggagctcagcccaagtggggtgcgccccaatctggtggagcacgaccctaggaccctcttggtcgtccaaccacctctttaaatagcttggtacccctttagggtttcttgggttttgtttagattaaagtttagccatttctacttgcttgcagcgcgtgtcggctagaccgcacgtctgtttgtcttcgaaaccctaatttatcatttgtattcaatttctatttgcaatatcagattgattttatctcgttctcttgtttgtttgattttcttgcaagaataaggttgatctacatcagctagattaacaaccaacgaagaggtgtatcgatcgctaaggcgcaacacaacaacgtcttggacagttgtagtcggatcattaacgtttcttccaaatcataattatcattaactcactgaaagatcgggctaatcatagccgtgagtgcctcaagtagaactcagggtttatcattacttgttatgatttcatcaatcgccacatataacgtcctagtgtctcggactagtgctcataaggggaggatttgattgtatgttgcaggaagatgcttaatgtgacttcgtcaagatatgtcaatccagattccagactcaaagatgctagtagaagtagcacatataagcatcctcatttgtgctatgttcaagaaaaactatctaacaacaatggctttttttaaataaaacatgaatggattttttttctagcataaatggtaaccctgtactgccttttttttcccctagagctcggtactctgagcacttaaatgtcaatatatttctcaattcgaaaatgacttgagtgattggtttgaatgtcttggatcttattaggaaactggacatctgtaacaagaaatttagatatgtgtatgaggtgttgctcgtcaactagaacaaaatgcgcaatggctatgaaatagaccctccgccagcctttggctttactcctccaaatgcatgaagcaacatataaattatttttctccaataaaggctgcagtgatattgctttctgatccataatgattgatgaactaattttcttgtcataaactcaataatattattgttttacgggtagtataaggtttgctcatctcctcaccataaactcagtattattgttttacggggtagtataaggtttgctcagtattatcgaatttgtacgctgatgacccctctcgctaaaccgtggtgcctgttcgcctgggagtcctcctcgtccgccaacctcgccatctacaaaaggtacaaatcccctcatcctccctccccaccaccatttgcccctttgccacctgatgcgctcaccagttagaggcatagttatattgctcttatttttcttatagaaatcgatgtcttttgcatcacggattcttctttacgtcacgtattgcatgcccctcttattagtgtgcccaatcttggaggtacttgccaatttttgttattgtgggatatagacaaggaaaacactacattaggattgttgctcatgatctgcttggcaaaatgcctctaaggttattacttattacttctgaaattttgagtaccttactttgtatatttttttgacagtatgttaatttgtatctcctagtaacataagattttaatttgattatgttaatttgaagatggtgacattttaactttattagatttccttgtataaagaaataatttttgtttaacactatcattggttcattaatttaatttgtactccctctgcccccaaaatataagcatttttaaaacatttttactttgactattaattaaaaaaataaaaaatatctatcatgtaaaattgatgttactatatttgtcattaaacatagtagatctccatcccatattacttgtctttttaagtttttgtttgtcaatgtttgatcattcgttttattcaaaaaaatttaaaattattatttattttgtttatcatttgctttattatcaaaagtactttacatatgacttatcttttttttatatttgcactaatttttcaaataaaatgaatggtcaaacattgtaaataaaaaatcaaaaatgtcacctattatgggacgaagggagtaatatgcatttctttttatttaaaatagatattgttagttaaagtagtatctcgaatactatgttaaagtaaaaaaatgggtatattttgggatggagggagtacttgtatgtgtagcgttagcaagaggggattatagttgggtttaatttgatgagatatcctcatcgtaacaccaccgctgattaaaaagggcgaaaaaggctaaaagaaagagggcaagaaacgcaagagggatccaagaaacgggaggaggcgtcgaccaagattcgccgcccatggcaacgcgcgcgccggcgaccggatccacgaccgtgacggtggacccctccccgtcctcctcctcctccgcgccggcctcgtcggctcccccgccggcggcggagtcggtggtgctgcggctgaagcggcggccgaagaagaaggtgacctggaaggaggggacggtggacaacgagtccctcggccgcaagagctccaagaagtgctgcatcttccacaaggaggtccccttcgacgaggattgcagcgacgacgagcccgacggcggcggcggccgccggagccctcccggggacgccggcgaggggacaagcggcggcggcggatgctgctcctcgtcctcccatggtcacggccacggccacgaccattgatctttttgattgaattggtacgaattggtgagtcttgatgcttatctttactgattaatttggtgaggtagatttggggaaaacatatttctaggttgtgttgcaatttgcggttaaacatgtttcaatcggcaaatcaaatttgtcgacacatttcagctgccatacatttgatttgttctctggtattaatagctgtaattattctaatatgaaggtataaggactgatttgatgttcagtattctagaaattttgaagcctcaatgatcaaactcttctaacctgcatgtgcaactactccatatatatgtaaacatattttcactagtgaatttgttatgcttgtgttattccgttactgatctttatatgcttggttgcagtcaacttatcgtggaactacgcatcaatgtgtgaagttataacttgaaggggaaaattgcttctctgtgccgaaacagtaggtgaaatgatactgctttgttttgtgttgcgattgtggatgctgtactagctttatttttgtgtggcatttgcaagagagaaacgttgtaccgtatagctgactttattgttggtcatgtgcaattctcttgagatgtatgaagtattgctcctgttgttattgttaccattccatcgcatcaaatatcctcttgttctttattttaatatggtgagttggtagttgtattgtattcacattaatagcagtgtattatgtgatgatgatgaaataccttgccccaaattactaaattagcacccttttatcaacaggttgaggtttattagttaacaaaatcattttgtcgaattcaattattactcactatcaatctcatcttttggcttatgcttatgcttataagccaaattttaaattttcaaccttaaatttgtagttgatgttgggggttttttttcatcgtagtttattttccggcctttgcttttggattgctaagaacacgtatatgaaagttttatttacaaattattttccgtttgcaaatatgccgtttcgcttactctgtcaataagcgaaacgatggagtcctatgccagaaatcaaaattcagacatttgtggaatcaattattaagtgcaaatgcagccatacaaatcatttttgttcattgacaacatcataatactaaacaattcacagatagctctgaagttagttgtcacttatcagtttagtcgacaacagtatggaatttgaaggttgcctgtattcagtcttagcagagagtggattctggttgtgttagcggaagcagataaggccgtgaagctattttgtctatttactaaaggatgattagctgtttatctttgtcagtataaaacaatacatggtatcagtttgataagtattgtcagtataaaagaatacatggtatcaggatgtttagtatgacttggaacttgtctgcgccggtgctcccggtaagccgaaacatttttgattgtcaagcttcgatctggtggtattgtggtgacaatggctgctatattttaagggggaatgtctatctttcta

SEQ ID NO: 57599 - DNA, 10769 bp, Oryza sativa
  unsure (1)..(10769): unsure at all n locations
tgtctgtggcataaaccagatgccgtcattccctacgaaatcaagcccgaatcctcctcgttcaccagggccaggtccaaccaaatgcagccttcttacctattgccctgaaggatccacctgctgctgctcctggcgtgtcctggggctatgcctttcctggagttgttgtgaactggataacgcagtttgctgcaaggataatcgctattgctgccctcatgactacccggtttgtgatacggccagccaacgatgcttcaaggtacgtagaaaacgattttgtgcatccaatatgagctgcctcaaaatcttccatggttatgttttctgtacttctcttccatttcactttgattcatatcagattccagtttttgtttttttttactgactgtagagtagatctttaggatttatgaacaagttattgttcacgttatcagatgaactttgtgtattctgagaactgagtgttctttcttgtttcaggcaaataatggcaacttctctgtcatggagggagggagtaggaaacaacctttctccaaagttccttctttgggtggtttgttggaactgttggatcagtgagcctataattcgagccaactatcttcgagtgagtacagttgacatgagcatcgaatgcgatctcgccttatctttcttttagtacctcgttgctgaccatcccctttgacagatacactgatgtatggacaatgctaggctcagtcagtagtcagtggttgggttgctgctttcttcaagtttcctgccgccctgatgctcgtcttgcacggagatattcagatttactgtgtattttggtgaatggtaaatcataatttgccctgtaatgttgttgctgtacatgtcagactagcctggattatttcactcaatttgtgctagtgagaaccacttgctacgtatggtagattgataataaagagattgtgctgagtccatgcatctaaaactcggatactttttttttttactgaaaacagttggagagacttctgctgcgctatattaatagatatataataaaactcagatacttctcccttgaattattagttcgtttctgcatatatttaagcttaaaccaaacatctaaactattaaaatatcttccatcagattgagttgtatgaattctcttaccaatgcaatcccaaatgtgattaatgaggaaaagtttttttttcctctttctgaataaacccgagttcatactgtacaaagttcagctgtattgggcgttcagtccagcaaccggattcaaaagtcctgcttaagatatcatctgatcttccgcaaccagtctcaccaagattatgtaactaattcatagtctttaatctcttcgttccaaaataaataaatttaatacttaattctttatttcaaaataaataaatctaatacgagatatgacaatcctatccttttgagtagctgaatgtgttgtaagatttggaggctgtgttcagacctttgtttcttttttcttttggtttggattgccgctgaggctgaacctatgatcatttctagtaaaagaaatgggggttttgagtcttgctcaaaagaaaaaagatatgacacattctattatcatgaatctacagtaaccactaagaaaaacatcatgttaaacattaaggttccgttcttttctccaacaagagttggataaagattaagattttcgtggcacgcttttttaaactgttaaaaggtgtgtttcgtgcgaaaaactttttatataaaaattactctaaaatatcatattaatctatttttcaagtttgtaataattaaaactcaatcagtcatacgttaataccatctcgttttgtgtaaaaaacttcatcttaacaccgcctaagtgtaaaattacaaatgagggccggtgacgattaggggattggttttcgtcggatgtcgaaggacagagtagtggaggtgctcgtctccgccgagttcagtcggcggagctcaccggcggcgacgggacggggaccctaacttttacaaaatagcccctacttggatcctaccaactctaacttttgcacaatagcccatatatttacatagtagcccccctgtatgatcctaaatattacagcatagcccatactgacccgatcacaattcgcaacggacaatggctggtgccctacattttacaaagtagccccccttctgcttagatcctactagtaactttttttacaaaaatgaccctcctgtaaagtagactggctcgtcttcttccccttccatcctccccaaaatcgtcgccgcggatggagtcgtcggcgccgccgctcagccgcaagagggggaaacctatgggctatggcgccggatttacgccaccggtggcgtggcggcctctccgatcggttcacaccgtcgaccgccgctttgctttcgagcgcgcgattccgctgcggcgacgcccgcgccgatgtccaaatgtcctccagttcataaaggtgaggaacaaaaaaaaaaaaactcaccagattcgttttcgcatggttagcgtttgcgggctagaaggcatagaggtgtggttgcgatttgctaatgggggaggaagagtaaatttgatggcattgccaatttgccatggtgcgatgctatggattcgggaaacaaatctattctttggttccatttttcttttatttattttatgttcttagtgcggccacttagtaaaatcaagaaccgagtgaagtgacaatcgatcaccgcccacatctcataagaggaatcaagaatcctgcaagttattgtatttctgctaaagattctgcatttcttgtccacggccttgccccttaatctctcttcacgccggaccaattccatccacagacatacaatgagacacgcgtgaaaaaaaacgaggaaaataacatttctgatgtagaattgatattgtaaaatatgtttcttgttttattctatatcgattgcttctttaattctacatcgttaatgcagggaatcatgcaaagtcagtcaggcatgggaggtccggaaaaggagaatatcagtggttgggaaaagacttcttttcttttcatgtgcgtgaattgtgaattggatccagtaggtcagcgaatcgagttccctggttgctttcaagtctcttgaaccgtttatgcggctgccagcttgcgatagtggctggtttccgggcgtcgtttgttctggtcatcctataaattggcaggtgtgtgcttcttgttttcttaataaacccatcctgtattagcagattggtaatagcagaaggaggtggcccaatcttaaattcttaattcaagtgtctgggcctatttgggcagcgagatatggtacattcttgtttgctcatgatcttgtgtgcttagttgtgtgttaaattttataaacagatgtatgccggttgccaacaatgcaaaagtgaaattctaagaatgcatactatctgcagaaatgctatgatagaattgtccagaatagagctagcctaatactattgtgacaaataggacttggagtaattttcaagcttgcaaagcctcgggcagttgcttaatcatgggatcatagtgacatgtcgaacttttgtttacgaagtttgcaattggacaactctagattcctagagtttcttcggttcaagaacagaacccacacatcattgctatgatgctatctttttttaattgaaaactctgctatgtgaatttcatgacagtgttttggtttatctagcgatgaagtgcagaaatattattttcttgatgaactgtagtttctagaactcaaactcagatgtcatggtctaatgaaactttggtgtccatgtctaatagagtatcaaaagcagcgacgggaagagccccatagtggttggcccttggggtggcacaggaggatacccttgggatgatggtgtatactcaacggtacgccaggtcatcatcacccatggtgcagctattgactccataaggattgaatatgatctgaaaggaagttcagtctggtcagagacacatgggagcaccgatggaggttctgaaacagataaggtctagtttactatccctgctgcagcttttttaatttttttagcaagattgcaacactccgaaatttgcacaaatttaattggtactgtgcatgtctttagatctatataataaatataagagatttattacgttccttgaggagctaccacattttttagtgtaaattttggtagctcttggtggctcctatgtgttgagataccaggaaacagttgtacctcctcaagtaccataaaatcactacaagtataaacacctatatacaattctggtaaagttggaagatagttttaggccttagctttatgtatgaatctcatgtttattttggcgcataaaatcgatgacatgctgacttgtttttaatgaagttggtaaaagtttatatatcaaaggcctactttgatatccattctactttgaagaagcataatttagttttcatccctaaaacaaaattattgattttatatgtataatctgcaggtgaagctagatttccctgacgaaatccttgtgtctgtaagtggctattacgggtcagtctgtggaactccagttatcataagatcattgacatttcaaagcaatcgttccatatacgggcctttcggtactgaagatgggacacctttctcactcccagtaagcagtggtaaaattattggttttcatggaaggtcagggtcgtatctcaactcaataggcttttatctgaagcaagtgaatgtttcagatcgatcaaattctccagtcttgcctcagagtagaagtattacaagtgcatataacaaaaatggttatagctttcctgagggtgcttcaggatatgacatggtccttgcagtgagagataggggtgacagctatgctgtttatactagcaattaccctaatcagcagtatacaaatccatccccagattacaatgatggaatccgctggaataaggtgccacaaactagtccatcactgcagatggtatcttttcctagtggttacggagatagaggaggtgcagctctgagtagccacgagacctatggtccttggggtggaagtggtggcaccatgtttgatgatggcatgtacaccggtgtgtggcagatcaatttgactcgtgcagtgggaattacttctataaaggtactttatgatcgaaatggccaagcagtgtggggaaacaagcatggattcagtggagctgtttcaccagacaaggtaaatatgatttcagtactgcatttcttttaatttattgtgatgctgcatacatgattgtgatgaagtggaacttttgttcttcagatagtatttgattttccctcggaggtcttgactcatataaccggctactatggcacgacaatgatcatgggtccaacagtggtcagatcactcacattccacacaaacaagcggagatacggaccatatggggatgagtgtggcacgtatttctccaccagtttttctgatgggaggatagtaggattccatggtagggagggatggtacattgatggcatcggggtccatgttcaggaaggtaacttggctgcaccgcgagttagtagtagatcaacgattgagatgaacccctctttgcgctacgacatgcttgcacaatcaaggagtgaaacatacaatgaggtagctacaattcttgtctgaatcataacataagtatgtggctgcagagctaacttgtaaccgttttccaggttccttatagcatggtgaaagaaccagttccaatggggccagggccatggggtggcgaaggaggccggccatgggatgatggtgtctacactggtgtgaagcaagtctatgtgatgagaggcacctttatcggctcgatacagatcgagtacgacaggggtgaccaatccgtctggtctgcaaggcatggaaccagtggccacataacccatagggtgagtactgagtgctattatcaatcaagttccgttgtcaaggaataaaattcatgaaacatacaacaacaatataggatctgttcatcattcttcggtggcatgtcaaacaataacctctctccaaatgcacttgcagattaaactggactacccacacgaggtcctgacatgcgtatacggctactacaacaccaacagggaggaagggcccaaggttctgaggtcgatcaccttcatcagcaaccgagggaagtacgggccattccgagaggagttcggggcatacttctcgtcggcgaagaccgaagggaaagttgtgggcttccatggccggagcgggcaacacctggacgccattggggtgcatatgcagcactggatgggagacaggaggcctgctcccaagtacgtgctatcaaagtacctcttctgattgagctatggatgaaaacttgaattcctttgaaacaaaaagtgaatacttgaattacatgtagtttagccaatagtcatatagataacagatgggctggtttcgatttgagctttggaggctgtaacattttgggatatggaacagtttaagcctgcggatgagtccgttccttgtactcaggcaggcaggcatatacttaatgcatgacgatttatgagtaaattcaaatgaaattcacattttctgattcttttgcttgccgtggagaattggagacctgttttcaagacttgtgtcatttgtgtggtccactttctccgaatttgttgtggtcaccagattagctgcactgcatgtctgcatctctgcagatctcatgttcatgatttgagacctcccggccacttcaggacgggcatccaatgttgaattcagcaggaaagtataatgcagtaatgcacatgaaatgctttgaaatcaagtgctgtgcaaaactgaaaatgaggcaacatcaaacaagtggaaatgaaaatgttttcttttttattgaagtggaaatgaagttgacacgctgcttaggagctaactagagagtcttcttaggaaagctttagcttcgttttaatccatcaaaaaagctaaaatgtttatggtacttttaattctagaataagctgtagctaatcgaatcaaaaactccccaaacatacccattatcacatatcgcagccgcccatgtttaggaaggttgtcccttcccttggtacaagcaccgaaaaaatgcccatccgatccgaccgttcgttctagatcggttccagatcggacggccaaggacagagatatgggacaccgctcattacaacaagggtctaaattgtacggccgcattttttcgtttatgcttatgtttattattcaaaatttaaattttcaggcttaaatttgaaattgattttagagttttttcatcaaaatttatttttcagtctttgcttttagattgctaagaacacgtatataaaagttttattcacatattatttttcatttgtaaatataccgtttggccaattgggggccggtaatttcgcacagaatagaggggcatattcgaccattcgtcacgtcaccagctaggataaagtttcgattcctctcccaacgacaatatctttgggaaggcgagccatggccaaggggagcacatagtcagaacaccgcagagcaagtgtgtgtcctgcctcgcgtgaaagataagcggcgctctgctctgctcgccgaggagagagagaagagagagagagagagctagagatggcggcggcctcagcggcggcgcaggcggagggaacggtgatcgcgatccacagcctcgacgagtggaccatccagatcgaggaggccaacagcgccaagaagctggtaattcaaccgtcgctctcctcctctttgttctttcctgtccttttttctttttttgctaagttttttgagttttgtgatcaatggtgtgcgtagctggcctagggtttacttaattgagattatgctcatatccaattttgtgattggggtacctgaggagaaaattttgcgtaatcaaagttgggttttccgcgtctggtttttttttaggattagggtttctctcctccccttccggtggggatacggatctactgttctctcacccgttagaggataattgcagcataaacagttacttctcctttaaactaaccatgtttttaaaaaaacaaaaaaaaagaagaatcatagttattgtgagaggaaaacgaacaagttgttcatatgctcgtagttggattggtggaaagtagatgatggtagcagcaatgagaaatcgtgggtaactcattagtccttcgttgaggtgtgtaatgatgtttattttccttatgcccgctgattctgtagacggtagaggacacgactattacaaaatacttagcttatttcagaatttcaggtcggtgtttacttcgattataagaaataaattatcacaatttgggatcgacccttatctgtagtgcagtgttgctccaattgttcctgcaggaggtcaaatttgcatgattaacttaaccacactagagcctaaaatcatggcatactttaggagagtgctgaggtcaaatttgcatgattaacttaaccacactagagcctaaaatcatggcatactttaggagagtgctgaggtcaaatttgcatgattaacttaaccacactagagcctgaaatcatggcttactttatgagagccgtatcatgttgcttcagagatgcagatgtttgataagtgaagtttgcaattttgtgtagacttgctgtcctaaggttggtaatagagtccaaaggttgggaactattacagtcacttcatgtatataactatatatgtttttcgataacattttagttctgattgcagtcatttgaattgttgaaatgttgaattagcaataccacaaaagtgtgttaacctggttttcgtcataacaggttgtgattgacttcactgcatcatggtgcggaccatgccgcatcattgctccagtttttgccgatctagcaaagaagcacacaaatgctgtttttctgaaggttgacgtcgatgaactgaaggtattgctgttccccaaattttatatttttatgtagtacagtagtacggttgctgtgttggttttccccttatctggctttatcctaatgaagatttatgtaacaaacagcctattgctgagcaattcagtgttgaggctatgccaacattcctgtttatgaaggagggagatgttaaagacagggttgtcggtgctatgaaggatgaactggcgagcaagcttgagctacatatggccatgtagtgttatagtggattagtactgatatcctaaataaaacgggccttcaggctctgaaaggattagtgcctctgtctgtggtggttttcatatgcttctagtatcaagcattgttcttaccgttgtctagttcatggataatgccttgcttgatccaagtttgtgctttgaatattccaacaaaataatataacctgtgttttgcatatgatggttttctttcaggtgagatatcagaatgttggatccttgagagttgtttagctttcatcatgattagtgaagaaagttgcacatcaccattgtagtaatgtggcaaaccttgttaacttgtgaaaaaaaatgaaaagagtaattcatttggagtctcatttaaattgtttcggtaacaagagtagctcatgtcatcctcaaccatctcaagccactaaaccagtactccattactgggtggtccaaccctataagatcgtgactgtaatttgcacaattgattatttgtgttgattttgaaaccaatcttctctggttaaaatttactatttgcagtcttgcttctttgcctggtcacctccatcccatgcatcatacggtatgtagtatggggcatatccttttcttcactgggtgccgtttcactggtcatttggtcggcagtcttgaagctgctcctcactgatccaggcgtaaagataagctgatctgattgatatctgccaaactcacagacagaagaaaggttttagttctaccaagtactgtactagtagttttgtgcaaccatgagagattcttgtcttccatggagtgccaccgccaagcagcagctatcttgcatcctactccacatcccatttttgttcttgcttcaatccctatctcatcaccttctcgcatggatcaaattcgataagaaatggagtaatcaagatcagtgaaagctaggggagagcttgagcttcttggccggcaatggcgccggcgcgcgggttcgtggagaggctgagcacggtggaagggcggctgctgcggctggaggtggtcgtcctcgccagcgccgtcgtcctggcggcgctggtgctgtacggcgccacccgccgccggagcagcgacaagctcctccgcggcgtgatgtggatggcctactcgctgtcctacgtggtggtgtcctacgccgtggggctgatccaggacgggccgttccgcggcgagacgttcgtgctgtgggcggcggcgctgctgctgatccaggcgagcgcgtacgcggcgccggtgcacagccgccgcgagttcagccagcggaagnnnnnnnnnnnnnnnnnnnnnnnnnnnnnnnnnnnnnnnnnnnnnnnnnnnnnnnnnnnnnncgagtgct

SEQ ID NO: 57600 - DNA, 2736 bp, Oryza sativa
cgccctatcaaagattatagtcatgcagactaataaatacagatgataaatccaactcgaaaccagaaaaaaactgacaaaatgaccataccaaaattattgcacaagtatttgttcatatggcatcaaatcaatcaagccagtgatgatcaagtattgccttgacgactaaaacagagccaaatgaccagtggcatgggacatgggggttcagttgaacccccccaaacctttttgggaaccatcaaactgttactagtattaaggtttaaggtaaatttctagaacagaagctagggttaacgcaaattcgagaaaaagtgcgtgggtagagagagagagagaggtaggtgaaagaggatgtgcgagacggatgcggcggaagcagcaggacgagcgacggcgacccagctcgctcgctcgcgcgatggatggggatcagcacaagcggtggtggtggaggatgtgctcaccaggatggatgcggcggaagcagcaggacgaacgacgaagccctactcgctcgcgggatggatagggatcggcggaggccgagggcaaactcaggaatcaggatgactcgcacatcccacccggattgcttgcacatcccacctcaccctatacaaacggtggtatatgaaaatacaactaataatgcaaaatttgctacaggacaccgaaagattatgatctttactatgagacacccgaagatcgtgtatttgctcgtgcacactgtaaaaaagtggtaatgagctgctgaacactcctctcattattttattattttctatcaaaatggagagagaaactttggttaaagacaaatttgcccatgggctcacttgtcaatctctctttctctgatgttcttcttcctctctttctctctgttcatctcttcctctctctgtcgcaggctcgcggcacaccgggcagagctccacggcgaaggtgtgccagcaaggacgacgaggcggcaacgtgcttggacgcgacgacctgcagtgggtgacggactgcacgatggcgcgggcgcggcgcgcggggtcgccgctcttgaagatgcccgaggcgacgaagacgccgtcgcagccgagctgcatcatgagggcggcatcggcgggtgtggcgacgccgccggccgcgaactgcacgacggggaggcggcccagctgcttggtctgcatgacgaggttgtagggcgcggcgatgcgcttggcgtaggcgaagacctcgtcgtcgtccatgttgcggagcgcgtggatttcgcccatgacggagcgcacgtggccgacggcctcgacgacgttgccagtgcctcacagacgcggtgcgcgacttcctcgatgacgccgatgacgtgctgttcgggcagctcgcggcggagcacgcgacgaggcggcggcgtgcttggacgcgatgacatgggcgggccacggcgaggtgacgaggtcaacgaggcgggtggcgtgggaggctgggagcgcgacgcgaagaagtcgagcccgccgccgccgccgcgcaccgcgccgacgcggagagcgtcgccggcggcaccgtgggcgatgcaccgccgccgccgccccgccgtggctgagccgtcccggctcgggccggctgccgtcgccttctgctcagtgtgaagaagaagaagaaggggaaaataaaagaagtgagaggaagaacactgtacaggggcattttagtacttacataactctttctctcttcatttcaaccagaaataataaaataatgggaggagtgtccagcaactaattaccacttttttacaatgtccacgagcaaatacacgatcttcgggtgtctcatagcaaagactgcaatctttcggtgtcctgtagcaaattttaccttataatatctagcactgctattctaatcctgtcctattcatatcctatatagttatatagtttatccttactttaatgctatttatctcttatctcattaagccacatcactctaattatttctaacctttggatgatagatctatggttcaatttgtctcttctttcttctctcataatatcatgcaatctcaattattttaggctcaaaattcataagtatcaaattattttagttttaataatcatgttgcatattatttgtacatatttaatttcccgcagcaatacgacgaggtatttatctagttttccaaataaagccccctaggttggacctttgagatggtggatttttatttctctttttcgtataaggttaagatgatagataaataataggtatgtttgggcataggccgtgccgtgtcggcctacgtgctgaggttggaacccatgcacgacccagtgagatatcgggtcatgtcatgttggcctggcaagatttggctacgtgggctgtgcagaggccagttagcccaaatttgttatataccaagaaaaaaaatgcgaatagtatgttgcatcctgctgcacaaactttagtgaagctttagtgaggtcctccgctcactgatagcacattccacatcctcctcatcaagcagcgtcgtagcccttcacttcctacttccttcgtcttgagccggtgagtccacaatgaccaaaatgcttagtggttgtcctcatgaatagggtgagcggttggctacactacaacgctaccgtgcatacctacatcgacgagcgtcctccatcgcttcttctgcccttgagcccctggcttacttga

SEQ ID NO: 57601 - DNA, 3606 bp, Oryza sativa
  unsure (1)..(3606): unsure at all n locations
cggagaaaaatgttgtggaganaatctcacagtgggtgtgttgttgggattataacgagacgcgccgcgcagaaagaagatacgggcgacggatgtgtgagtttgtgggcccagaattcccgagacgggggcgaaaattgtagagaatacaaaggctgatttacccgccatgtggttaaagtgttgcgnttaaattggcattaggatatcccccgcggtggggganggaaacccccgaccccacggaattaggggcaaggtactctctccagggcggggccccatggtgccgccgaccctgtcccattgttgaaggaaaaagccggcaattcgggggtcccataggccggggtgccgggtgatcgaccgacaggcccgggtcaagcgggttggagaagaaacgggcaagggccttttcccttggtgttccccctgttcaaagttttttaaacgccgtgtttccggttttgtcccgggggaaggccggccttcccaaggggcgggggacctcggttttaggtgggcctataccggccggcccgttagggggcccaaccccgcggttccgggtctcaaggggggagctcgtgttccttttcgaccaagttctacacccgcaacttgtgcttgtcggggccaggacctacgtttgcatcgccgccgccgtgccggggatcacaatgtggacggcgttcttcggcacgctcggcccggcctaccaccccctccgcatcggcgtgcgcggcttcgaccgctccgtcacggtgctgatcgtcgtgatcaccgccggcctcgagctctgccaggcggtggccggcttctccagcaactggaggtacgtcaagacggtgtaccgctgcgtgcgcgacgaccagccgtggacgaacaggcggcacggccacctctggtggaaggagagcatcacgccgccggcgacgaggtactgggacgacaaggtcggccagtacgtgctcctcaagcggttcggccaccggccatggaacatcctgtcgtggctgacgctctacctggtggagccgcggcggcaggggcagaagcgcggccggaggaagcgcctgccgcaggaggtccggcgagcggtgctcgtgtcgctcaaggcgagctacggccacctcaccaatggcgtctccacgctgcggaggcacggcctgacgccgcagctggagtgggcgtgcgcgttccccaagctcaccgaccagatcctggtgtggcacgtcgtcaccacccgcttagactggacgagcgccggcggccatggccggagccgccgccgcgacaacggcggcgacgtgaacagggtcgtggcgacgaagctgtcgaactactgcgcctacctggtcgcgttcgtgccggagatgctgccggacccgagctacaacgcggagcagatgttcgacacggcggtgcagcaggcgagggaccacctgggcggctgcaggacggagagcgccgtgctccagaggctgcaggagatcgaggacgaggagcggcgcggcgccgtgcgcgagagggcgggaagcgccaccgtcatcgagaaggcggcgctgctcggcgggcagctgaggcggnccgtgnacgaggcgcggcggtggcaggtgctgnccgagttctgggcggagttcatcctgttcctcgcgccgtcggacaacgtggacatccacgccgaggtgctcggcgccggcggcgagttcatgacgcagctgtgggcgctgctctcccacgccggcgtcctggaacggccggccgtcgccgcgacgccgtcgccaccgacggtgtgatcagattgatcgatggttatgttcgagatcgtgcaagctagataggggatgcaaatttagttgctccatccatgaattcattttatattttgaaacatcattgaacgatttagtaattagtttggaacaaagcgtctgaaaggaaaattttctggcttataagctaaaaaaagacctccgcgataaaaaaatttaagatatgacctttacaaatttattcttagcgattcaaaagctagagctagatattaaaaacagaaaacataatttaaattataaattcaaaactggttacggcttaacaagcatgatcatataaatattatttcaaacactaccaaaataataattctatgaataatttgtttcaaatgttaccttattacttccgccatattgctcgtttgaatcgttgtcgtccattcgcctctgacttgaatagttcagtgtacttaaaaaaaatgttgacacgtgtgcctaattattttttcgtacaagaccatccaaaagcttgaaatgcagcggcaagcaaaacaaaaagcaaataaaaaggtgaaataaaagtaaaacaggcaacctagttcaaaaaggaaaatgttcctactttatatagtttttttaagagtaaattgcgcccgcggtacacaaacttgtaaggtgggtgcaatttagtgtaaaaacttgaaaaactctcgtttcggtacacaaacttgcgtagtgcatgcgaaccaaggccaagacatgacttcatcactaatcttattgagttggcttgtgattaggataccacatcagcgcatacacacgttatgggagcgtgagctggctacacatatttgcaaataacccctcatacatctttcgattcctccgaatcttcttttgtgttgtagcccacgatgatgcccatgctagagatcagtttcatgatagcctaccaccaattgagttaccaccaaaaggagataaatcaggagattgatatatggatcaaggtggaaggccgcgaattggatccaggcggtagggctttgctgggagacaacacgccagccacgtttagggcagcggtggcaggacgttgccgccggcgctgaggcaacatggtgccagggctgcgaagtaaaggtgcacgatctcctgtatacagtgagtactttagtttatcatatcaaaaatgagattgtctttctcaattccaatttttgtggagatttcttcctcttattgtcgatttattaggtattgcaaacgagaaggactatcagttgttttaatttatgccaggagctagttcatggtacacaaaagctgtaatttttgttgacatttatggtatagaagtgatcatgggaaattagtatttttggagagcaatttgatcattaatgtgctgctagcttctgttgttaactatgctttcttcctggatatacccttaaacatctgaacctaaagtaaactgttctgaagatgaataattatctgtgcacaatatatgtagattccgaagatgaagaattcagcattgagatgcaccacggaggctttttttatgggaaatggtgtaaaccgggcttatgttgatggtagagtaagctggtttgaccattgtgagtcagattcttggtcactgttgtgggttgatgatttcattgaagaactaggatatgagaaatttgataacaccaaaatttactggttgcttncctgcacaccattaaatgatggggtgaagaggtttaatgtgatgcagacactaacaggatcgcccctcttgtacctaaggtcccatcatattgtttgg

SEQ ID NO: 57602 - DNA, 678 bp, Oryza sativa
  unsure (1)..(678): unsure at all n locations
cgtgtcctgatgaactctnnnnnnnnnnnnnnnnnnnnnnnnnnnnnnnnnnnnnnnnnnnnnnnnnnnnnnnnnnaaatgcttcgccgcacgccggacgccacccaatgatctcctttgccggaagaacgccgtgcgccaccatctccttcaagttttcctctgtcacatcagagggcacccactgactttcaaagctttctctctcctctgccatggatgcaaattggatgatgcgatttggtttgaaatatggccgggaatggataggagatcgatgcggtggttgcgcggaagatttttgtggaactttggaggatggattggaggggatttgtgaaccctagcttcaccgaagtgatttcgcactatagcagtgagtagggaaagtggcaagagtttcggcggggaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttat

SEQ ID NO: 57603 - DNA, 6090 bp, Oryza sativa
atgccgcaatggagcaaattgtgtgctattcctggaccatgtcgtgctggctcgctacatgcacttgtcatgttagcatgttgggtggtagcaacccaaacatggcgtggctagacgggccatgccagcacgatccacagccaaatagatcatgtttttcctgagctgtgagctgcacatgcgtactcggacagacacggaaggacccaacctatttgacaacctataggagaatttggtaaattcataggcattattatgtttgtacagatgggatcaattaagacacctcagttgcaactaattaatttgtttagtgtcaaattaaagctgtaatagtgattacactccagccaaccagaaaaataacacaccattttcccaaaataacatgtaagcatgatataatctagaaaacatatccattttattcttgtttttattagctcaatttcaagttgtgttgtctaagacaaaatttatttcaatatgcagaatgaggataaaccgatctcatggggatatacacattttcgttgcttatctcattggtgaaaaggaatatattttctcactaaatcaacacttgttaagagttgatacgtcataaaaaaattaagggccatccgatttctgctcttgaagttttaggccattggattctctgaatggtgaaatatctttttcgcccctaaggaaactgctatcaatttctaatgtaagaaatgaaatgagttcactataacaattataataaaatcggtatatgattcctgtaacttgctatagattctcctatatagtacattagattcctgtatacctcgttctttcataagaaacacatgcatgctagtagaaaaacagatataatccatccattccaaaaaaaaaaaaggcaatgtgacccattcagaggattcaccagtggcatttttaccctttttctgcatccaaccatatatacggctatcaaaatagggaacttagccccacaaacaatcaaatctaaattttgttcctatggagatttgaactcaagaccttgagatattacttaggtcattgtaacaactaggctacgttccctttcctggcagccctctatgcacacctcagaaggccattgaaatgcttcgctcacaagaacacctgcagaggcaacttctgctattcaaacactcttttaagatcatcaagaatgtgatagagcacccacatgatatcaagtacaggagactgcgtaaggtatgcttggctgttcttatgctcttttattaggttcctttggtccactaaaataaattcttactgatcctaatttttcaaatatgcagtccaatccacagttccaaaggagtgtggcgagctacaaaggtctctatctcttattcctagatactccctccatccacaacaaaagttacacctatttcacatttgagtttttccaaataaattattcctatttgtagtctttatacatttaagacttaaatgaaaagataaattaaatgttttattagaatccaagaaattatctaaatactcatccttgattgattttgtaacatccaaggtgatttaatttctccttagtcttggtgtcaaaagtaatatgtgtaacttttatggatagagggagtggttgatacccacttcagagcattaacactaaagctgtaaaatcgtgaggccacgtcatctgaaatggtgagccgtccgatctgaacgttccacgccattcgatctgaacgttccaaattccaagctccatgttcagttgccgatcaagcctggcccaaattacccggctagaacagcccatccagtccccattagctgccatcctctcaccgagcattgcacggccgagtaaccgtgcatggtggtggcaagagcaattgattctaatggatgccatcattttcttttttaaaaccgatgttatcatgatggggcagataaggggttactcctaatggattattaatttcccctattctcttcgtatcccctctttcgatactgccaataaatttacataatccttagagcaagtttaatagtttaatagtatagccaactactaactctaatcatctatagccaatctaatagctcatttgtataatagttacatactacactattaatacttgatctcacctgtcatacacacattgtgtcttggagtccgtgctatagctggctacaaatctgtagcccgctgctcttctctctccttatttattttcttaaaatatatttgcagctgacttatagcttgctattgtactgctcttatgcgtcaatataatagggccaatggtgttccatttctgttgctggagtttgctcgctggaatcataagcatccctacgccatcatcttctttaatcactccagcaagctagcataggctatattagccatcaacttcctctttccttttggtaaattgatctgattttttttctgaccacatttcagttcttacatgtatttcaatgtgtaagcatgctccatacataattgtaattgcattagttttccagtttggctatctcgcattttgttacaccagttttaccatatcaattccttctttttactctgcatccccattcgttttcacatgattttagatactaggttactgacttggttaatttcttttggttgtcccgaatcacacatcatttttcattactgcagttgaagcatgtaggaaacaatatcatctagacctacatattcagatctaatatgtatttcaattatgacctttacctggtgaagttatcttaattagtatatatacggtaattaatatgatttcctgaaactccatatcaagaataagggccagcatagatacgctggattggctcctgtcgcagtatatatgttggttcatttcactgtccgagcatcaactacctcttatcatcagtaaaattaaataaacaaggcaccacacatcaaagtcactttcacgaaaaatagtaccagcaacaaatattaaaattaatatccactcctactctactattgatttacctccttttgatttacatcttgctacctccttttgattaacattacttcatgtggtcatatgtatttaatatagttaatatacaagtatattatatatagcaaatagtactaagcatgccttccaatttatcctaaattaagaatttcctcagtaacaagaaaaattgatctccagtcatcattcttaatcattgttctacaattttacgcacgtaacataattttatttatgattttatacagtcccgcagcaacgcgtgggatatcacctagtttgctttataaactcccctcttcttttttccttcaggtcttcgaaaatctactgtaactaacttcctcattttttttgcctccctgaaaacagctgcaatggagttccttgaattgattggtttctgtgaggatgttgtctcggatgagattggtcgtgcagagacttacttggtattgaaaaggaacgatcctagcttgccgtggcttgcaaagtcctctcttgaagtttccacaattgtttcaccaagtaatctcctattgcttccgtatacctgtaaatcattttcattactgttgtgtggatgctcataggcaactgatgtagtatggtcttcctacacgaagattgtttgtacatggaaacaccaaatggtctgtactatctgtccaagcttcatgattttacatcaaatatacacactgcagataaatttcctgacaaaaatacaaaatggacacattttcccttttgtgtggactccgatagaaattgattccagatgctcacaaatgccaaccgtatccacgaataaagtctagactagacggtgcaatccattatcatcgcgaagatgtcaattggaactgaagtatatagagccagatttaatcacaaggtctcatgtttgggaactgaaattaaaaaaaaggggactatagaaaaccgtcacaagttttataagggaaaaactttctaatctaaagtattgaaagaactaatctttcttgtcaccggaatgtgccatgtcatcgagattacaagggccgtcagatgaagtataagttcaatatccaccgttaaatcttggacgagcctctcagtaaagaactaatgaaagcctccagagtctttaataggaagcctcacgaatctggcgtatccacgtgtcatagtagaacgaaaaaaaaaaacaaacgaggaaaggaaaagagagagaagcgtacccatcctttcctcctcacgagtcacgaccgccgcatccttccctccctcctccttcccatccccatctccggcgctgccggatcttctcagcacggcgctagatcaaacttgagacgatggattgaagtaggcaacgaagaaacaaagcggggcttcgaggagaggaattcgagcaggacaatgccgccacctcgtcttccctccagccaccacctccgtacgtccactgcatcagcacccaaggaattcttctcctagtccaccccaactccccaagcgtcgaatcagcggtaagttacatacttatattctcaactcaatgaccatcccctcctgacctctcctctattgtatccgccgccatgccacacctacattgtggggacacaatcacataatagtaggaggtagtgagatcatcccaaacaaggatttagtcatagctgatgataatttggctgcttgcagaatgataagctgaaactgattagtggcatactaattgatatcatctgcattgtcaaattttgtgagcatggtgtaactgcctactcttgtgcactgaaatcttcagactacttacattgcacctgttcagcctcactgcatgactgcatgtgcatgactttagggcactcccaacccataacactagacatggtttccataaactccacatcatcaagaaactagtactagacactactcttccaatgcaaacaccactattccatacttcaatttaatgctacttatctcatatgatatcttggatgttgtgtagaaatcatgtctcatgcaagacatggtttccttctctttcctcatttattcacttgccatattattttttgtcctaagtggcaacttatttaatgctatggacaccatcctagtcattgggttgggaatgcctttaatacactgtgcctagctgaaatcttgtgatcgtattctagaggggtatggctgtttaatttcatgagtaatacaattttatttgtatcgatgtcatagttaatagttagatgcaggtacttcaagcagactgttaaaaaaagaaaaaaaatatattgctcaatctaacgactgaatgattagctgatgagcctgtggcaagcatggaacaagatggagcctgaaacaaaattctcaaaacacctgttgaagtcaatttcagggccatctttttatgcgaacttggagcaggcttctaaagatgcgagacatgaaaatacaggagaaattggatatcctgattgagggaaaggacaatttcatgatatttctatctatatgtctaatactccctctgtttcaaaatgtttgacaccgttgactttttagcacatgtttgactgtttgtcttattaaaaaaatttgtgaaatatgtaaaactatatgtgtacatgaaagtatatttaacattgaatcaaataatatgaaaagaataaataattacttaaattttttgaataagacgaatggtcaaacacgtactaaaaagtaaaaagtcaatgttgtcaaatattttaaaacggagggagtaaaacatagttcatcatacgatatattatgacccataaatatagagcttttctacatgtatctaaccaaatggctagtttaactatagtattgttgtgtattgggcctttccaacctcgaacataattccgggctgtaaatttggtgggcttggtgtctaacaacagcagaaggcccacatgcgtcccatcgcaatatcccctcggccgcttgcttcgatgcgtagcggcagtaacacactctcccacttcgcgct

SEQ ID NO: 57604 - DNA, 785 bp, Oryza sativa
tttcaagttttcctctgtcacatcagagggcacccactgactttcaaagctttctctctcctctgccatggatgcaaattggatgatgcgatttggtttgaaatatggccgggaatggataggagatcgatgcggtggttgcgcgaaagatttttgtgaactttggaggatggattggaggggatttgtgaaccctagcttcaccgaagtgatttcgcactatagcagtgagtagggaaagtggcaagagtttcggcgggaaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatactgattttgtaggcctttttagcctgcaaaaactatttgggttttgttgaggtgactggtttttgaatagtcattctctcggcatgttatatgcttattttgattatgacgtgagtcatggcctaggtcagttctgcgccatccagccgggataaccatcgtcgctgacgtaatatcccagcgcagccccgctatcatttattttcacaccggcgcgacagttccgggtatccccgatattattcggattgctga

SEQ ID NO: 57605 - DNA, 108773 bp, Oryza sativa
  unsure (1)..(108773): unsure at all n locations
ctaaagatatcggggggcctgacaaggcctgacagatttagaaccgggactaaagatcatttttagtcccggttggtaacaccaaccgagactaaagatcaaatatgcccgctgtagccaccaaccgggactaaatatcatctttagtcccggtttttagtggaaccgagactattgtggatttcgggcgaccgaccaaagatggtttctccaccagtggacgcggcgatgggcggggtggcgaccggcacgggggcagtggccaggggcctcgccgggggagcggacgacgacgatgcaggcgtagcccggctagccagctccgagacgaggcgctcaacgaatggtgctacgacagtctcctcatcgagcccccgtggcttggtgctgcgaatcaccttgcgcaggcacgatgggctcgtcggcctcactgcccacgccgccaccgcagcgcggccatgtcacccatcgccgcgagatcgacgagatgatggcaatgacacctcttgccgcatctatggtggtggagagagaggaaggggaaagagaagagaggggagggaggtggggcccatgtgcagttgcggggtaacggggatttttgtcggaaaatatgatggagtggcatggttccaatttctccaattttcagtggtacatagccaatatgctgaatagtagtggcattttttcgaattggcatatttccagtggcatggatctaattaaccctttattttaagatgttttagtggatatagctagcattgcgctatataaaatacaattgtatctataaaaaatggttgagtgtataaatattttaaaataaattttaatctagcccgcgcaatattacatggaaaatctgccttagttcggttaactcaaaagaatgaactgtcttggttaaagtgttccctaacttatagttttgatgaattttgatgaatgtttgcccatgcatgcaggaaaaattccacaattgttgttcactctttcggggctgaaatatgttgaagttattggaaaccagctatctggttctctagaagacatcccttctcctttaacttcatctttgtcatcaattgacttaagcgacaatcaactatcgggcccgatacccaaatcatttttccagcttacaaatcttaattatctcaatcttggatcgaataaattcataggctcggttgaacttagctctgtctggaagctgaagaatcttgatttcttaagcctgtcaaacaatttgatatcactcatagatgatgaaggtgaaacagtgtccccttctcttccaaacattagatacttacacctggcatcttgcaaacttacaaaaattccaggcacactaagatatcttgatgcgatttcggaccttgacctttcaagtaaccaaattaccggggcaataccaaggtggatatgggagaatcgaacgtaccagctcaatagtctgaatctctcgcacaacatgtttactactgtggagcagtctccttctcttgttaatatcgcatatttaacttatcttgacctcagtttcaatagacttcaaggaatcataccaataccagtaaccacatccagtgagatcgcattggactactcaaacaaccacttctcttcaatagtaccgaactttggcatatatcttgaaaacgccagctatattaatttctccaataataaactaagtggcaatgtaccatcttcgatttgtaatgcaagcaaagccattatcacggacttatctggcaacaactacagtggatcagtaccagcatgtcttacaggaagtgtaaacttaagcgtattgaaattgagagacaaccaattccatggggtgttacctaacaatagtagagaggggtgcaatcttcagtcaatagatgtgaatggaaaccaaattgaaggtaaactacctagatcactatcatactgccaagatttggagctcctggatgctggaaataatcagattgttgattcttttccattttggttgggtaaacttccaaatctccgagtccttgtcttaagatccaacaaaataaatggtacaataaggggtcttaaaagtggttaccaaaatagtgattatttcacaaggttgcaaataattgatttggcctccaatcatttatctggcaacatacattcagaatggtttgaacatttgcaatcaatgatgaatgtaactgatgacgaccaaatattagagtatcgtacgaaagcaagtataaaatcgctctatcaggataatacggctgtcacttacaaagggaacactcttatgttcactaaaatcctgaccaccttcaaagcaattgatctctcagacaactcatttggtggtcctattccaaagtcaatgggggaagcttgcttcactacatggatttaacctgtcccacaatgccttcacaggacaaattccatcacagcttagttctttgactcagctggagtcattggatctctcttggaacaagctctcaggggaaatccctctacagttaacctctctaacctctcttgcttcgttgatctttcatacaacaacttgactggaagaataccgcagggcaaccagtttgggtcatttagcagcagctcgtttgaaggcaatgccaacctctgtggaaagccgttgtctaaacaatgtgatactccaggctcaacatctcgaaatgcatcagctacttcagaaaccagcagtttctggcaggacagacttggcgtgatccttttgttcttcttttctggcttggggttcacagtgggcttcatattggcggtctggttccaatcattcttccacatagaacgatggactcacaagcattgatgactgttagtatactgtatacactatgtatggtgtttatccacccaaggacatgatatgtgtgtatgtgtgtactcgtaattagtgacaggtgaagtccattctctgttgataataatgcataattttgtgtatgtgattaccaaaatagtggggtagtggcgacatctataactgtataagaaatgtgctctttgcactgacctatgcgctggcacatttcctcgaacacctggtgccctggtggtggtgatggaagaagagcgcgacgacgaggcaacgagcagaccgacggacagtcggacacgctgttcctgggacatccccatggcgaccccattgagagccgactgcaagatctcaatatctgcaaccctggataccatcatcctctctgcttcgtctccgcctcatcctcacccctgacccctaaccattccggcgaggtccaaccaagaggtggtggttatctcggattgggatgtacggcgtgtggggggagcgggattggcagagtactccgagtgggatgtggtggaggagaaggacgacgaggggtggaaatctctcggcagctggcggcggcggcgtaggcgcgtagttactctaggacggcgcgcgtgttgggcagggggtgtgtagcgggagagagatcgagagagtatgacgcccgcggcgcactaccttcggcttcaaagcagatgcggagatgcatgctagaccgggctcagagcccgtccgttttcagccgctactgccttcgatccgctgtctcacgtcttcaattcgtacgtgtcgccgtcgaattgggatgaagatatagacaaatttgataatgtaccacgtcttagagcaagtttaatagtatgagtctcgctccgatgctttttacttgagtagaaattaatccgtgccgttgatcgtatttaatcgtagggttaagatctaattctactcccactagattttattagagtagaaatgtggagggctatatttgttcagagataataatttgcgtaggggtattatcgtaatctgtcattatctaactgttcaccctctctctatcctatcctaatcgacaccattcctctccattcgccgtcgaagacgaaggcgagcgtgtttatcgtctgcgtgccagcgacgaaccgatcgatttggagacaatcgtcagatatgttgatgagaaaaatgtttactaatctctgaagattaatctgttcttacttatgatgaccatcgtatcggaacgtctttgtggatggtgctgatgacggcggcgtcgctggtgaaaacgccgccgccgaactacatgccagcggcgaggaaggccgtcagtccagcgccgaggacgatggcgagctacagcacgcgggcagtagtcaccgccaccttgtagtgatccgcaaacgcgctggcaagcaaggcctgaggttgattgatcaatttaagcaaagttaattaagcagccatgcatatatcatcggaatgtaggctaagctaggtaggtaggtaggtaggtagctcacctggccagcgacggcgaggccgtcggcgaggagcgatgtggcgagccagacctaggcgcagagctggaacgccgccatggccgtcacgccgtggcgcgtcgccagcgacgccgccagcgtcacgcagaacgtcacggccaccactctcgtccggatattaggagattacttacctgccctttaaaataaacggtctagattaattctattcggagtagaatacttcaagtatattgcaccagagcatctctctaatagtatagccaactactagctccaaatcatctatagtcaatttaatagccaattcatacaatagttacatactacactattaatatctggtcccacctgtcatacacacactgtgtcttggtgtccgtgctacagctggctacaaatctatagcccgctgctcttctctcttctcttttatctccttaaaatatatttatagctgatttatagcctgctactgtacctgctcttactgtcttttgtttttttaccactctaattctctaaaattactcctttgataatatcacccgccatcaggatcgcgattttttttttcaaattttgtgccactttctcgttgagtaggaaggggatgaacccgtcgctcccctttgcctgtcgcacagcacgcgaccaccaccgaggtccgtcgccggcaccagctttatctggccaaaatagtactccatccgtttcaaaatgtttgacacatttgactttttagcacatgtttgaccgtttgttttattaaaataattttgtgaaatatgtaaaactatatgtgtacatgaaagtatatttaacaatgaatcaaatgatataaaatgaataaataattacttaaattttttgaataagacgaatgatcaaacacgtactaaaaagtcaacggtgtcaaacattttgaaatggagggagtattagtaaggcctttacattggctgcggcttcactgttccgttgttgtgtttccatccgtgttccgtaccacgtggagggcatcggtttgtcgattctttttggtggtggggtcggcttctatctgccgtgcagaatatgacgccgtcactactccgtcaaaacaaaccgggtactagtacttttcactccgcgctgcacaacttggaaaaccactgcatccttatctcttgtccccaaatcagagagttcatctgaagttctgctcatctgctactctcctcatcttcctcttggccgcacgcaaccatggttgctctcgcgttgtcggcggccgggctcgccggcttggcgtggtctgcactccgcatactcgtcggcttggtgtagttcaatggtcagtaccaaatgtggaactcccttgctgctggcaactactgtttgctatggtgaagaagtgaagaattgaagatcgaaacttttttcaccatacagctgcattaaggtagttttatttggtaagttcatttttgcaaacacctcttgtgttttgatgcttctaaattattaggatttttttcacatgagccaaacaacatgtttggtgggaaccatatatttgatgctaatacaagagaaagtactagtatgatttgacagcttgaatcgacatgggaattcagattaagatccaaccttacaagttgtaatgtgattggaaattggtaaaggtgctaattaatatgaaaaaaaaggtggggattttaatttaaatgggcaaacatgctatagggatatgtatcaattgtctgtgcagtctcttcatgctgcatcccttgactttgttcagaagttctgaaataaccagatgactgaagtaatgaagcaccttcaacatgatagtagtctggcatttgcatgtgattgtagttagtgggaatctctgaacgaccctgaatctgtataaggcaaataataatcagtagcactaataagagagtctcttttgccaagtgtgtgtgtgtgtgtattttgaatctactgacctgcatcatggtgtatggcagtgatggtgttaccacctctgcttgtactggacactttgatgtgtttgaatcactctttttctttttactccgttgtgttgccttgtcaaaaccaccaattggtctcctcgacccacgaatggctttctccttaacctttatgcctcttgctttactcgggccaacattttcctctgtgcctatgataaaatatttttgagatagctgatttagattataacatagtagtcactagcataagtactattcaactcagagtagcatacaaaccagatttatccaaatctggatcatgccttatactcaagtatttctccacatcttctgctaacttttgtgcattgttggcagccattaagtatgtttcatcagattctgcagctcaagatgctattttaacaaacattctgcacaagtctctcctgcgcgttgataactttattttaggatcttcatgagtactacagttgctctttatatgtagagattttgcatcaatggtccatctttgtagtatgtattgcttatgaatttcttttatattgttaacatcaagtatcttcaatgcatggcaacataggattccgagaaattcaaacttcttgcagctgcacctgactttaccttctgttggagaaaattttacaacatgctcatggtgcttaccgtgaacttttaatttgtacaccatttcagcatcaatatcaccacagtagtataggtcacagttcaatgtttgcaacacttgttcctgaaacactttaaatattgttggagtataaattcttgttgcttgccttaatattgtcaaatctgctttcggccatggtgtactttatgttgtcttaaagtcatttttgacttcctcatatcttttgtctgacaacaacctgtcaaagtgttccaagaaggtaagtatgtcatatttcacactgatatagcccttcaattcattgttcatgctctcacttctctgtgttccactcatatcagtagaaaatgtgtttctcccatacactaatgcccattgctcttttttttttgaaatagcctctcaagccatttgttctcctgcagatcatacttttcaagcattctattccatgcatttataaattcatcttcctcctctttgtcataaatacaattctgaaaatcttcattgaatttcttgtactccttcacaactccagcaaggtgtttgcaggcattctggttcatatgccaaacacaaattctatgatgactttctggcatgactaacttgattgctttggccattgctgcgtcttcatcagtcaatatagtctgtggcttctttccagacatggcttttaaaaatgtcttgaaaagccaaacaaaactatcagcagtttcatcatacaaaagtgcagcaccaaaaacaacgcttttcttatgattatccacaccaacaagcaaaccaaatggacgaccatcatttagttttctatatgttgtgtcaaaacaaagaacatcaccaaaaacttcataatcagcaatcattttagaatcagtccagaaaatatttgttatcaagtcatcctcatcaactagaatggaatagaaaaaattaacatcttccgatgattttttctccatatattccaagactccccctgtgtcaccttcgtttaccttcaatgacctctttgaatataatctattcttcatgtcttcacgagtaaatccaagattctcatatccacccgcttcttttgccattaaatcaatagtagccttattagaaatgcctactgattttgcattttcagcacttgccatctgtgcttcagttattttcctttgagatcttaagtagagggcctgacttccagtagcaagaatgtggttatgctcgtgcaagaattcatatatgcaatacaatccatcatccctaagacttattttcatgcatgctcggcacatacatcgtgtttctggcctactaaaacactgaccgtaatttgaaatttggtcttctcttttatcatgaccacgagtacctattgttaaataaaactaactcagtatatgaattctatatgaacactaaacattgtaaatataagttggaactagtacctgcacgagaacaacaaaatgtccgattctttattatggtggaatctttcacataatggtaactgcttcttcgaatgctaaaacccatgtctcgagcataggcattatagaaatcatatgcctcttgttcactgttgaatttcataccgatgattggtgccttccctttggagggatctgcttgtggagtagcttcaattttactaggatcttgattaatatacccgttttttatctgagacaaattagaaaaaaagaaaaactttcatgaaacttacagaaaaaaaagggctaatagaaaagaagcaaaacttctatgagatttactgatatgatgtgcttgtagtgatcaagtctcaatgattactaataaaagaaagtgaaaacattatgaagtcttaccgtctctaattccccttctaggttaccatgaaagcttgtccctggatgatgcagtacaaacgttccagcagaggcagctggttccgtcggcatggttgtcacttgttcatgcagtgaatcggtgaccttgattgaccttggaagattagatagagaggccattgttgttgcgaagaagatgattgtgatccgataataatgtgccatatgtaaagcttaatctattttctgaaaaactgtctaatggtttggcgtcttaatttttatttggcgcctttgtttccctggagggccacgctaattaggattaatcgctaactgcgtaatctggtgattgacggagagaataatcctgtaatctccgtttatggtggggccacacaaaaagaatcgacaaacggatgccctccacgtggtacgaaacacggatagaaacacaacaacggaacagtgaagccgcagccctttacattggccaggatttccacgcacgtgccgaaagtgtccaaatggcatcgaccgagaccacagggaacaaagccaccggcgaacgactccacgccggagtttgactccctcgctggacacagtctggtcccgtgcagcacgcatgacagtatccagtatttcaacacaacaatctattcgaattatcgagctggaaaactgattagaaaaaaaagaagtacagaaaacgagaatgagacaggaggatagataggccaacgaggatagaagctgctgaactgaggcagtatgaggctggcagcaagtttcattgtcgcttgcatcactgtctatccgtttagagtatagacactctctccacaattccacattatcagggtttgatatttcggactgaaatttcgatcattttgcggacccctccgatacgatattatttgggccaaaattttgatttttttaattttttatgaatttcggtaatatttgttcaaatttgactaaattttgttctaaaatttggaaatttcagaaatttcgttatattggtactgcccgatacaaaggccgaaaacgagaaagtgaaccctgatcatgactcgtgagactaacctgagttgttctctgaattagtccaactgtccaagacaatgaaacttgctgcttctgtgatcactgatcagtcatcagtctgtgtacaatttcctgcgttcataatatataacagaataaggcaggtggaaaaatgctggccatatcaaggcaacaggctggcatggaccgacgaaaacaacactggtaacaggatatgaatgggcatgcaggaatggtgcaaatttatgtccgctcctggagcttttatatgtgtgccgagcaagcatatatacatctgcagtacaattggagcatcaacccaagacagcagcaaaatgatgatatccaccaagcaacgcctcctcactcccattctcattctcctcatttgttgttactccatagtcactgcagccaacaatgacacaaccgtcccttgtctcccagagcaagcttcttccctcctacagctcaaaaattccttcatcaataatgcaaacttatcgtcatggcgagctggatcggactgctgccactgggagggcatcacatgtggtatggcctccggcagggtcatttcccttgacctcagtgagttgaacttgatgagcaatcgtctcgatgctgcactctttaacctcacctctcttacaaaccttaaccttgcttccaattacttttggagagccgaactcccagtatctgggtttgagaggctcacagatatgatccacctcaacttctcacacagcaacttttatggtcagatccccattggacttgcttgcctcatgaaacttgtcactcttgacttttctagtaatgatgggttgtatttcgatgaaccaagtttccaaaccgtcatggcaaacatgagcaacctgagggagctccatcttgatgagatagaaattttcggatcaacttggtcagttgttttagcagacaacattcctcaactcgagattcttagcttgtttgcgtgccgtatatctggtcctattcactcttccttctcaaggcttcgttccttaaaggtgatcaaccttggatacaattttggactccccagcaaagttcctgagttctgtgctgaattatcttctttgagcattcttgaaattgcaggcaattcttttgaagggcagttcccaacaaaaatcttccacctaaaaagtttgagaacgcttgatttgtctcataaccccaatctttctattaacctaccagaattccctgatggaaataatctagaaacactaggtctagcagcaaccaatttatcttatcacataccgtcctcatttgccaatctcaagtccttgaagcgtttgggtatgagcacggcacgaacttccaaggagctgccctctttattagataagcttccttcattgacagaactggaattgcaaggatcggaatcaggcttggagaaggcggtattatcttgggtaggcaaccttaagcagctgactgctttggagcttgtatcgtacgatttctctgaatcggcaccctcctggataggcaatttgacgaatttgaagtttttgtggatctgggactgcaatttctctgggtcaataataccatatcagattggcaatcttgcaaaattggagaccttggactttagagggtgcgagttctttggacagcaaataccaccttggatcggtaattttacgaagttggcaaatttagagatgtatagttgtggcttctatgggtcgataccctcaacaatagggaatctcacccaactggaaagtctgcggatcacatctaatccccaactcaacggtaagtctttatacgacggctacttcttccttcattcatatgcattttattatatcatcatggaataattttattcaaaatgccaccaagagagtgctgtagaacactccaaagcttaagtagtaatatatatatttctgtattttgatttggatcgtgaaacancacatagtagatacatgnatagnctggtagtggtgagcaagtttccacgttctgtttgatanttgtggctcgcatctagatattacatcccacctacagtaaatcaatggcgtctattttcaaaaacttacnacattttcctatctacactanntctaggagcttaganatctattgctactanaatattataatagaatgctaaaaggagtaacatgtttgttttgagagcctagaagttaccatgttaattggtgaaaaaagagaataatgcacacggattaatcggaacgggtccatattatattataacaactagcatggtgcnccgcacaaattgcgcggctagcattcttatattatagtagcatatattttttttcttattttttattaaaatatcataaataacaagataatttaaaattgtactaacttgaataaactatcaatgtgcaatattcatattatgttgtatatatgtgataggtattaattatttttttaataccgaattttagttatttctaaattatattgctagatggactctagactcctcttccaacattctttaattttttttaattatgaatttctataatttataaattgtgttcctatatttttattttaaattcaaatttttagttatttctaaattatactcctatatgaactctagactcctcttccaatatttcatatttttcaattccgaatttccgttatttataaattgtgtttctatatggactgtagactataattataatattgcttttttaaaaaaaatgaacttttcattatttctaatttaatttctatatagactctaaactcatctttcgatattatttattttttaatttcaaatttcagttacttcggaattgtattcctatatggactctagactattgttccaaattttattttctaatttctaattttagttatttgtaaattgtatttccataattactctaaactctacttttaattttattatttttattctgaattttaattaattctaaattcctatatagactttatactcttcttccaatattccttattttaattcctaatttttattatttctaaattttatttctatatagactctaaacttatctttcaatatttcttttttttaattctgaattttaattatttttaaattatatttctatatggactctatattcttctttcaatattcctttttttaaatttcgatttttcgttatttctaaattttattttctatatgaactctaacctctatttttatttttcttattttttaattccgaatttccattaattctattgtatactggttgtatactggtacagaccctagtcttctcgtcctatattccttatttctaattctgaatttcagctatttttaaattgtatttctatatgaactctgtctatttctttctatcctattaatataagaatttttagaccatgagagtgaattttttttatttcaaattttcgttatttctaaattgtatttctatatgaactctaacctctacttttattttttttcttatttttttaattccgaacttccattagttctattgtataatggtatggactctagtcttctcttactacattccttctttttaattctgaatttcagctatttttaaattttatcttctctacttttatttttaaattttattcctgtatggactctttttttcctatttcttcgattaatatgagaatttctaggccataagagcgaatatggagccttcttttttatttatttaataagttaaagggaagatgcttattggtccatggttttattatataaaagggaaaagctaaacgtatgaacaatttgttaccaacttttttacaaacgttgatgtgacacatccactactgcaaaattgatttttggacgagaccccctccaagttgtaggtggaccataactactttcgcctgtaaaaattgctcctttgagtacggttcaagggtcgcatgcaaaaatatattttgcagatgacccttaagaggcctgcctgcaatgttgcaccttaaggggtctcttacgaaaatagattttcgcaagtgagcaacatggagagcaagtgggccacacgcgtcaccgcactacattttttcatatttttttctcctctccactcacgcacactacttattttctcttctctccttggctccacctcccatcactcctctcctactccctctcctcatctctttcccattccctcccttctcttcttcagcgactgagatggaggcgacagtaggctcactcaggtgcgatgttgacgcgcgtgacgacagtgccggcgacagcaaatacagcaacgacctcgagggcagctgatccggtggcgccgccctaggccccgggaggggcgacgacaatggcgggcggtggatccgacagcgccgtcctcgaggggcaacgacgagctcaaagaggatgggaagctagagttttggccgaaattgtttttgtggaacttttatttgttttctccaaaatcattttcgcagcggttggcataggtgaccacgtgaacatcatgtttttgcatgcggttactcaacatgcatgggaaaatgttgattttcgcatatacctaggttcaggcgggccgtctagctgcctgcgaaaattgattttgatcacatgcaaaaaatgattttgtagtagtgatcatggttaaatctttattagtgccttccaagtaactaaatcaaactttgttagtagaattttataaaaaatgttttagtatctctagcaaacaattatatatatagaaccaaaagcaatgcttctttttatcaaatacaatattttaaataaatgttaatgtaaccatgtgcaatattacggaaaatcagcttagtttggttaactcggacgaatgagttgtcttggttcaagtgcgtcctaaggtaccagactgtcagttcagtgaacattcatctttgaactttttgactagtatactgcacttgcatgcagggaaaattccacaatcgttgttcgctcttccgaggctggaaaatgtttaccttcaagaaaaccagctttctggttcactagaagacattccttaccctttaacttcatctctgttatgtattgacttagccaacaatcaactatcaggcccgatacccaactcactttttcatcttacaaatcttaattatctcattcttgaatcaaataaattcacaggcacagttgaacttagctctgtctggaagcagaagaatctatttatcctaagcctgtcaaacaatttgatatcactcatagatgatgaaggttaaacagtgcctccttatcttcctaacatcaagtacttatacctgtcatcttgcaaccttacaaaaattccaggcacattaaaatatcttgatgcggtttcccttcttgacctttcgagtaatcaaataacgggggctataccaaattggatatgggagaattggaagggccaccttaatattttgaacctctcgtgcaacatgttaactactttggaacaatctccttctcttgttaatatgtccaatttagcttatcttgatctcagtttcaatagacttcaaggaagcataccaataccagtaaccacatccagtgagatcgcattggactactcaaacaaccacttctcttcaatagtaccgaactttggcatatatcttgaaaacgccagctatattaatttctccaataataaactaagtggcaatgtaccatcttcgatttgtaatgcaagcaaagccattatcacggacttatctggcaacaactacagtggatcagtaccagcatgtcttacaggaagtgtaaacttaagcgtattgaaattgagagacaaccaattccatggggtgttacctaacaatagtagagaggggtgcaatcttcagtcaatagatgtgaatggaaaccaaattgaaggtaaactacctagatcactatcatactgccaatatttggagctcctggatgctggaaataatcagattgttgattcttttccattttggttgggtaaacttccaaatctccgagtccttgtcttaagatccaacaaactcaatggcacaataaggggtcttaaaggttgtcaccaaaattgtaatcacttcaaaaggttgcaaataattgatttggcctccaaccatttctctggcaacatacatccagaatggtttgagcattttcaatcaatgatggaaaatgacaacgatgagggacacatattagagcataccacaaacacaaaaataccattgctctatcaggatattacggttgtcaattacaaagggggcactcttatgttcactaaaatcctaaccaccttcaaagtaattgatctctcagataactcatttggtggtcctattccaaagtcattggggaagcttgtttcactacgtggacttaacctgtcacacaatgccttcacaggacacattccatcgcagcttaattctctgactcagctggagtcattggatctctcttggaacaaactctcaggggaaatccctcctgagttagcttctctaacttctcttgcttggttgaatctttcgtacaacaacttgaccagaagaataccgcagggtaaccagttcgggtcatttagcaacagctcctttgaaggtaatgtcaacctctgtggaaagccactctctaaacaatgtgatactccaggctcaacatctccaagtgcatcagctccttcaggtaccaacagtttctggcaggacagacttggcgtgatccttttgttcatcttttctggcctggggttcacagtgggcttcatattggcagtctggttcgaatcattgtgccacatagaacgatggaatcgcaaaaaacgatgattgttagtatacactatatgtatggtgtttatccacctacggacatgatatatgtgtatgtgtgtactcgtaattagtgagaatttaaattcattttctgttgataagaatgcagccttctgctttgcatagttttgtatatgtgattatcaggtctagtggcgccatctataagcaatgtgctctttgcgctaacctgtgcggtgggccggtggcgcattctcttgaacacctggtggccctcgtggtgtggtggtggaagaagagggcgatgacgaagcagacggacaggacgggacatcccagtagcgatccattgattgccgactgcaatatctgcttgaaaagtgcaacatctggaaccttggataccatctcaccttcctctccgcccccctcatcctcacccccttacaacctcatgccccattccggcgaggtccaagtggtggcggttatcacggattgggatgtgcgggaccgcctgaggtgggggagaaggacagcgaggggtggaagtctcgccgcagctggtggcggcgccgccgcaggccctccagggcggcatgcgcttcagccttcaggcagggcgtgcaccatgcaggagagggagatcgttccgagctcgccaggaggatggccgggagagatccccgcccttgtgcagacgctgccgcctctgacccgccgctgcacatcttcaatcgccggccgggtcgccgggaaagcagccggaggcgggacatggccgcggccccgtctggtgttcgccgcaacataacaggctttccgtgggcctccaaacatctcggcccgtacatgtcgaagtagttgacctagtaaacggcccactgcctagacagcacatggacacatggatgggccgacaacatcacggcctgttcagagaccgcaccatcggtctatcgcgctcacccgcccagtcacggtctcacggaggcgtagaagtgatcgaagtgttaaatcctagatttcacactgctaattgtatttcttttaatggtagatgtacacgttgacggcaaggcgcatgtaataattttattaatcttaagatataccgatccagtcttccggaggtgtttatagggataggatgagtatgtgcgcgttgtgagcgcttgtgtttgtgctgtgttttttaaaaatgaaaaatggttttgcgactaaactacatgttggtgacgtgacgctggcaaagtatgcacggcagctagctggccagctggtgctatcggatttgtatgtttcgtggtacttctgtgttcatcgtctgaccagggcacggccgcgacaacgacgcatgtacacttgttcacagccagttcaatctctaagtgcgattgacgtctcgcacgattacgatgccaagttgtcaatggcttcgtttcaacaaaaaaacatttgccttgacttgaataatctacctttctggccataggcagatagccagatatgtaggaagtttttaaaaatcgagcttacaaaagggcattttccctaagcataaagtccaatcgaagattgtaaatcttcttgtgctcaaacaaaggatctctgtctgagtcagacagtcataaaattagttgtttcaagcatacaacaatcaaaggcgccaaaatgtgtaccaggcaagctcgacgacggtactacgagacatcgttactcgtactgatgctcctcctcctcctacaagctaggctcgcgcaatcgcttcctccatgctcgccggaccaggccacggcgctgctccagctgaagcggtcgttcaccgtgaacaccgcgtcggccaccgccttccggtcatggcgcgctggcaccgactgctgccactgggcgggcgtccgctgcgacgacgacgacaacgacgccgccgcgagcgggagcaccggccgccgcgccacttccctcgatctcggcggccgcggcctgcagagcggcggccttgacgctgccgtcttcagcctcacgtcgctggggtatctcaacctcggcggcaacgacttcaacgcgtcacggctcccggccgtcgggttcgagcggctcaccgagctgacccatctcaacatctccccacccagcttcacaggccagataccggcaggtataggacgcctcaccaacttggtttctctcgatttatcaactcttttctatgtgatcaatcaagaagacgatcgtgccgatatcatggcaccttcgtttcccaactggggcttctggaaggtagattttctgaggttggttgcaaatcttgacaatctgagggagctctatcttggctttgtgtatatgtccaatggaggggaaggatggtgcaacgctctggttaattccactccaaaagatcaggttctgagcctaccattttgcaagatctcaggtcccatctgtcagtctctcttcagcttgccatatctctgttgttgacttgcaagaaaatgacttgtatgacctgagttcttcgccgatttgtcctcccttggtgttcttcaactctcaagaaacaagttggagggtttatttccagcaaggatcttccagaacagaaaattaacaaccgtagatattagctacaactacgaaatctatggcagttttcccaatttttcacccaatagtagtttgatcaatttgcatctcagtggtaccaagttctctggtcagataccaacctccatttctaatctcacaggtctgaaagagctgggtcttagtgccaatgatttccctacagagctaccatcttctctaggaatgcttaaatccttgaacttattagaggtttctgggcaaggcctagtaggatcaatgccagcttggataacaaatctaacatctctgacagagcttcagttttctaattgtggcttgtctggatcattaccatcttccataggcaatctcagaaatctcaggagactatctttattcaagtgcagtttttctggaaacataccattgcaaatatttaacttgacacaactgcggagcttggaacttccaatcaacaactttgtggggacagtggaacttacctcattctggagactaccatatttatcagaccttgctcttcaaataataaattatctgtggtggacggtttagtcaatgactcagtagtgcgttctcccaaagtagcagaattgagcctagcatcctgcaacatatcaaagtttcccaatgcagtaaagcatcaagatgagctacacgtaattgacctttcaaataaccaaatgcatgggccaatacctcgatgggcatgggaaacttggaaggaattgttcttcttggacctgtcaaataataagtttaccagtataggacacgactctttgctcccctgcttgtacacaagatacatcaatctcagttataacatgtttgaagggcccatacctatacctaaagagaattcagacttggagttagattactcaaataatcggttttcgtatatgccatttgatttaattccttatcttgccggtatactatctctaaaggcctctaggaacaatatctctggagaaatcccatcaacattctgcactgttaagagtcttcaaatccttgacctctcctacaatatcttaaatggttcaattccttcttgcttaatggagaattcttcaacaataaaagtactaaacttgaaggcgaaccaacttaacggagagttgccgcacaatatcaaggaagattgtgcatttgaggcattggatttcagctacaatcgatttgaagggcaactgcccacatcattagttgcttgcaaaaacttggtggtacttgatgttgggaacaatcaaattggaggctctttcccatgttggatgcatcttcttcctaaacttcaagtccttgtcctgaagtccaataagttctacggacagttggggcctactcttaccaaagatgatgactgtgaattacagcatctccgaattcttgatctagcttcaaacaatttctcgggcatattgcctgatgaatggtttaggaaattaaaagctatgatgtcagtctccagtaacgaaatattggtcatgaaagatggagatatgtatggcacatataaccatataacatatctttttactactacggttacatataaaggacttgacttgacatttactaagatcttaaagacctttgtactaattgatgtctcaaacaataggttccatggcagcattcctgaaactattgccacactaagcgtgctcagtggtctcaacatgtcacataatgctcttacaggaccaattcccaaccagcttgctagtctgcatcaacttgagtctttggacctctcttcaaataagctttctggggagatccctcaaaaattagcatccttggacttcctatcaacattgaacctatcaaataatatgctggagggaagaataccagagtcacctcatttcttgacactccacaatagttcatttataagaaatgctggtttgtgtgggcctccactgtcaaacgaatgcagcaacaaatcaacatcttctgaagagaaatctgtagacgttatgctatttctcttcgttggattgggttttggtgttgggttcgctattgcagttgtagtttcatggaaaccttgcattggcaaataatctttgaaggaatccaccctttttttatatttatctgttcaggagtctgccagtctgcttccccttgtaattttagctgtaattgtagctagcatgtatataatactatgtgcatggacaacacttttccatcatgcatgcatcctataagattagttgtttattaccttgaaaattttatacaagccaacaaacaattgttatgtctgaaacaagaaaggaattgaaatgcatgacctgtatgtggcattattagggtcagtttaacttgtagcatagatcagtgagctatatatcatgatcttgtgtttgaagtacatacttacgcagaacttactttgagtaccaaacaaccatactagaacaaaattttctgtgtgaagaactgaagtctgaagatcacataattacgcgttggaatgaaactttctgtgaaaagatcacttgcaatacaattgtaatcagagttatatgctgttattcttactagttgtgtaatactagcccgaatcttgtatgtggaccaaattaggtaaacatataggaactaaaactaaatgatgtcatccgagaacaatgcacaagcaaagcttaaaataaactgaaataagaaaacgaaattcattaataaaaactaaaactacacgattctttattaagtatcagctctacatctatatctaaaactaaaacggcgtcatatatcaggtcgcacattgaactgctagtctcctaataggccaataccacagcagagcaggaaaatcaacaccggaacactaagctgcattcgtaatttggtactagaatcgtagtaattccaaaatgggttcataatattcgagaaatcctagatttcacacactaacctgtgcaatgcagctgatggcaggaccattccatcaaacacctggcgtgcagagctcctgaggacatcgccatatggtgaccacattggttggtccaattggttgggatttcggtgtacgggctgcggtggtgggaatgggataggggagttcgccgagtactccaactccaaagtgggatgaagcggaggaggggacgacgaggggaagggctcgcaagtggtggccgctcctctctctctctctctctcgggtagttaactcatcatatcttcctatatagttgtacccactaaggagcatttacttgtataaagcaaagcatataagaaaccacatcatcaataattctaagccatcgagttgtattagtacatagttatcagccgttggataaagaagctactcatccatttaatttaatcattgattactcatccagtcacctccatttaactcataatcacgcgtgacattgttatccattttgcgcataatactatgttttcttctcccaagtcatccgagataatgcaaacttatctttttctaatataacttaaattattgtataagatgcgatttttgttttgttataaacaattggataacataaggtaattagacatcattaacataaacctatttttgaaacaagcttgatataaagcaaagaggtgcaggatactctaatagacgacatccagattgtgcatgaaaataactttcgtgcatcataagaaatcacaataacgtttaaaaaaataaaagatgaatggtattgtaatagcataggctatatattaagccacattatcatttattttgtatatatacagagttacatctaatcatttaaaatattgattttatttgacgataaaactagcaaatcccgcggcaagacgtggggtgccaactagttcatcatatgacaaaaccaatgaacatgcaaccaataagtactaaaatgatttcttgggttccgataaaaaaaattaatatagcacatagtgactacaaataaaatgacttcttgggtttcgatcaaaaatttaatatagcacagtgactacaaataggacttagacttttggaaaaaccaaataatgaaataggactttggcttttagaaggagggagtacatcgtaggcgtacagccgtacacggcgaccggctacatcctgtgcatatgtgggtactatgaagtgtcatgtagaacgaaactgctcccgaaataatggaaggagtcgattttcagtcctttttgtttcgggttaaaattattataatctagattattaagtcagataataagctggattataataagggactatcatatatctgttgacagaaaatcccatcttctatctttcgaattttggaccattggatatgctttcagattcgtgcagaacccttaaccataactcctctcctcctcccccgttcagatcgcgccgccaccactcctcatcccgtccctcgcgcgattccccgccaccaccccaccgcacctttgcccgcctcgccgactggccggaaagagtcaacggcgccggcgaggacccctggtgagccctctccccttcccctctcccctctcccctctcccccttctcccctctctttcttctcaacaccgcgacggcgaggatgtgaggtgcccccgcctcgctgtcttccccgtatctggtggctccccgccactagatccgcaaccatcgtccaccgcctcctaaccgcacgcttgcttttcccctgccaccaatgccagcccaccgtcatcctccatccccgcggctctggcactgccgccggcgcctcgccgcccgcccgatccgccacccaccgccaggctgccgcctcccacggccctccctctaaagccagtgagctccccctcttctccctccccctcccacccctcccacctccaccacgtcctaggaccctaacccgtagggtcctttgctggagtctagggtgtcgccagcgctggagaagaggaggaggtcaccagagtcagaggagaaggcctggagcacgaatcgcgcagctcatccgatggtccaaaatctgtaagatttggggatatattttttgtcgacagaaggttagcaattccgttataattaactaaagtagaataatctaaaagattgtgagggtatatctgattttgcaattaagtgagataaaataaacttaaattatggaaggagtcggtttccactagttttaaaaggagttttttttagaaatagtacaactttaatggaaaattagagtgaattgcactttgggccatgttttattaccaaagtttcactttggaccaccctgtacgtaatcttttcgctttggactaggtaactttgcctttgttgcacagtgaactaccctaactcttttcgcttgtgatgtctagcgtctctttagacaaaagtatgtcatgcatataggtatgaaagtttgctggcatgccgttaacaatttgctcgaagttatcgaagaaatgaaaatgtgttttggggtggtccattgtgcactagtccaaagtgaaaagattagataaagggtggtacaaagtgaaactttggcaataaaatatggcccaaagtgaaattatctcggaaaattataaaagtaaatgctggttgataaaattacaaatttagcatcttgtcaaacaagcattgttcaataagcatacctgtcaaacaacagcttgggccgttcgacaggttagttagcttgatttacccccctaaactcgaaaatcggacatttgacaccctaaactcttaagaccggacaaattaccaccctaacatggttcgaagcggttttcagcctacgtggcacacacgtggcgatacagtcagcaaagataaataaaaaacaagtgggacccacttgtcagcgtttttttcccttcccttctctgcctctctctctcgattcgcagagaagagagcacacggctacggcgaacgtgacgcgctctgcctccgcctccaccaccgaccgcccgaactcgccgcctccatcgccggttgcccgagcttgctctgtgttcgccggcggatgtggttggacggccacgatgccaacgaccaggacgacggaccgttcgccgcctccacctcgtgaacaagagaagcagagaagggaaggggaaaaattgccggcttccccgacgacctctgcctcgccggcccgcatggcgtgttttgtgacgacgacgacgatgatggcaacgcgtcccatgttgtcagcatctcgctcggctacgtctctgacttctctgccaacccgagctgcgcgggcgccctccgcctccgtcaccgccacactcctcacgtccggcctcctcgccgcctccttcccgcgcctatgcagcctcttcgtctacgactgcttcgttggcgacgataacacgcgaccgctcccgccgctcaagtggcagctccctcccacgcttcagtccaggacctcgtgctcgtcaataaccccacgctctccggccgcctcgccatctccaccgctagcctcccgctcctccgccgaacgcggaggcggagggcggagctgggaggcgagtggcggtgcgcatggctaggtcgctccggccggcggcgagcagctgaagcatctaggcccccgttgtgaattttggtaattaatgacaagcgctaattgtggactaaccgttatctttgagatattcattgtgagttaggttcacttattatgtacgcatggatgatcaccgaaggattaaaattgacggcgcaaagcgaaggaaaagaagacggtaaaactagtgctttagttttaaattgatcgaggtgtaaggcgatcaaatttgctagtttatctttagcttcgccgtactattaagaggggtaatgacctagcaaagagatgattttaattgccacattaggtcatttgcatgtagacttgtgctcacattttatcacacacacacacacatatgtattcactgtgtctcggcctgaccaggggcggtcagaccggccacatagtggcggtctgaccagagtgccctggccggtctgaccggccccaagtgcgcggtctgaccggtgcataaggccagtctgaccggaggcacttgtgcggtcagaccggccccctggaggccgggatggtgttgctcggggtggccgatacaaagccgacggagtggtattcggtcagaccgagctaacggcggtctgaccgagccgaggccggtctgaccggccactcaacgtcggtctaaccggccaggccgatggggccctctgatagggctacaacagctagttttctagccgttgcagagtagcacggtctgaccggccacatacctccggtcagaccggcggcacacagagttgggggatttcgcccccaacggttagttttggttggtgggagtataaatactccccctccagcatcaagggggctttcttggcacccaattcaattgcatacaccccttgcatctctcatacacccacttgagctttgtgttcttccatctaagtgtttgagggttgttctagccaagagtcaagtgcatttgcttccattgtagagctagtgtggcacttgatcatctccgagccgcgtcattgcttgttactcttggaggttgccgcctcctagacggcttgtgaaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttacccaccccttgacgaagggggcgtgcggtggctttgtggttgagcggtggagttgggctcgcctcaacggggagtaggaaactggcgagtttccgaacctcggtgaaaaatctcttgtctccttgtgtcatttgattgtcgtatttacatttgtgcaattacattcctagagacatacttgagatcatatcaccctaggattgcaaaacattgacataggagtgtaatttactttcctagagaattaattgagccactatcaccataggtttgcaaaacataacctagttgcttagttagacttaaccctcaccgagcctagaaacttaggttagttttgattaagtgtcatttaggtttttaaatcgcctattcacccccccctctagtcgacatctcgatcctacagcagcggcgggcgcgacggccggggagaggaaatcgttggcgcggctgtgtggctccggttgacggcgacgacggttgatggggatgacatggatggacggcgaactcgtcgccgtagcgcaccgcctccgatgccctcctcggcgcctcccaccatgccctccacgctacgcgcgccactcgccgcgccaccccgaggatgattcatcgccggccgcctgcctgagcagagagagagagagagagagagagagtgggagggagggagggaggccgtgcatcccgctgactccccgtcggaaccgagaagaggctccgcacctctctccgccgcctccaacaccctcctggcctcctcggcatcgcccgttgcctgccacgtcctccctgcgttctgccgccagcccgcgcgcgccgaccacccgtccgccccagcacgccgccgcccgccgctcatcaccggcccccgcgcaccgactacccgtccgcctccacgcgcctccactcaccgtgctgcacgctctgagcccgagagaggggaaaaggatgaggaagaggggaagataaggtatgataggcgggtcccactattttttaaaaaataaaatgctgactggattgccacgtgtacgccacgtaggacaaaaccgctctagattcggtcgaagggggtaatttgtccggtattgaaagttcagggtgagcaatgtctggttttcgagtttaggggggtaaatcatacaaccgcgatagttcagggaggtaattcgtactttttactttttaaaaaagaaaatagtacatgtgcatgtgcagcctaccgaactccacaacccactcgatgcatgtgcatgcatacacatcccaaattcccaatattttaagcccaatcgaacaatctgttcttcgacagtgtgctaaatttgtaattttagacaaccaatatctaattttacaattttcgttaaatttgtattatttctaaaaaagttcttttaaaagattgtgagggcacatccaattttgcgattaagggagataaaacagacttattccttctcaaataacagtatttccaacggtaaatctaattggagaggcctctccaattagtcttaaccagagacacccacgtgctagtactttaggagttttggttgctattagtatatccaatagtgcatatcttgttttcttcttatagaattttctcttaaactaattatccaatctacaatctgattacaccattactttcgttgcaattaaatatttacaacaagatcttacatgattatattacgatgaaaaatatttatatttataaattacttttattatatacgtaagttacttttatcatatatatataagttacttttatatttgactaaattacttctatacattcataatactctaagttgattatttttattattgtttttagttaattctatattttgtggactttataaatcttctctactttactcgtgaatttactctacatagtttcttatttcagttcactcacaatataattatttctactatagagagttacttcctccgtttcataatgtaagtcattttagcattgcccatattcatatagatgttaatgaatctagacatagttctaaattaaagttactttcttttttgttataaattacttctataatatatgtaaattacttttaagctttactaaatttacttttatatgtctaagaagtaacttagtgaaatctaaaagtaatttagacatatcataaaagtaatttatgatttttcatcaaaatataatcatgtgagatcttgttgtaaagatttaattgttacgaacacaacgatgtaatcggattataaatcgtttgagtaatttaagagaaacttctttaagaagaaaaaatatatagatattgagtgtattagtagctttttttgaaaagaagggtgtctctgtttagtactatccagctagcactctcggtctcagtgtagttgtgtactatttccaaacgtagcacgattagtgtccgaggtgaattggcggatctacggctacgcgacgtgtcacgtgtgcggcactacagccatctgcaaggagcggatatgctctcggattaatctgttttcgtccgtaagtgctacagtttgtgatttgtctgatcatgacaaaggtctacacgcatgtacacctgttcacataatgacacgatcaaaacatgttaagtacgtcccatgtacgatacgactacgatgccaacggcatctttgattgatttgatattagtatatatcaccatcacactatcacaattcacagtcacacaagtcaggcttggagtattgaacaggctctctctagctctacatgtatacaatagtcattcactcattctcactcagccgccacccgccaagatgtcccctcgggtagcccaacgagagaacgagccattgttacttgtactcgtcctcctcatacaaaccttgatcgcgagctcgcttccatgcttgccggaccaggcctacctgaccatcttgcaccgtcttcatctcattttagatctggtctacttcctaactttttcttcaaactttcaactttttcatcatatcaaaactttcatacacacataaactttcaacttttctgtcatatcgtttcaattttaatcaaacttctaattttagcgtgagctaaatacaccctaaagcttagcgtacatggcaggacacgtcctcgaatcttttctgcatcttcgtcaggccaacaaacaagagccacagagaagatgctcctttttccttgacccggagagcaagtttaatagtatagctaactactagctccaattcacctatagtcaatctaatagcttatttatacaatatttatatattacactattaataattggtcccacctgttatgcaaacaccgcgttttgaagtccgtgctacagctggctataaatctgtagcgtgctactcttctctcttcttatttatcttcttaaaatatgtttaaagctaactttgatcctgcaattgtacctgctcggataaattgataatgcggtttaaactttctatgccattgcactctctctgccctaaaatgatcgaccaatgaatttcaacagagacatatccagattcgttgatataggatgaatcatatctcatctaagttaagttattttagggcagagggagtacatctcaagtctaaataatctaagtatagaaaactcatggctacacttattttacgatgaagataactcatggctatacttattttacgatggaggtagtaggtccgtttcgttccagatattcaaacagtctgtacgcaaaaagccattcaacggccgcgacagtacatgggttgaacgttaagcttacgctaccacaccgcgacacgggctcatatttcattttctaaagactagccatgcagtcatcgacaacgacaggactaaaacagaggcgtcatttcacaacagaaaaattcacatgtaaggatcaacggttcaacaccatcttcagaagaaaagaatatgataaaaattaagtttttttatgtaaaataagatgatattaacgtataattaatttaagttttaattattataaacttaaaagatcaactttcatactgaaagttttcgcacaaaacacaccgtttagtagtttaaaaaacgtgccataaaaatcttaatcttcatctaacttttattggagaaaaatgaaggggttccaacactgcatgaacagtgtcattggtttttcttcttgactttaaatgaatgagcttaccttgacttcgcccgccattcccacggagacggagtgaactccacgtccattgatgggttgctttaccagatcgtaggaagcaagatgttatgtaatctcactagccaacatagggtgcgtttagttcacgttaaaattagaagtttgattaaaattgaaatgatgtgacgaaaaagttaaaagtttgtatgtgtaggaaagttttaatatgatagaaaagttaaaagtttgaagaaaaaattgggaactaaatcaggccataggccatagattgtacagaaacaggcctggatgacacgggatgtcaagttttcacacggagaggaatgaaattcgcgatatatatgcatggtcaggagccaggatgtcaagttttcacatgattcagtaagcaagcaccaagtgaactcgcaagatgaactacacgcatagatgcctccacagccacaaactccctcttctcatcctcctcattgccatcgtcgtcatactcatacagccatactccatccatgctgctgccaacagcagcaacaccaccatcagatgcctgacatctcagtcatccgccctcctccagctgaagagctccttccacgacgcgagccgcctctcgtcctggcaaccggacaccgactgctgccgatgggagggcgtcacctgccgcatggcttctgggcatgtcgttgtgctggacctcagtgatggttatcttcagagcaatgggctgcaccctgcactgttcaacctcaccttgctcacaaacctcgccctcagtggcaatgacttcatgggagcacaactcccagattctgggtttgagcggctttcgaaacttgtcagccttgacctctctgcgaccaactttgctggccagatccccattggcattggaaatctgagcaacatgcttgctcttgacttgtctcataaccccaatttgtacctcacggagccaagttttcagaccttcatagcaaacctgagcaatctgagagagctctaccttgatgagatggacctctctagcagcggggcaacttggtcaagcgatgtagcagcttctgctccacagattcagatacttagcttcatgtcatgtggcttgtctggtttcattgatccctccttctcacgactccgttcactgacaatgatcaacgtcagactcaatgtcatcagtggcatggttcctgagttctttgccaacttctctttcttaacaattctggagctatctggcaatgcttttgagggtcagttccccacaaagatcttccaactaaaaaggctgcagtttattgatttatactggaacaataagctttgtgtgcagttgccagaattcctacctggtagtcgtctggaagtgttggatctcatattgaccaaccgttctaacgccataccagcatcagtggtcaatctcaagtatctaaagcatttgggccttacaacagtagaggcttcaatgaattctgatatccttttgatcagagaactccactggctggaagttctccggctctatggaggatcaggacaagggaagctggtgtcgttctcttggataggcagccttaaacatttgacatacctggagcttggcaattacaacttctctggattgatgccctcttcgattatcaatcttacaaatctgacaagtttaacgctctacaattgcagcatgtctgggcccataccttcttggattgggaacttgatccaactcaataatttgaacttcagaaacaacaacctcaatggtgagatccctacaagaatttgaaatctcaatcatagctcaacagtttctaatggtacagtagtacagtacaggtggtaatactgaatagaacctactccttactttaaaaggttattgatgttttagtattttgccgcattgactaggaaatgccctagatcacaagtaacttaaaaattagcttctactccagtgagtccagtccatttgcactgctacttttatttatatttataagagagcctacaaattatagcttgttgactataactagatgtgtatgcaggaacaattccaaagtccatcttcgcacttcctgcgttgcaatcactatatctagattctaatcaactttctggtcatttagaagacatccctgttccattatcttcatctgtgtatgacattgatttaagcaacaattggcttcatggccccattcccaaatcatttttctgtcttccaaatcttgagtatctcaatcttgagtcaaatcacttgaccggcatagtggaacttaggcctttctggagactaagaagcctttattttctgggtttctctaacaataagctgtcggtgattgatggagaagattctccatctcaatatctccctaagattcagcacctaggactagcatgttgcaacctcacaaaacttccaagaattctgagacatctatatgacattcttgagctagacctttcaagtaataagattggtggagttataccaggatggatatgggagatttggaaggacacccttggatcattggacctctcgaacaatgcatttactagcctggagaactctccctctcttgttacatttacacatctaagccatctaaatctcagtttcaatagacttcaaggagaaatacccataccagccatatcattgccttatggtgtagttgtattggattactcaaacaatgggttctcttccatactacgtacatttggtaggtatcttaacaaagtagcctatattaacttgtccaaaaacaaactaaaaggctatgtacccatttccatttgtagtatgaagaaactccaattcctgtacttatctgataacaactttagtggtttcgttccatcttgtctggtagaaggcagaagcttaagggtactgaatttgagggggaataaattcaacgggatgttgcctaagggcattaaagaaggatgtaagcttgagactatagatttgaacagcaaccaaattgaagggaggctgcccagaacactatcaaactgcaaaagtctggaactcctcgatgttagtaacaatcacatcctcgatctgttccctttgtggctggggaatcttcccaagcttcgagttcttgtactgagatcaaaccaattatatggcacaattaagggtctccataatagtgatctaacaagggatcacttctcaagcttgcaaatacttgatttagccaataacactctatctggtcagttgcccccaaaatggtttgagaaactgaaatcaatgatggcaaatgtcgatgatggacaagttttggagcaccaaacaaacttttcacaaggatttatctatcgagacatcatcactatcacatacaaagggtttgatatgacattcaatagaatgctaactacctttaaagcaattgatttctcaaataactcatttgttggagttattcctggaacgatagggagtcttgtttcacttcatggacttaacatgtcacataataatttcactggagcaatcccgcaacagcttggtaacttggctcagctagagtccttggatctctcttggaaccagctctcaggggtaataccacatgagttaacatttctaacttctctttcttggctgaatctttcgaataacaacttgactggaagaataccacagagcaaccagttcttgtcgttttccaacagttcatttgaaggtaatttgggcctctgtggaaggccactatccaaagattgtgatagttctggttcaataactccaaatacagaagcttcttcagaagacagcagtttgtggcaagataaagtaggggtcatcctaatgtttgtctttgctggcttggggtttgtggttggctttatgctgacaatcatatttcaactggtttgccaggtcaaagggggaacctactgtatttgttagaaatatcactgaatctactttgctttggctttggaaaatagtgtagttattacttaaaagcagtttgccccgtcactgtgtgtccttacctaaaataatagcgtgaacttagaaatgaccttatttcccaggtatcacttatgagtgctatataaaatgcttgttgaaattaaggtctgggtttcttgtagatgttacttattaaaagaatgttatggttttcttaattggtaaatgagtccaacaaagaattagaacttatgaaaacagtaaactgttactgggtaccaatcagagcagccagttaaattttgtaatgtccaaactacaacaatttttttaagaaatagcacaatctccaagtgagctctcatacaccttgcatactgtttttctacagagcaaactagtcagctaaacttttatagttttatctcacatccacagaagctattagtttccagtttcttattttccctttttatggcttcatagaagaaattaacaggcattctaaatatgatccagtgttatgaattccatttaataaaaacagaagccaaaagtccaagctgggctcgtctaagaacaatgcaaaatcaaggccgaaaataggctgaaaaacaaaaggatctaccaagcaccaagtactccctttgtccaaagaaaaggtgtatcttgccttgtacatgacaattgagacattgaaaatgactagaatagctacaattattatctctagtgactatatctattgcattcatgaatggaaaaggtaaagctggatggttactaggggaataattggaatatgaaatacatcctatatctttgtgcatggtcattggaaagtatgcctgatattttggaggaatggtataactctaaaaatattgattttattgtatgatcaataaaagagctatatgtcatatttgtccgtgaagttccttatgatttctcagaaagattgacaatgacctaatagaagacaacattttcagtattagagataaactattttcttataggccaaatgcagtgagaattgaaatagacatgtgcgtgttagcatgtaggcgatgataccaacagaaagtgacccaagagttcgtcattgtaggtgctgaacaatcacatatgcaagtaaactgccattcctaataccacggcatcaaacatccagtaagagctcgttttcgatagatgctaagcacaatcaacaatggaagagtattctaggaatcctaaacccaaatactgcaccgcatacaccaaatttggaaaatgaaacgcttcaggtgctctcacctgtacattgcagccgctgagaggcgcatttcctcgaacacgtggtggtaggagaggacgacgagaccgatggcaataggatgaactgcgcgcatttccttggacatgtccatggccatggagaccccgttaattgccgactgcgacgatctggaaccttggataccatctctctccctcgtcgcctcctcaatctcacccctctaccaccacacgcccccattccgccgagtacttcgagtgggatgaggtggagtagaaggatgacgaggagtggaagtactccagggcgcggcatgcgcttcagccacggcgtacaggagagggagatcgccccgagctcgccacgaggatggccgggagagaccccgcccgcctgcagccaataccgcctccaaccgccgctgcacatcttcactttctctcaattcggaggcgtcgcagagaggcaaagcaaccggaggcgtacatggccgcctcgcgtctggtcatctggtgttgtaaacggcggcgccggccatcctcgtcgtcgccgggcaacatcctgccctacgcctccccgtcgaagtagttttttttttcaagggcttttgaggccccaatttccattgacagagatgagatagtatcatagtaaagctagtactcccttcgtaaaaaaaaaaaaaaaaagaaaaatcctgggtttctgtgtgcaacgtttgaccgtccgtttcattttaaaaaattatgaaaaaaattaaaaagataagtcaagcataaagtattaatcatgttttatcatctaacaataatgaaaatactagttataaaaaaaattcatatgagacggacagtcaaacgttggacacaaaaatctaagatttgtctttttttaagacggagggagtacaagattcttaaaggaaacaaaaggactaagcgcctgttcaccattttcaaccatactaattttttttaattaagttgtcaaaaaaatatctacgtttaattgttaccatatttggtaaatacataagaaatcatgtcaaaattttggcaatattaccatcttgcctttggtaaggtttactttggctacaatctaaacaggctctaaagaaaacaaaagatccagaatttcaacgcagcaacctcaagaaaaaaggggaactcggtctaagggcaacctcaagaataaaggagaactcggtctaagggcatctacaatcagaacactctaagactaccctcactaactgagagtactctctgggaaaccccccctcacaatgaaagataccctagtagcctaacgagtgcccctagcccaaaaagcccacgtaggtattttactatactacccctctgttctccccccccccctctctcttctcatttaccggcgcgcctcctcccctccgccgctcacctctctctccttctccctctcgttgccgccgctcgccggagactcgaggcgtgctcggcgatggcgcggtccttggccgcggcggcctcgtcggaccgggagcggcgtcatggtgcgtcacaggagcagcgggagcgacggcgaggacgacgaggagggccgcctctcctgttgccggcgtccaccaccgcccctctctcttcctctctctcccgtcggcgtcctccccggcatcctccgcctcgcgtcgtggtcagtcgggagcgccagatccggcgccgtagtgggtggatctaggccccccgtggcgccggcggtggcgggcaaggcaccggcggaggaggccgggcaaggcgcgcgaggcggcgagcacaggcgcctcaagccatctccgcccgtcgctagctggtggtcgatggctaccgcggcgcgcggtggccggatccggtcgtcgccgatccatcgtcatcaccgtcgcctctctcttctctctctctctaaggccgacggtggcggtcccggcggtggtaggcgcggcgccagcggtgtcgggcgcggcgcgacgagaccaaggggagagcgagagagacaagggtgtaaggggaaatttggggggacgacgccgtgcccacgagctccacacgcgcacaacgcggcgcctggctgcgtcttcccacgaaaagctagtgaggcacagagagagccgcatcccccagcagagggacgcgttccatcgcaggggacgacaccgatgaaaaaggggatgtccgtcgctaggggcacgggctgaagcaccgcattggtgatggcctaaggcaacacaaaaaatctgcagactttcgacaaaactatgttgccatcggaactaaggctgtgttcgggaaccctcattccccgtcatgcaaaacgaagcagcatttagcatgattaattaagttttagctaattttttttcaaaactgaattaatatgatttttaagcaactttcgtatggaaactttttgcaaaaaacacaccatttagtagtttgaaaaacgtgcacgcggaaaacgaggaggagaagttgggaacatgtcccaccgaacgcagcctctacatcccaccctaaaatttttcaccctgtcacatcgaacgtttaaacacctgcatgaagtattaaatataggctaaaaaataactaattgcacagattatgactaatttgcaagatgaatcttttaagcctaattgctctgtgatttgacaatatagtgctacagtaaacatttgctaataacggattaattaggcttaataaattcgtctcgcggtttactaacggattttgtaattagtttttttttattgcccgaataccccatgcgacaccctatataacacctgatgtgacatgccaaaactttacacctcttaatctaaacaccccctaacttgcaacaaaagcctaaaaccaaaaggatccagtcatccagaacatcagcaaccgtcgtctttaagcaaagaaccaaggagcatttacaatgcagtgcaaaagtagtttataagcaataaaacattacatttagccacctacaaccattgtgcaactggtccatataaaaaaaataacaaaagatacttgtatgcatatggactacccatatggaataaataatattatctatctcgacttctctctcttctcttaatgatatcttgtatttatacattatgaggattgctatatgtaaagtttatttatatagatctcagctatacagatattggttgataaaaatcacaaatttagcattatatcaaacaaccattgtttgacagacataaatttatacctgacgaacaacagccattcgacaggttaggtggcttgattataaaaaaagagagcaagcaagtactatgctgcaggtctatattgatggaaaacacgaggcctaggagatctgcttaactccagtgcaggtctaaaactcgccttcgggtatgctagcgtgccagttgatttgatcctgcaatcaacaagaaatagaaacaaagaagccgtggttaaacccataaatgatagccgatcggctaagtgccgatgacatatcatttatctttgagccgatgtcatataagcattgatcggcagtcattgataagtaaaaaagaactaaatctacccgatcggctgtagatattaacaatatataatccttatgtcgatatatacttaaatcaagtgattgggatagatcggtcgccatgccgatacagtataaatcacttaaatcgaaatatatattaacaacaaaattatatatgttcatagcatagccgatcagatagatctagcatgcatcggctaatactccaataccgctcaatattaagatattaaagcaagtagaacataccaagcagaagcctaatatacttaaaagcaacaagatcttaacataaagggcagatttaacatgtcgatcaagcatatagaataactatagttaaatcaggtaagatcggctgaaaccccgatgctatcctaatcggcaaccggaagacaggctagagattgaaattctaagcacgatttaatagatcaaactcaactgttgcaacattaagtatgaaaaaaagaacaatatctagacaatcaagtcgttggatgtttcatagagtggtggatatcttatataatccaagctaacgtcgctatttaacctaatcggccgccttctattaacagatgttagccgattgtaggttagatgacgatattaccgaagattatgtaagatatatgataactcgataaattacataaacaagattagagtgtcataaagatggaagcactaatcccgagaacgcaagccgtcataacaagttttacctcttgttgaagatcgaaaccgatacagctcaacccgaaagcaagaactcgtcgaaataaaacgaaagcaaaaagagtggcgatgtgccgagattgtattgaacgtatgttgtttgattacatggggttcgggtctatttatacccgagaattacaaaatatgtccataccggacacgactcttatctctaacaaactctaagatatcataagtctttgcggcagacttttgcccaaatatatctctaaggaaattacataaaatatcctaattaatagatacaattgccttctcaggactctatccatgcgtggcaatcatcttgaagcatatcaacccaacctgatgttgtacaccaagtcgtattatcgaaatcggctgcattacctaaccaagtctgactcgaacttagccgatccaatcgtagccgatccggactccagccaattcttgctctgttcccgcgacaatcctcatcttagattccgcttcgatctaatctccctttccgatgctgatattatcaaatttggtcgttaacaatctcacaacccactcacatgtatgcacacacatcccaaattcccaattttttaagcttggtcgaacaacctggtgttctataaggtgctaaatttgtgatttcagacaaccacttacaattttcattaaatttgtattatttctaaaaaaagttcttttaaaagattgtgagggcacatccattttgcgattaagggagataaaagtagactattccttctcaaataacagtatttccaaacgtagcacgattagtgtccgaggtgaattgacgaatctacggatacgcgacgtgtcacgtgtgcggcactacagccatctgcaaggagcggatatgctctcggattaatctgttttcgtccataagtgctacagtttgtgatttgtctgatcatgacaaaggtctacacgcatgtacacctgttcacataatgacacgatcaaaatctgttaagtacgtcccacgtacgatacgactacgatgccaacggcatctttgattatttgcatttgcattgacttgatatagtatgtcaccatcacactatcacaattcagtcatacaagtcaggcttggagtactgaacaggctctctctagctctacatgtataaaaaaaaatcagtttcaagcatcatacaatatagtcattcattcagctgccacccgccaagatgtcacctcgggtagcccaacgagagtacgagccgttgttacttgtactcctcctcctactacaaaccttgatcgcgagctcgcttccatgcttgccggaccaggcggcggcgctgctccagctgaagcgatcgttctcggcgaccaccgcgtccgccaccgcgttccggtcatggcgcgccggcaccgactgctgccgctgggcgggcgtccgctgcgacggcggccgcgtcactttcctcgatctaggcggccgacgcctgcagagcggcggccttgacgccgccgtcttcagcctcacgtcgctgaggtatctcaacctcggcggcaacgacttcaacgcgtcacagctcccggccaccggattcgagaggctcactgagctcacccatctcaacatctccccacccagcttcgcaggccagataccagcaggtattggaagcctcaccaacttggtttctcttgatctgtcatctagcatctacatcgtcaatcaaggagatgacgatgtcagtatcatgtcaaatttgttacccccctggggcttctcgagggtaaacttcgagaagttgattgcaaatcttggtaatctgagggagctctatcttggattggtgtacatgtccaacggaggcgaagggtggtgcaatgctctggctaattccactcctaagattcaggttctgagcctaccattatgccagatctctggtcccatttgccaatctctgtttagtttgcgatccctttctgttgttgacttgcaaggaaatgacctgtctggtgccatacctgaattcttcgctgatttgtcatcccttagtgttcttcagctttcaagaaataagtttgagggtttgtttccacaaaggatcttccagaacagaaaactgacagctattgatattagctacaactatgaagtttatggtgatttgcccaattttccacctaatagcagtttgatcaaattgcatgtcagtggcaccaagttctcaggttacataccaagctctatttctaatctcacggatctgaaggagctgagtctgagtgcaaataatttccctacagaactgccgtcttctctaggaatgcttaaatccttgaacttatttgaggtttcggggctcggcctagtaggatcaatgccagcttggataacaaatctaacatctttgacagatctccaaatttctcattgtggtttgtctggatctttaccatcttccataggcaatctcaagaatctcagaagaatgtctttattcaagagcaacttcactggaaacataccattgcaaatctttaacttgacacaactgcatagcttgcatcttccactaaacaacttcgtggggacagtggaacttacctcattctggagactaccatacttatcacaccttgatctttcaaataataaattatctgtggtggacgggttagtcaatgattcagcagtgtcctctcccaaagtaaaattcttgagcctagcttcctgcaacatatcaaagtttcccaatgcattaagacatcaagataagataatcttccttgacctttcaaataaccaaatgaatggggcaatacctccatgggcatgggaaacttggaaagaatcgttcttcttggacctatcaaataacaaatttaccagtcttggacatgacacgttgctccccctgtacacaagatatatcaatctcagttataatatgtttgaaggacccatacctatacctaaagagagtacagactctcagttggattactcgaataatcggttttcttctatgccgtttgatctaattccatatcttgctggtacactatctctaaaggtctctatgaacaatgtctctggagaagtcccatcaacattttgtactgttaagagtctccaaatccttgacctttcctacaatatcttaaatggctcaattccttcctgtctgatggagaattcatcaacactaaaaatattaaatttgaggggaaatgaacttcgcggagagttgccacataatatgaaggaagactgtgcatttgaggcattggatgtcagctataattggattgaagggacactacctaaatcattagtaacttgcaaaaacttggtggtacttaatgttgcgaacaatcaaattggaggctcttttccatgttggatgcatcttcttcctaaactccaagtccttgtcctgaagtccaataagttctacgggccgttggggcctactcttgctaaagatgatgaatgtgaactacagtatctccgaattcttgatctagcttcaaacaacttctcgggagtattgccttatgaatggtttaggaaactaaaatccatgatgtcagtctccattaacgaaacattggtcatgaaagatggagatatgtacagcacatttaaccatataacatatctttttactgctagatttacatataaaggactggacatgatgtttcctaagatcttaaagacctttgtactaattgatgtctcaaataatagattccatggcagcattcctgaaactattgccacactaagcatgctcaatggtctcaacatgtcacataatgctcttacaggaccaattcccaaccagcttgctagtctgcatcaacttgagtctttggacctctcatcaaataagctttctggggagatccctcaaaaattagcatccttggacttcctatcaacattgaacctatccgataatatgctggagggaagaataccggagtcacctcatttcttgacactccccaatagttcatttatacgaaatgctggtttgtgtgggcctccattgtcgaaagaatgcagcaacaaatcaacatcaaatgtgatgccacacctttccgaagagaaatctgcagacattatactatttctctttgttggattgggttttggtgttgggtttgctattgcaattgtagtgaggaaaccttgcattggcaaataatcttcatcaaatccacccatttttatatttatatgttcaggagtttgccagtctgcttccccttgtaaatttagctgtcattatagttagcctgtatgatttatagtactatgtgcacgtacaacatttttttccatcatcatgcatcctataagattagtattgaaaattttatacaagccaacagaaaattgttatgtctgaaccaagaaaggaatagaaatgcatgaccacaaatgtggcattattagggtcagtttaacttgtagcatagatcagtgagctatatgccgtgattttgtgtttgaaatgtatacttacacagaacttacttaagtaccaaacaaccatactggaacacaaaatttctgtgtgaagaactgaagatcacttaattatgtgttggaataaaactttctgtgaaaagatcacttgcaatacaattgtaatcagcgttatactgataatgttactagtagtagtcacactaatactaacctgaatcttgtatatgcaccaaattaggtagtaagaaatatatatatgaactaactaaatgaggtcatccaagaacaatgcacaagcaaggcttaaaataaatggaaacaagaaagcaatgttaaatttacccgactgtttattaagtatcacctctacatctatacctaaaattaaaacggtgtcatatatcaggtcgcacattgaactgctagattcctaataggctaataccacagcagcagcagcagcagcagcaataagctgcatacgtaattccgtagaatcgtagtaattccaaaatcggttcataatattcgagaaatactggatttcacacacaaacctgtgcaattcagccgatgaacacggaaggaccattccatcaaacacctggcggacgacaagagcccgccgatgcaaacctcctgggagtgggacatggacatccccattgtgaccgcattggttgtcagctggtcacccaccccacttgggctcccaaatcccatgacggccaccttgtgctcaacgcctcaacccggtgcccgtgcccccattccggtggcggtggttggggattccggtgtacagcctgcggtggggatgggattgggagttcgccgagtcctccgagtgggatgcacgcggaggagaggacgacgtgaggaggggctcgcaagtggcggcggcggcggcgcaacccctccacgacggcgtgcgggcgcctgcgccgcatatggacatatggtgtacatcgaaattacagattttgtatgggcctcagacatctggcccaacaagggtccgactcattcgctaatttctgaaatacgtactccgtcggaccaataatacctgtcgtttgggcaatggtaaggttaaactttagaatctttaattatgtatcatttttaaaatatttgtctcttaaatatgatgactacattatagattcgtcttaaaaagtattttaataagatcatatatttgttaacacctttttacatattataatagaaaataatgatcaaagttgtttttttataccgtgtccttattcaaaacgacaagtattatcaatcgtagggagtaacctctattatctgaacaagcaaattgttacgtacgtattcaaaatttaaaatttaatgcatggttaaatttatcatggtgttctaaactagttagtggtttttaatttctcgtatatattacgatgcttgtaacaacaaatccataattatagaaaattacattcaaatgatcagttcaacggtattacttttatcaaacaaaatttaaattatattagatttatggtttgtcagatattactagggttgaattaatatgtgtgcacacattgtattttttttttgggaaagatggtacaaatgattgactgagaaaccacaacaagttttcttaatcgaaaattacatcaagtttcatttgcggcaaactaataaaatcataagaaatatgaaaaactatcacacgagcaacagcaattaaaacagaaacacaaaagaaccacgtatacactgtccaagtagaattccatgcctcccgaattgatgaaacgcgcaagctcgcaagtgtaagtgtcacaaatgcacgcacatttatcgggtgcctagtgcttaggagggcacatcaccggccggaaagcgagcgggccagtggcatacatgacattatagtagtcatggtcggaccaccgcttgccctcgtcacggagtggcgcaccctcaatgctagagtagttgatgtttgtggggttgttgcattcgaaatccggcgaggcatgaagacgcacatagcacgccttacgcggatcacccatgtagaagtcggagactttagtctcatcgagctccgcgcggaagtagccattatcgtcggcgacggcctgatggcacctcaccattgcgcgattcttggcgtcgtggcatatgacagacacctccgccttagacagcggcttcgcgtcttcgaggctgtgtgtttctttgcacgcagctctggcagtacaccataccctccaacctcaccaacagcttgtcgctgtgggccggaggggtgtactgctgcggcggcggtggcggcgatggtgatggtgtggtgtaaccataatttgcggtggcgccggcggccaggagggacacgaacacgaggatcgcgagaggatgcagggcagccattgctctgagctagcttgctgtgctccgtgctcgactgatgagatgttttgttttgaagctttggctatgtcgaaacgaagaggcgtgtgggttatatactgcatgccatgtactaacgtgcggacatgtagatggaaattaactgtcttgattttggatgaagatcacattttattttttgttattcgattctgacaatatataatgattagcccgcgaaagaaatgctagcatgtaatcattgatctgtaaggcaatttgaatagaagaaatcgcatgctcatgatctgcctggtgattagttaagagttcgtagtattcaggaggaagatacgcaggtttgtcggaacgtgcagcccttaacggcactgaaataccaggttctccaccctggcagatgatttttgccgatagagctacaatatttatgtcagtactctgaaaaggagtagggcatgtcatttcctactcctaccgtcccataaaaaacgaatttaggacgggatgttacatattctattatgatgaatctggacatatatatatatatatatatatatatatatatatatatatatatatatatatataagattcatagtactagaaagtgtcatatccggtactagattggttttttatgggatggagggagtatgtaaaatatatgcaaattttgctacaggacattgcgactttgtggttttagctataggacaccacgtaaagtgacttttgggagaagacactatgtaaatatggttatttaccacgagacaccgtatccattaaattagtatttttgtgctgacgaggctagaaggggcccactttgttaaacatcatgaccgaattgcccctcttcatcttcctcttcctctcctctcttcccctctctctccctcctttctctcttctctcttctccggcgaggcattcaacccgcaagcggcggcgcgaccaccagagctgcagcggcgcggggaaccactcctcacggcgccacccaaacgtgaactgcaggtacgccgcgagcagcagccatgccacagcgcgcaccgccccgacaacggcctctagtggtatgttcccggtggcgaggaacaccgcgatgtcgctgagctcaacatggaggtacgagaatgagccaccggcggatgggatctccgtggtgagcggaggaccgagggcaccagatccaacgcccccgttgagctcagaccatggagagaggggcatgcgacgatggtgggggagggggagcagcggagagaaggcaacagaggaggagcggcatcgccagtcatgagagtggaggggagggggagaggcgccgccgggagggagggggaggtggagctcgtggtggggggtgggaggggaaagtgtgattagggttagggttataggcagcaacggttttgatggatttagaatcgatccgagtcatccatcaaaacgagtggcttagatcgatcctgtgtcgggccggcctccatctcgggccacaacactgttgggccacgcgctcttcatgggccggacgcgcaatagcaggccgatagggtccaatgggttttttttttccttttttagaacctttttatttgtaagcaatatattttttatgggctcgtaatatgaaaaactaaaacctaattaatcatctaatattttatatttgctataattttagtttactcgtagcaacgcactggcatcttttctaacaaaatttaatttatattagatttatggttcgtcagatattactaggattgaattaatatgtatgcacaccttgtattttttttttggaaagagggtacaaatgattgattgaaaaccacaacaagtttatttaatcgaaaattacatcaaatttgatttgcagcaaactaataaaatcataaaaaatttaaaaaattatcacaccagcaacaacaattaaaacagaaacacaaaagaaccacgtatccaccgtccaattataattccttgcctcccgaattgatgaaacgcgcaagcgtgcaagtgtaagtgtcacaaatgcagacacatttatagggtgcctagtgcttaggagggcagattgccggccgaaaagcgagcgggccggcagcgtacataatattataatattatagtagtcatggtcggcccactgcttgccctcgtcacgtagcggtgctccctcgatgctagagtagttgatgtttgtggggttgttgcattcggagtctggtgaggcccgaagccgcacatagcacgccttgcgtggatcacccatgtagaagtcggagacattggtttcatcgagctccgcacggaagtagccgttatcgtcggcgacggcccgacgacacctcacgatggcgcgattcttggcgtcgtggcagatgacggacacctccgccttaggcagcgatttcgcgccttcgaggctgtgtgtgttcctttgcgcgcagctctggcagtacaccataccctccaccttcaccagcagcttgtcgctgtgggccggcggggtgtactgctgccgcggcggtggtggcggcgatggtgatggtgtggtgtagccatagtttgccgtggcgccggtggccatgagggacacgaacacgaggatcgcgagaggaaggaagtcagccattgctctgagctagcttgctgtgctccgtactcgactgatgagatgttttgttttgaagctttggctgtgtcgaaacgtagagaggcgtgtgggttatatactgcatgccatggactaaatgtgaggacatgtagatggaaattaaacttgattttggattaagatcacattttattttttgttattcgattctgacaatatataatgattagcccggcgaaagaaatgatagcatgtaacgattgatctgcatggcacttttaagagaagaaatcacatgctcatgatccgcttggtgattagttaagaatttgtagactataaagtatattcaggatgaagatatatatgcagatttgccagaacgtgctgcccgtgtctgtacctaacggcactgcaataccatgttgggcagatgatttttttgccgatagggctacccctactacgaaagtgatttttgcacacggcccaaaagagattttcgtgtgcagtagggtagcccgctcgcactaaaagatctacgaaaatagctatttttgcgtgcaggagtttgagagaaagtgagagagtagtatgtggagaagaggaggtgagagagaggagagatgataaggatgacttagaaaaaaaattaagtgctaggagggaaaagagaaggtaactcgaacttccgggcggacctttaagatggccgtctgcgaaaatatattttcccgtgcagccccttaagaggtccatatggaaaaataatcttattttcctgtgcagctacttaatagggtcgtctgcgaaaatgttagtcgatttttgtagacacggatacttatggtccgtctgcaatatattgaggagctcatccagaaaaatcattttttatggtgattatttatatcagtagctacattattctccatacagataggttttgctattttacatgtgatagatttttgggcttctatttttcgatatgttgttcataggattttgcatcaagattcgtgtttatgtagttataacttgcaattacacttatttatgtagtacgtttcatgtagtattaaagtaccatgacgtcttttttcttagcgcctgaaactaacggaaagaaaacgagtgtatttttctcattgttttgtagaaaggagttacataggcgctatgccagctaaaattggaaacaataccaccaagaaatttcgtttgcacttgttttggaagttggaggatgtgttctatctggttttcggtcaagggacgattttgtaattcggtgataagacgagggatctccactgtactttttccacattgaaattacagattttgtatgggcctcaaacttttggcccaacaagggtccgactcattcgccaatttttgaaatacgtaacctctggtatctattttttagataatggattttcattaatccggcctctatatccacgatggatatagacagctaaaatgatataagagcacttaaactcaaatctcaataaagaggagaacacacaaccaaaaaacaaaaaacctacaacctcgacacatccctgcatcccgacattctctcctgaaatagtcaaaatcgatgagtggaagtcgtttagtcacaaccgcccctagtacgttgtcgctgcgaatctccactggtgccttcttcatctgcttcaagtgaaccgatgccacgcaccaccgagtagtccaccttcatccatcgtcgtctagtcagaactagccaactagacacgggctgaaaggatctgcttcaccggattcctaagcctctgccgcccatagggccgctgccaacgtcggaatccttctccgcctctccgattcccagcccactaccacctctgccaacgtcctttgccgtggtcagagaggacatcatcttccgcccggactccaaggcctccgccgccccaagggctgccatcgccgattggatccaccttcacctgaaccatctgcatcggtgattacgccgccactgcctctagggctgcagctgccgcaaccgaggaggtcattgcttggactcgcacaccgccgctgcccctagggtcgcccgctagctacgaaaccaccttcgccggaaccgccttctccttgccgaggaccggacatcaacgcttacgtcgccgttctccacagcatccaccgtcgcccaaagaatcgtgtcgccgacgtcttgccgacccgccgccgcactgcctcccgacccctccactgctgcgcgcaaggtgcggttcggccaacgccgctcgccaactcgcgcgcctccgtacctccggaccacctccgcagccgcgctcggcccggccggccaccgccgcccacggccccgtcaccttccacgccaccagattttgggggccggaaccccagactcggtacagccctcagccgcgtcgtggtctccgccgaaaggccccgctgtcgccttcctcactgccgctcggcacgccggcggcctgctcgggcggcggcaaggcgaggagacaaggaagcgagaaggagacgaggaaacgctgtgaggcgagataatctaactaagcaaattacctacgtactcaaaattcaaaatttaaggtatagttaaatttagcatggttttccaaaatatttagtgattttaatttgtcctatatattacgatgcttgtaacaacaaagccataattatagaaaattacattcaaatatcagttcaacagtattatttttatcacataaaatttaatttatattagatttatggttcgtgagttattactagggttgaattaatatgtatgcacaccttgtattttttcgaaagagggtacaaatgattaactgaaaatcacatcaagttttcttaataaaaaattacatcaagtttgatttgcagcaaactaataaaatcataaaaaattacaacacaatcacacaagagcaacaacaattaaaacataacacaaaagaatcacgtatccaccgtccaattagaactccatgcctcctaaattgatgaaacgcgcaagtgtgcaagtgtaagtgtcataaatgcagacacattcatagtgagcctagtgcttaggagggcagatcgctggccgcaaagcaagcgggccggtggcgtacatgaagttatagtagccatggtcggcccaccgcttgccctcgtcacggagcggcgcaccgtcacggagcggcgcaccctcaatgctagagtagttgatgtttgtggggttattgcattcgaagtccggcaacaaccgaagccgcacatagcacgccttgcgcggatcgcccatgtagaagtcggagactttggtctcatcgagctccacgaggaagtagccattatcgttggcgacggcccgacggcacctcaccatgacgcgattgttggcgtcgtggcaaatgacggacacttccgccttaggcagcggcttcacgccttcgaggctgtgtgttcctttgcgcgcagctctggcagtacaccataccctccaccttcaccagcagcttgtcgctgtgggccggcggggtttactgctgctgcggcggcggtggcggtgatggtgatggtgtggtgtagccatagtttgcagtggcgccggcggccaggagggacacgaacatgaggatcgcgagaggatggaaggcagccattgctctgagctagctcgctgtgctcgactgatgagatgttttgttttgaagctttggctgtgtcgaaacgtagagacgtgtgggttatatactgcatgccatggactaaacatgcggacatgtagatggaaattaagcttgattttgattaagatcacagtttattttttgttattcgattctgacaatatataatgattagcccggcgaaagaaatgataacatgtaacgattgatctgtaaggcacttttaagagaagaaatcacatactcatgatctgcttggtgattagttaagaatttgtagactataaagaatattcaggatgaagatatatatgcagatttgtcagaacgtgctgcccgtatatgtccctaacggcactgcaatatggtagggcagcctgctcgcgctaaaaaatctacgaaaatagctatttttgcgtgcaggagtttgagagaaagtgagagagtagtatgtggaggagaggaggtgaaagataggagagatgataaggatgacttgaaaaaaaaaattaagtgctaagagagaaagatgaggtaactcaaacttctgggcgggcctttaatatggccgtctgcgaaaatatattttcccgtgcagccccttaagaaattcgtatagaaaaataatcttattttcctgtgcagcagattaatagggtcgtctgcgaaaatacaagtcaattttcacagacacggatacttatggtccgtctgcaatatattgaggtgctcatccatgaaaatcatttttatagtgattatttatgtcagtagctacattattctccatagagaggcgtgtgggttatatagtgcatgccatggactaacgtgcagacatgtaaatggaaattaagcttgattttggattaagatcacattttatttcttgttattcgattctgacaatgtatgatgattagcccagcgaaagaaatgataacatgtaacgattgatctgtaaggcacttttaagagaagaaatcacatgctcatgatctgcttggtgattagttaagaatttgtagactataattctataaagaatattcaggatgaagatatatatgcagatttgtcagaacgtgctgctcgtgtctgtccctaacggcgcttcaatatcttgttgggcagatgatttccctaatggcctagccgcatgtgaaaataattgctggccgtatgtaaaaacctattatgtagtagtggcagtatgtggagaagaagaggtgagagagaggagagaaggtgaggatggcttgaaaaaaaattgaaatgctaggagggaaaagaggagataacttaaactactggacggacctttaagatgatcgtctgcgaaaatatatttttactactggacggacctttaagatggccgtctgtgaaaatatatttttcctgtgcggcctcttaagatgtccatctataaaaataaccttattttttcgtgcggctgcttaatagaatcatctataaagatatgagtcgatttttgcaaacacggatacttagtccacctgctatctattcaggtggtcatccatgaaaatcatttttaagtagtgattatttatgttggtagctacattactctccatacagataggttttgctattttactcgtgacagatttttgggcttctgtttttttatattttgtttataggattttgcatcaagattcgtgtttatgtaattctaacttccaattacactcatttatttagtacgtttcatgtagtattaaagtaccacgacgtattttttctttgggcctgaaactgacgaaaagaaaacgggtatatttttctcattgtttgcagaaaggagccatataggcgctatgtcggctaaaattgggaacaataccaccgaggaactttgtttgcacttattttgaaagttggaagatgcattgtggatgtgtttagttgaaagttggaagttggcctgtctctggttttttatcgagggatgattttctaattcggtgataaaatgagggatctccgctgtactttttccacatcaaaattacaaattttctatgggcctcagacatctggcccaacaagggtccgactcattcttcaattttcgaaaatacgtaacctctggtatcggactaagcaaattacgtacgtactcaaaattaaaatttaaggtatagttaaatttagcaaggttttccaaatagcaagtgatttttaatttgtcctatatattacgatgcttgtaacaacaaagcctaattatagaaaattacattcaaatctcagttcaacggtattatttttatcaaataaaatttaatttatattagatttattggtcgtgagatataccagggttgaattaatatttatgcataccttgtatttttttggaaagagggtacaaatggttgactgaaaaccacaacaagttttcttaatcgaaaattacatcaactttgatttgcagcaaactaatataatcataaaaaaaattacaacacaatcacacaagggcaacagcaattaaaaaatagaaacacagaagaaccatgtatccaccgtccaattagaactccatgcctcccaaattgatgaagcttcataggaagcctagtgcttaggcgggcagatcgccggccggaaagcgagcgggccggtggcgtacatgacgttatagtagtcatggtcggcccaccgcttgccctcgtcacggagcggcgcaccctcaatgctagagtagttgatgtttgtggggttgttacattcgaagtcctgcgaggcccgaagccgcacatagcacgccttgcgcggatcgcccatgtagaagtcggagactttggtctcatcgagctccgcgagaaagtagccgttatcgttggcgactgcccgatgacacctcaccatgacacgattcttggcgtcgtggcagatgacagacacatccgccttaggcagtggcttcgcgccttcgaggctgtgtgtgtttctttgagcgcagctctggcagtacaccataccctccaccttcaccagcagctttttgctgtgggccggcggggtgtactgctgcggcggcggtggtgatggtgtggtgtagccatagtttgcggtggcgccggcggccaggagggacacaaacacgataaccgcgagaggatggaaggcagccattgctgtgagctagcttgctgtgttccgtactcgactgagatgttctgttttgtagctttggctgtgtccaaacgtagagatgcgtgtggattatatactgtatgccatggactaaacgtgggtacatgtagatggaaattaactgtcttgattttggatgaagatcacattttatttttttttgttatcgattctaagaaatatataatgattagcccgcgtagaaatgctaacatgtaatcattgatctgtaaggcactttgaatagaagaaatcgtatgctcatgatctgccaggtgattagttaaaaattcgtaggcgataaagaatattcaggaggaagatatgcagatttgtcggaacgtgcagcccttaacggcactgaaataccaggttctccacccaggcagatgatttttgccgatagagctacagtatttatgtcagtactctgaaaaggagtatggcatgtcatttcctactcccaccgtcccatctagaacgggacgtgacatattatagacaatgaatgtggatatatgcatgtccagattcgtagtacatactaggatatgtcatatctaatactaagttggttttttatgggatggagggactatgtaaaatataggcaaattttgctacaggacattgcgactttatggttttagctgtaggacaccgcgcaaagtaacttttgagagaagacactatgtaaatgtagttatttgccaccaaacaccacatccattaaattagtatttttgtgctgacgagcctagaaggggcctactttgttaaacatcgtgaccgaattgcccctcttcctcttcctcctcctcctctcctctttcttccttacctctcttcatctctctccctactttctctcttctctcttctccggcgaagcatacgacccacaagcggcggcgtgaccaccagagccgcagcggcacagggaaccactcctcacggcgccacccaagcgtgaactgcaggtacgccgcgagcagcagccatgccattgcgcgcaccaccctgacgacggcctccaacggtatgttcccggcggcgaggaacaccgcgatgtcgctgagctcaacgtggaggtatgagaatgagccaccggcagaggggatctccgtggcgagcagaggactgggggcaccagatccagcgcccccgctgagctcggaccaaggagagagggggcatgcaacgacggtgggggagggggagcagcggagagggggcaacggaggacgagcggtgccgccagtcgtgagagtggatgggagggggaggaggagctcgtggtggggggtgggagaggaaagtgtgattagggttagggttttaggcaccaacggttttgatggatttagaatcgatccgagccgtccatcaaaatgagtggcttagatcgatcctgtgtcgggccggcctccatctcgggccatagcactgttgggccacacgctctttatgggccggacgcgcaatagcaggccgatagggtccaatggggcctttttttctttttttagaacctttttatttgtaagcaacatattttttttatgggctcatatcacgaaaaactaaaccctaatcatctaatatttttatatttgctataattttagtttacccgttggccgttgcaacgcacgggcatcttttctaataaaatttaatttatattagatttatggttcatcagatattactagggttgaattaatatgtatgcacaccttgtttttttttggaaagagggtacaaatgattgactgaaaaccacaacaagttttcttaatcgaaaattatatcaaatttgatttgcagcaagctaataaaaacataaaaaatttacaacacaatcacacaagagcaacagcaattaaaacagaaacacaaaagaaccacgtatccaccgtccaattataattccatgcctcctgaattgatgaaatgcgcaactgtgcaagtgtaagtgttacaaatgcaggcatttttatagggtgcctagtgcttaggagggcagattgccggccggaaagcgagcaggccggcagcgtacatgacgttatagtagtcatggtcggcccaccgcttgccctcgtcacgtagcggtgctccctggatgctagagttgttgatgtttgtggggttattgcattcgaagtccagtgaggtccgaagccgcacatagcacgccttgcgtggatcgcccatgtagaagtcggagactttggtctcatcgagctccgcgcggaagtagccgttttcgtcggtgactgtccgacggcacctcaccatgacgcgattcttggcatcgtggcagatgacggacacctccgccttaggcagcggcttcgcgccttcgaagctgtgtgttcctttgcacgcagctctagtagtacaccatactctccaccctcaccagcagcttgtcgctgtgggccggcggggtatacctgtggcggcagcgggggcggcgatggcgatggtgtggtgtaaccatagtttgcggtggcgccggcggccaggagggacacgaacacgaggatcgcgagaggatggaaggcagccattgctctgagctagcttgctgtgctccgtactcgactgagatgttctgttttgaagcttttgctgtgtccaaacgaattaaattttaaaatatactgtttatccaatttttttcaggaatattcgggataaatttttttttttacaaatataccatcaatctcgcgcaatcgttttacgaaaatgacgtggacatgacgtcaccagcggtatcgcgtgacgaaagcgcgagaccgtgcggtatcacgcggcagtggcgcgagaccgcgcggtctcgcggaagcaaagagcgagtccgctcggtatcgcttgttcaagcagcaacaccggcatggcagtcccggccgtcaatggttaattacctaattaactattaactaataataattagtaattaattatcctgattagtgattaattaattgctaatcaggataattaatcaacaggcatgtcagtgcggtatcgctatttcaatcagcgagaccctttggttccacgagaccgtgcggtctcgcgcagttgttgcgcgagactgtgcgctctcgcgctttcatcgcgcgataccgtccgtgatattacgtccgtgtcattttcgcgtaacgattacgcgagatcgacggtatatttctgtaaaaaagtttgcatctcaactattctttaaaaaaaatgaggaacaatatatttttaaatttaattcatgtccaaacgtagagaggcgtgtgggttatatactgcatggcatggactaaacgtgcggacatgttaaattaagcttgattttggattaagatcacagtttatttttgttattcgattctgacaatatataatataatgattagcccggcggaagaaatgataacatgtaacgattgatctgtaaggcacttttaagagaagaaatcacatgctcatgatctgcttggtgattaattaagaatttgtagactataaagaatattcaggatgaagatatatatatctatatatatctatatatatatatatatatgcagatttgtcagaacgtgctgcccgtgtatgtccctaacggcactgcaataccatgttgagcagatgatttttttgcctatagggctaccactactaagaaagagatttttgcacatgggccaaaagagattttcgcgtacggttggacagcccgctcgcactaaaagatctacgaaaatagctatttttttgtctgggagtttgagagaaagtgagagagtagtatatggaggagaggaggtgagagagagatgataaggatgacatgaaaaaaaaattgaagtgctaggagggaaaagaggaggtaactcaaacttctgggcgaacatttaagatggctgcctgcgaaaatatattttcctgtgcacctgcttaatagggtcgtctgcgaaaatgtaagtcgattttcgtagacatggatacttattgtccgtctgcaatatattgaggtgctcatccagaaaaattatttttatagtgattatttatgtcagtagctacattattctccatacatataggttttgctatttttcgatatgttgttcatatgattttgcatcaagattcgtgtttacgtagttctaacttgcaattacacttatttatgcagtacgtttcatgtagttttaaagtaccatgacgtcttttttcttagggcctggaactaacagaaagaaaacgagtgtatttttctcattgtttgtagaaaggagttgcataggcgctatgtcagctaaaattggaaacaacaccaccgagaaacttcgtttgcacttgttttgaaagttggaggatgcgtgggacgattttgtaattcggtgataagatgagggacctccactgtactttttccacatcgaaattacagattttgtatgggcctcagacatctggcccaacaagggtccgactctttcgccaattttcgaaattacgtacgtactcaaaattcaaattacgactcattcgctaagggtatctgactaagcaaattacgtaagtactcaaaattcaaaatttaaggtatagttaaaattggttttccaaaatatttagtgctttttactttgtcctatatattacgatgcttgtaccacaaaagccataattataaaaaaattacatccaaatctcagttcaacggtattatttttatcacgtaaaatttaatttatattagatttatggttcgtgagttattactagggttgaatcaaaatgtatgcacaccttgtatttttttcgaaagagggtacaaatgattaactgaaaatcacatcaagttttcttaatcaaaaattacatcaagtttgagttgcagaaaactaataaaatcataaaaaaattacaacacaatcacacaagagcaacagcaattaaaacagaaacacaaaagaaccacgtatccaccatcaaactagtttctcccaaattgatgaaacacgcaagtgtgcaagtgcaagtgtcataaatgtaggcacattcatagggagcctagtgcttaggagggcagatcgccggccggaaagcgagcgggccggtggcgtacataatgttatagtagccatggtcggcccaccgcttgccctcgtcacggagcggcgcaccctcgatgctagagtagttgatgtttgtggggttattgcattcgatgtccggcgacgcccgaagccgcacatagcacgccttgcgtggatcgcccatgtagaagtcggtgactttggtctcatcgagctccgcaaggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcacttttaagagaagaaatgacatgctcatgatctgcttggtgattagttttgaatttgtagactataattctataaagaatattcaggatgaagatatatatgcagatttgtcagaacgtgctgctcgtgtctgtccctaacgacactgcaataccatgttgggcagatgattttttgccaatagggctaccactaggacaaaagtgatttttctcatggctcaagagaaattttcgcgtacggtaggacaacccacacgtactaaaatgtctacgaaaatagctatttttgtgtacgggagtttgagagagtgagagagtagtatgtggagaagaggaggtgagagagagaagagaagatgaggatggcttgaaaaaaaatagaagtgctatgagggaaaagaggagataatttaaactactgggcggacgtttaagatggccgtctgcgaaaatatatttttcccgtttggcctcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagacgaatcttttgagcctaattacgccatgatttgataatatggtgctacaataaacatttgataatgacggattaattagatttaataaattcgtttcgtagcttacaggcggaatctgtaatttgttttgttattagtctacgtttaatacttcaaatatatgtgtccgtatactttaaaaaagttttggctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagggagcctagcccttaggagggcagatcgccggccggaaagcgagtgggccggtggcgtacatgacgttatagtagtcatggtcagcccaccgcttgccctcgtcatggagcggcgcaccctcaatgctagagtagttgatgtttgtggggttgttgcattcgaagtccggcgaggcccgaagccgcacatagcacgccttgcgcggatcgcccatgtagaagtcggagactttggtctcatcgagctccgcgcggaagtagccgttatcatcggtgacggcccgacggcacctcaccatgacacgattcttggcgtcatggcagatgacggacacctccgccttaggcagcggcttcgcgccttcgaggctgtgtgtgttcctttgcgcgcagctctggcagtacaccataccctccacccttaccagcagcttgtcgctgtgggccggcggggtgtactgctgctgtggcggcggcgggggcggcgatggcgatggtgtggtgtagccatagtttgcggttgcaccggcggccaggagggacacgaacacgatgatcgcgagaggatggaaggcagccattgctctgagcctctgagctagcttgctgtgctccgtggtcgactgagatattctgttttgaagctttggctgtgccgaaacgtagagaggcatgtgggttatatactgcataccatggactaaatgtgcggacatgtagatggaaattaattgtgctgattttggattaacagatcaaactttatttattgttagtcgattttgacaatatatataatgattagcctggcgaaataaatgatctgtaacgattgatctgtaaggcacttttaagagaagaaatcacatgctcatgatctgcttggtgattagttaagaatttgtagactaccgaaaatattcaggatgaagatatatattgagatttgtcagaacgtgctgcccgtgtctgtccttaacggcactgcaataccaggttgtctacacaagcagatgatatatatggagattatttagtagctacattattctccataaagacaggtttgctattttacttgcgatagatttttgggcttctatctttttatactttgtccataagattttgcgtcaagatttgattttgcgtcaagatttgtgtttatgtagttctaacttgcagttagactcatttatatagtatgtttcatgtagtattcaagtaccatggcgtcttttttctttgggtctgaaactgacagaaagaaaacaggtgcatttttctcactgtttgtagaaacaagagctttacagccaaattactggatccaaagcaagtctgctttttacatgcagcggatcgatctagccaacaccacatgatgcacggcgctatcacccttgtcaccgtgaggctgatgcatctactagcaaggagcccaaggccaccggatctagtgacctcggcctctgcgcgcaacagatccgagtagctggaggtgaagatacaagccactcctgctaccgtcctctttgatcatcttcgtcttgttgagttgtttcgcggaggcccatcgtcgggaggcttgggccggagcgtggcggagactgaagctgacccattgggccgtgcacctggggacgcctggaggtgcgggggcggagcccccgcgaaacggatcgtcatccattttagggttccaccatatatatacctcatgtaagccgccgtgcggcgttgtaacctctccccagatatagtgaagatattttgctggctagcgtccgtggttttttctctcctactttggaagggttttccacgttaaaatctcgtgtcttctgtgattgatctattgttctttatcgtttgtttgcctatcgtttcctaatacgtctcactctacaccgccctatcgatgtttggttaagggtgggcaaaatcgaactaaccaagatagaaataaaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtcccgctgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaagagagaggattggggaaagagggagatagagaggtgaggggaaagaaatacagaggatgagactgacaggtggggcccatccatttaaaaaagaagaattgctgactggactgccatgtaggaccaaaaccactccggttcgagttagtggtaattcgtctgatattaataattgagggtgaaacatgtatggttttcgagtctgagggggtaattcatacttaggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattagatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagattttctcttaataaaatataattggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcatattcgctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattccagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgatgtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaatggacacctccgccttgggcagcggcaccgcgccgtcgaggctatgcgtgttccggtacgcgcagctctggcagtacaccatgccctccaccctcaccagcaacttgtcactgtgggccggcggggtgtactgctgcggcggcggcggcgacggtgttggtgtggtgtagccattgttggcggtggcgccaactgccaggagggacacgaggatcgcaataggaaggaaggtagccattgctgggagcttgcttgctgtgcttgaccgagatgttcttttctaaaactttggctgtgtcgaaacgtagagaggtgtgtggcttatatacttgcaatgcatggaccaaacgtgcggacatgtagatggaaattaactgtcttgattgattttggagtaagatcacattttattatgtgttattcgattctgacaatatatgtaatgatcgattcatctgtgatatgcagttttaagataagaaatcgcatgttcatgatctgcttggtgattagtcaagagtctgtagaccataaagaatgttcagtatcaagatattcagatttgttagaacgtgctgcccgtatctgtcgttaactggactgcagtttcaggttctccagacagaccgaaatagactgaaaccgagagaccgaaccaaactactggagtagtaaccaatactggccgaaaaaaaaaacatttctgtatctgacgaaccaaaatttaactctgtcagtaggcgcggttatctgcaatttcaaaaatgaccaacaacaacctgccaacccaacaagagcaaatcccactcccttccccagtacccccaccacctctctcatcacccgttagtccgtcacacttgcatcggcggcatcgatcccattcctcgcgttgtcctactgcgctgtgccatcctgcttctctgcggtggcacctccgcgtctcctccactagagattgagaatttggtggagcggtctctcctatgttttttttaaaaattttgagattgtttattgttttggtatgaccgaaactaaatcagtatcgactatttttatatacatgtcggtcccaaaatttctctaaagatcgaaggttgagatcgaattgtttgtttttacataatggccacccctacatccggtaaccaatgtggggaacccgatgtacggtagcaagtttttacagttaaaatcactctaatcttaggggcggacacccattagataagatgggtcaaccagctccgctatggtacactccacccctcacccccagacctccctcctagtcgtggatctaacacattagccactattccaccatcaacccatcaaataaatcaagtatttcaaaaagggatgaaaatgatatggaaattcccgaccaactaagtattgttttctataagtggttctattttttatcatatccgattggccatatataaatcatttcctaaatagttaaattggtaaaataaaaatttgcaacagaccataaatcatttctgaataaatgatcgttttcagtcatttttatccctagctaactctaggcattaggcatccattgtcgtgtcattttcatgactatgctcaccgtctcaattctaatatctatctgaccatgttcatcttcgttgttaactgttcatcttcgttgttaacttgtgtaatgtttgtgtggtgtgtcgccataccggtgcgttgagccggtgactataatttatgtgcacagtaccacacgcccctagccagcagctagctaggactagctccttgttagaggccgctctatcctaccactgatctcactaattcacataagggtttacggtttaccatccttaagaaattattgggagtttttcttgtgtaaattaagcttggtatctccatgtatcttgactcttgaggtaccaaaatatatttttatttaggtacttgaggtactttttcatggatcataaaatttcacttcacgtagagagttactcagctcgtgtgggccgtcaaaatcacgacctagtgccccgcagcattatccacaaggcccattagcctgatatctgaagcaaattatcggcatcattttttcgcttatgcttatacttatcagtcaaattttaaattttaaaccttaaatttataattgattttaggatattttttttcgtcgaagtttattttccagcctttgcttttagatcgctaagaacacatatgtaaaaattttattcatattcttttttgttgtaaatatgacctttcgcttataagcgaaacgatggagccgaaaattatatactcgcggggttatctttttttcccaacaaaaatgacatcaagtttgattaatttgccgtaaaactggtagaaccacaacaatatcaacttacaaaagaatcacataataacaccaccaattcaattagaacagaatcacaaaataaaccaggatatattctccgtccaaattaaatttcgcacacccaacgacgacctctcccaattcaaaagcacgagagtgcgcgcgcgccacacgcatgggggcggccgcggcgggcgcatctagtagtgcttgggcgggcagttcgccggccggaaggcgagcgggccggcggcgtagacgacgttgtcgtagccctgccccggccaccgcttgccctcgtcgcggagcggcgcgcccaccatgccggcgttgatgttggtgaggccgtcgcacttgcggtccggcgacgacagcagccgcgcgtagcacgccccccgcgggtcggcgccgaggaagtcggacgccctggtgacgccgaactccgcgaggaagtagccgctctcgtcggcgacggccagcctccaccacgccgcccggttcttggcgtcgcggcaggtgaccgacacctccgccccgcgcagcggcctcgcgccgtcgaggctccacgagttgcggtgctcgcagctctggcagtacaccttcccctccaccctcactagcaccttgtcgctgctttggtgcgccgctggcgccggtggcggtggcgatggcggcggcgtgtgctgcggtggtggcggtggcgatggtgtggtgtagccgttgttggcggtggcgccggcggccaggagggagacgaggatggcgaggtggaggaaggcagccattgatgcggagcttggtgtaagctcgactgagatggtttgtgtgaagcttttttttggctgtgtcgagatggagagaggcttggggttttatatactgccatggatcaaacgtgcggacatgtagatggccgaagcccgaagtggtggccatgtttgtcctggaaaatgtcttggttttgattaagattacgttttattatacattattgtaaaattgtgacaatattatacgtacaatgattgacctgtcgaaatgaaaagaaagacaatatgtaatgattggtcaccatgggcatttttaagagaagaaatcgcatgcttgtaatctgtttggcgattggtcagtctgacatagataacgaatgttcagaaggatgatatgcagatttgtcagagaacgtgctgcccgcgtgtgtcctcaagacttcaactgcaatatctggttctccgtgtaggcagagagatgttccccaacgcaatgccgcgcaaaataatcaattttgccggcagagcgacaacttgttttataatctgaaaacgaactgacatcttattttatctgtaaaatgtgcagttcatgtaggagcatgatgtgcgtccatgttttgtctgaaaccgactgaaagataaacagagagcactggagtaagagaattttctgattgtttctacataggagtaggagagtttaaggcgaaagttactggatggaaaggaagtctgactaatcgagcttacccaaaaattcacaaaacgtagcatctccatcccatcaagagcaatatgtgctctagttcttgtttttcatcttgagggagaaattatccgattaagtttacatgtctgaagagcctaatcatttttgtatatcacttatatgtgctgtcctaaagatttgatttatggaagagtagaagacaattctcacttcacattccaaacaggtcataaatcgacaatatcgcttgttattgtgcggtttccgcggtaaccggacttacctttggatacactaatagtaacttatcccgtcaaattcaaataaatttacataataatatgaacttctaatagcatcgtctagtttttcatggtttaccgtgtgattaccgtgcttacgattgggtgcggtaactcaacccctgatggtaaggttagccctgctctaactaggaaaaaacaataacaaacagatatataagacacaggtttaacatcagtactcttaactattccctccgctcaaaaatatactacctccattctagaatattcgtcgttttgagttttttatttgtaatgtttgaccattcgtcttatttaaaagattatgttattattatttattttgtttgtgacttgttttattatcaaaataccttaagtatgacttatcctttttaggtttgcattattttttaaataagacgaatggtcgaatattgcaagcaaaaagtcaaaacgatatctaatttgggatggaggtagtaataaattttgacactttcatttgtccacaaaaggctagtgaatattattaatgggctgggccaaacacccaccaaagaaaattcccaatgggccttgagtgatccccaatatacagcccattacatgtacaccccagcaatccaggcccacacgcagcgagagaattcgactcccgtttaattccggcccaaatccatctctttcgactgcttacttctgccctaatccacacacgtatcagaaattcggaatactctgttcgcacttgcccttccggaacgctcccaaaccctaggcgcgtgaccatgtcggggtcgtacggatccgacgactaccgcggcggctacggcggccgaggtcgcgtcgggatcctgcgggttgtgtgcgtgcttgcttctggatctgctcctgactggcttgtggttttttttgtaggtggcggcggaggcggccgtgggaggggaggtggcggaggaggagggggaggatatggtggtggtggtgtgggaggtggatatggtggtggtggcggaggatatggcggcggtggcggagggtacggcggcggtggtagaggtggcggtggaggaggaggatacggcggcggtggcggcggcggcagaggtggtggtgggggtggcggtggccgaggtggcggcgggaggggtggaggacgtgacggtgactgggtttgcccagacccgaggtttgtttcgtttactcatttgacgttgtctcgtttgattcgactgtgactgatgaaatcgtggttgtcccgattgtcttgtaaattatgctacttggccatgaaatctagggtttttaggttgttaaattataaattattgggttatttgataatttggtttaggattttgcatggggcatgtgtgaagtgtcctactaaatttttgtttcatcgtagtattgtgagcatcagaactgccaacaaatagttaactgcataattcattctctatgagagctccctataatcttaggtcacaagtgctaaatttatgttgaacctctagatacataaatattatgttatacttgtctcccatgatttcttcccctcccctatgttctattttccttggtatagcagagtggcagagaagaaatttcatatatgtttttgaaatgagttcatggtgttattggaagcattacaaaatacagtaaataagcactacaaaatacagtaaatactttcttttatgaatatgtttctttcaatatggcattagttgtcttgctgagttggttatattttgcagaatattcggttgcaatttcattggttctcttccaatattcctaatatatttgtttatcattcttgttccagttgtggcaatgtgaactttgcaaggaggactgaatgcaacaagtgtggagcaccttctcctgctggaggtggaggtggaggtggaggtggagggtataataaatctggtggagggggtggaggctacaatcgtggtggtggcgattttagttctggaggtggcggtggctacaacagaggtggaggagattacaactctggtggccgtggtggtggcactggagggggaggaagaggaggaggttacaatagaggtggtggcgatgatcgtggatttgatgaccaccgtggtggcaggggtggttatgggggaagagaccaagggaacaaccaaaggggagacgaaagtggttatgacgctggtagctatggacaagttcctcctcaaggtcctccttcctatggtgggcctggtggtgactatgcagcacctccaagctcctatggaggcaataatgcatacaattcagattctgcagtgccacctcctagtagctatggtggtggtccaggttcatatccaccaagttatggtgcaccacctccgaacccgccatatagcggtggtgctccaggtggccaaggtagcctacctccttcatatgatggtgggtatggtggtcggcctatgcctgggggtggaggccctggtgcacctccaccctatcatggtggtggtggtggtggtggtggcggcggcggtggcggcggatacactggcagtgctgctccagagccagctgcaaaggttaagcagtgtgatgcaaactgtgatgagacttgtgataatgcaagaatttacatctccaacttacctcctgatgtgactgttgaggaactgcaagaactatttggaggaatcggccaggtatactttgacctcctcttgagctcccacatatttagtgtttatgaactgtgcatttcacgattcgctcactgaaatattttgtgcattttatgtcttttttctaacctcatgtttttcattttatgtgtttcgccataatatctttttccagtgttactgatattacttgttggaatttaagtaaatttacaaatcagtattcagatgatgtttataatctgtagttgggcttgttaacatttttttccccttttgctttcactactgctagcacattgcaagtcatagttttgcacaaaatctgctccatctgttgtatacagcgcagttagagcgagcttattacatattgtttttttccttgctagtggagaagtacacccttgtgtttcaatgtgcataattaaatttggatatttgttttgatgtaacataatcatcttgcagtaatgatgctctttttttttgtagaagtagtagtactgtaattttagttataaccaagccattcaatgattttgtagtaattttgctttactcccatattggtattttatgccaaataattcgtggcatatcaccccatgatgttaatgtaaaatctttgataataaagtaaagttggttttacagattacttagtgttcctagctaaatttattgcaagaaattaatttctttagttttgggggtggtaactgcttgtgtttcatggctgtgttttgagtttttgcaactgcttttttcttaaggttggaaggatcaagcagaaacgtggctacaaagaccagtggccctggaacataaagatctatactgatgactctggaaagaataaaggagatgcctgccttgcctatgaagatccttctgctgctcattcagctggtggattctataacagtaagttcagcatcgagattatattatgtgtgtataaatacagtgttctgcaatttttaatgcatgttttctattgatattccagattatgaaatgagaggctataaaattagtgttgcgatggctgagaaatcagctcctagagctcctgcatatggtcatgggtaagtacttttcagttctgtagatgctaaatgcagattgtggaatgctgtgtgcctatgtccaagcaagacagcttctattatgggcaaagcatgccccttttagttgcaatttgatagcctagatgtttgaatctattcttcaaagtgctcgtaggttgcccccttaagaaactgtgatattaggagtatatgacacgtaccatctgtttatgttattttggtgtagcttttttttcttcaactacaaaaactgtgtaaaaccaagcacttaagctagaaatgtgatgtaagccacaattacattgattggattctggtggaacataatctggggacttttcttatcatatttttttgtatagcgtgtaaggtagttttacctgatacttcaattatgtgttcttaatttgcatatgcattctgtcacaaagggcttataataacacattcatggtgtagaaataagttgaatgtgggagcagtagaatgccaagtatgtatcagtcaatgtacacttgtactacttccgggttaagatcttaaacattgttcactgaacctctttgtgtaatttttagcctagctagaaaagaatgtcactaacatgccacgattcgaagttgtttggtattattttagaaactggataattgtaaatatctatttattctcacttgacaaggtgggtcctaaccacttgtcttaagtcaatgtgtagtgtatgactgtgtaagggacaatgtgttggttgaaatctttagcatacctcgatttaacacaatatttgtgaacactacttgttattttatgtatgtgcttgggcatatacatcatggtgtaaaacaagtaatatatggcaactgaatgatttttgtttaatttttatcagttgtgccttttaggtatttaatatctgtccacaccacttttagctcatatataacttaagttattactcatgtcgagttgtatatgtataatcaactgcattacatggcatgcagaggtggacgtggtggctatggtggaggtcgcagggataacttcagagatggaggaggccatgggcctaacaggcatcaaggtggtggttcgcgttcaaggccatactgaaagcaactaatatagttactaagattgtcatctgtgagaaaccatttctattcctgttcatcggacttgtactcaaaacaagagcgtaaggtaggttgcctgcttttctcggaattatattccattgtcatactccaatgttggtcggatgtttgtttgtctcatccaaaaagtgattgatccatgttatgtgaatttttccatagaggcagatggataagctccaaatgctggtagttttgagatgttatttcaggtgagtgccgatctgttatgattctgcaatgctttgctatcccgtgattgcttacctttttatttctgcgattgcaaattttgctataacgcttacattccacatggtaactcagccggtggatcactagcttggattttggcgaggagaaacaggtagggcatttttgttcttcgataggtttactagatctagaatccattagttacggatatctctgtggatattagatgtatatgaaccaccttttctggtacacattcattgacttattcatgtggtttgcgtcaaataaagcatggatatgttactatttagatactatttccagacgaaaacatctgcgcatttgttggcttattcatgtggtttgtgactcaaatgtagcatgcttagaaactacaatttccaaaaggaaaaatattctaacatagtagaaaaaatcttgtgggagactcctaaaatcaccccccttagcattagtagtagcactcttgtatgaggtttcctactgttgaggttacgcttgcaggcttgctgctgtacaatgtgtgcagccaacaccgtctgctgcacatcgatgctgcctgctcttctatcactgcagcgtattgtgaaacctcgaagccatccttgtatctgccctccggatccagttccttgtgctgattggcaaattgacctgttggctggatacctccagttcatctggtttctttgtatggtttgtcacagttgcggtggatacctccagttcatctggtttctttgtatggtttctatcacagttgcggaagatagacgtcaggcttctttccgttgattgctttttccgactctttcatttctttctgaagtttctcctcgctgttccatatgggtttggtatttggatctgttttaggaggcttgatctggagccctggacttgcagatgggcgaagctccaagccgttcacgtcgtttttgtttgacatttacgtgccgtatgtatcttgcaatagtttggttgtatgacatttgctgaatacttaaatttttcacttcatttgggattgtaataatgcactgagaaacgtacctgtggcttcgcattaaggataaaaaaatgatcggtgttgcttcactacttgcggggtgtgctgagcggaaacgagcgaacgtgttataagtgaattgtgcaacgtttagataaacgatgtattacttcaaagttcaaacgatgtccggcatctttgccacgtagtagaacataaaccgtaggttgtgtagtcgcatttagctagaccctagaggtagctctatactaccagcattcttggttaaaaggtgaactagggcattgttacagtgattcagctggctttaactgacgaaaaatagagatggcactatcttctatgaatgatgctcatgctcattcaccgtccttgtcacaaatcacaaaatcgaacatacaatagccagggcaaaacttgcaacctacactggttaaagaaaaaaaaaagcaaaattgctaagaacaagatatacttttcatcttctcctagtcttctgtttgctcctcccttcaaatctcctagacccttttgccttccctttctgcttgattttcttgagcaccttgttgcccctctcctttctctcgtccaggtcagaatcgccgccatccgaggaatcgtcatcgtcagattccccgaatccggtgagcttctcgtactcgtcctcgtcgatcaccccccgcttcagcttcttcaggagccggtactcattcgcgagctcatccatgtcctccttggtttggactgcttgacgctgtttacctgtcttcttccgctttggcttttcaggcttctccggggctttcctcctcttctctatctctggccttagagctagttcttctgctttccttttcaatgtcttctgccgttgtttttctcgagctttatccctgcagttaaccatgatggagtgttgatccctttctcatagttgcatttgaagcaaaaaatacggatagctctcaagtgaaaaattgctgaataattgttcgattagtttagacatagctctttagccctacaagggtcttacacaacaagattatggtttgtgtcatctacgttttgaatatgggctttccttttaatataaaatataccaatataaatttgtcaaattagtagtgcgttgatgcaatagtacaattggcaacagagtgaaatgttaggtttgcaggcttacttgtacttgatttttgtaacatcgacatctttaacaggagtaaacccttccaatgaaagagaatggtgcttaacttctggcatagatggaatttggagtaagccgtactccatacccaaccttccaatttcaaggtctttccaactgaaaatgtaagaacagtggtgctccttgtatgcccgaacaaacgaaacaaaagctgtaagccctttctccatgacatttcggtcttccaatgcagcacttctgatctgtgacagacaagtgggtaattggttattttaaacactaaatttttctctcaagaaaaaaaatcatttctggattcagatgccttcacaggcagacaacctaagatgatctataacaataagaaactcacctgtggtacaatatctacagcatttgtggaacactccctttcagtgaggggtacacctctcctcttcaagaactcaacataagtatcttcctacagaacaattatagcgctaagcattttactaacaaggcaatccattgtatcaaatcactactgcatgtgcatggtatgcatagccaaatatgtctttgaaattcaactactgacttccacttagataatgtcaaagcagagcaagtaccttcggtaagaggaatacaatagcatctccttcttgatcataacgtgcagtacggccagctctatgtatgaacacattgggatcttgaggtggatcatactggggaagaaacaaatgttttatatcaactaatgacaagcacaaggaaacaatttagggagttatgttcaaagcattacctgcacaatcagatcaacatgtggtatgtcaagaccccttgctgcaacatcagtgcaaactagaataccacttgagagagctgaaaatgatgccaaagctttctcacgagggccctacataccaggaaaatagcgcggtagcaatcagtatgaaggaaagcttttggaagcgccatgtacaacaaatcatgcatgtattagctctgtaacctgcttcatcttcccatgataaggaattattggagaacctttaagtgagtccaacagcgggagaacaatagcccagtaatctacacaagcacatgttgcgaagtacctgcattcaagtaagatcagaaagcccacaagctaacacaatgctacacaactaggcacttaaggtaagtgtgtgaaaacaaattttagttcgctgtctacttacaccattattttctttccattgttctgcacaaggaaatcaacaagttgcgatgacttatttgatgcttcacatatcatatactgcaaagaacaaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatggggtggagccgtgagcactgagcagacctcgtggggcttgggaggcgaggggcggcggcggaggatctcgacgacggggacgacgaaggcgagcgtcttgccggagccggtggcggcgtcgacggccacgtccttgtgcgaaagcagcagcgggatggccgccgcctgcaccggcgtgcaccgccggaacccgccgcccttcagggccttcaccacctccggggacagcgcgggcgacagctccgagaacctctgctccgtcagcgcgcgcttccgcgccgccgccgccgccaacgaggaggaggaagacgacatggcgtcgcgccgccgcgtctgctactcgcgtcgcgccgcttgagcaggagagacttcctcttgctgttggtttagggattccggggggttcatcgattgggccgtgatggtgggccgcgtagtcttctccagggttgcatttaccgcggtaaaccgcgcggttaccgcggttatcgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtcttctcccgaaggccactgcccaacagcctgttcaattaattttttttttaccgattccatccaattcacttctactctgcacaagttctctcaagtagggatggcaatttaaaccgtttgcccgtttacccgtgggtaaaaaccctaataaagttgggtttgttctccatttagtaccagtgggttttttattgggtcaaaacctatacccaatgggcatacgggcactggcccgcttcgcccatttacccgcaaaaaccaactgatatgtggtccctcggtcaaattagtataaatgccaccatctagtattgatgaacttgtaatgcttgtattgttgaacttgatacaactgtaccctttctttaaattgcgataatgtctctctgcttgtggagatttgtggttgaaatgttgaactgtgagtttgtgacgggtaaacgggcatacccgcgggcacatagcacccgcgggtaacgggcatgagtagtgttccttgctcatcatgtagtaacgggtatgcccgcgagcataaattacctcgtgggcatgggtatgggtagtcactactcgtgcccgtcgtgcccgactgccattctcaacaataatacagacaatttctcaaaaaataaaagacaaaggagggaaaaaaagagatagaatgcatatgtaaatgggtgacttgtataaaaggaaagtcacaattttcagcaataaatgaaagagaggtgtattcgtagcgactcaattctgcagggaattcggctgtacatgagtattttgattgagttgtattccctccagtagaaacttacaaatgtacatccttagagaaaagataaggaggaagacataaaatagaaaatggcggcgcacgaagaacgtcgctttgaagaatcagtagttacattgtgattgcggtatcattgattttactgtttatgtggtaattgagtcttccttctgttcagaggatgcaacggcaacagcactgccttgctcatccccttgacccttttcttcatcaacaccctgtaaatttcactcaacagtaagaatcccaaggtgaaactgccttatctgcatatcaagattggaagattttgtaggttcacctcatcatctgggatcatcactgccttcacctgtgcaacaataaccgtaatgtcatccatcttaccacctgcatagatgaaatttaggcatcatgagattactttgcgttctgcatagagtagagcatgatagtatgtgtatgagttcatgcgtacctattagtttccctccaatgaactttttccacgaggggacatcaaaaccctgcattcaagtgatcagaatgaagaaatttctgtcatccctttttggctgtaacaatctgaacagaaaagattgttgaggggtatatgtttcgcacccgactccgagcctccattgagtagggtgaatcaaaggtgacatccactgaatgcttccttgcaagctctgctagtgcttttgctgtggaaaaaacatcaaactttcagaaggattggaatttgggaggactggaacatgtgtttggtggcccccaattcaaaactgagatatttaccacttaccagcttcatctacccctggagactcggaaatgacagaaacgatctcttgatcgaatatattgtcaaaaaatccatctgagccactgacaatcatatcaccctccataagatttactgtgcaaacctggtagacaactggatcaaaatcagaaggttctacaaataatgcttaaatcttgtacgactatcttgattactgtagtgaagcacttggtattatgtttccactgcattagtggtatcttttatggatagatttgcgcatgcatgcgtgtcccttgtaagatcttccccataattttgatttgtccacacatgcaaaatatctgcatgacttgagatcatatagagttttcaaattaagaaataattaatgtgcatgtcttggactcgttgtaacatatgggcaaccacctagaactgagtatgctaataaaacaatcgtcacacacacagctctattattctgacctacaataaggcacataccagtgcatccagatacgtttgaccaattgcttcagagcttaactggtatgggcagtcaaagtaatgttcttgaggacatgtagagaacattacttggcctaggaagaagagaacagataagtatgctaataaactttaagaaatctataaatttgttcatgctaaccttttctaattactttcaaaccacaatctcccacacttgcaatttttagaatccctgtcttctcaagcattgcaatgattctgttagcgttccaaagaagtcattaggttttgacctgtaaagttgtactaacataacaatgtagatatatgcttacacagttgcagatccaacagaagttgttgcagcatgagccttcattagaagaagctgaggatcatgattgacctgtgatggatagaaactcctatttgatatgcaaattgacgtatagtgtacgtgactttatatcagtactgatgtcaattaagaaatacctcctcatccttgagaaaagtagaagtgtgtgccatgagctctcgagaaaacagagccggattgacatccttttctgcccatctgtcagtagacaagagaatgactagcaggataaaaaccttgtgttaatgcgaattgctgaaaacaccatgtatttttttgagaagtgctgaaatcaacccaaaattaaaaggaaggaaacaaaagcacaatctacaatttattgaagcagttcttttcagggacaaaagtacaaaacaattcattgcagcgaagatggtgtaccctgaaactccatctgcgacggcaaacactccaccatcatcgccgttcacaaagaaagcatcttctccgccagtctcagccttcagaatttgaagaacattcaaatatcaaacaatggttgcttctgttgtataattgagtatgaaggggaaaaaaacactaccagaagagtaatatattaatatgtttatctaaaaaatgactaacctttcttgggtgtggtattagatgagttccaatagttaacacagcttccaacctacaattacaggctcacattaccaaacactgacagatgaagcacactagaaataactaaagactgaaattatcagtgagactgaaatatatattagcagctgtgtttgtttgtagtctaaatcgctgagacgattttctgtagcctaagccattcctggcttagggtgttcttgttgtaaaactctctctccttcttaatacaaaacttggccggttcttttgccggcccggtgaaaaaataaactatcagtgagaacattgctccattacaacttaagatttgcaccttgacccaagtactactgataatcaaacgcatgtcttaggaacccgagaattcgataaaaccgaacatttcgtggactgaaacttatcgtaagggcaaagataagaggatcgaacaggtgtaagcagggaggcatacttggcggcgcgaagaggggagaagcgcgagcggcgaagcgggagatggggagaaggggtagtgggtgcgtggaggcgaggcggcgagaggcgggtagcagtggaggaggccgccatggctggcttgctgctgctctatctcctcctcgcctcgcctccgtcgcccgcggccaccgtgaatcgctcgctcgctcgctagtggtggaggcaggcaagacacgtcactagcacggcactttttcaaatacaccccttacgtattatctattctcgtaaggaccaaagtgaaaaagtttactacataaggactaatcgcagaataagtggatttccaagggggttcgagtaagaatccgggtcagaaacgggggaactgctttaagattcgcgcgagcacgatcgacgcgcacccagccacccacccgcgccccaaatcacgaggaggcgaagccgcccatctcatcgccggagctcgcgaattcgccgccgcgattccgaccaccgccgcgccggcgcccgcgcccgctacggtactccgccgccgtgctgagatcgccgggggagccatgtcgcggtccctgagcatgaggtcgtcgatgagcatgaggtcgcgccgcgacctgcctcctccccagcaggtgagggatccctcctctccccgtgccttgggtattgcgagtgtaacatttgcgcgaggtgcgcgggattcgctgttgcgtgcgcgatgcgctagtttgatctcggtgtttttcgaccttggggcgtagaggggcgagggggtcgattacccgactcttcgtggcgaatttgaggaaactagggttctagtaccgaatcatgtccaattgcgaatctcgccattttattgtgtggaactactagctggaaaaatcaatcgtaatatttctaagaaaaattaagattacttattgtggtttgatgatgataaaaaaaggcatcaatgatttactctccgcagtccgcaccacctggttgtgcgcataatcactagggccttgtccggttaggcccggattgaatccagacgtaaccgaacaaggcctagctgtgggtatacctggtttggatcctctttgaagtgttcccagtcccagcatggttcctcatacccatctttgacaacattgagtatatttccctttggattgatgtttgtaaccgtgaggtgtttgttttcagacaatcgaaaagcttgagaatatggtggctgaaggaaattattatgaagcccaacaaatgtacaagtcaaccggtgcaaggtactctgtgaataatttaactgaagccacaatgattgattcccctttaacttgcatttgaccatcttgcttatggttgtctatttcagaactgcttagcatatgatagaaatcaaccattcactttttataacttaaattggatctgctaaataatatgagttgattgaatttagaatctttgttatacaatcttccgtctattatcatagttatttggctaatgcagcatcttaaaaatagttaatgtcaggattgttaggacattaaacaaattcaaagtaaaacaatgaccagaatgtttacatttgcatagaagcagtattactggatcctacaagtatgtttcatatgatcacaatgaaaaatgttattcatgcacaaaatggctattttctttgactagatttattgatttcttaataaaggaaaggggcatgagctttgtctgaaagatattgtagacaaaaagtgccaattcaggaatacaattttgattaattgtgtctcatatcttgcaggtatattgctgctcagaagtatttggaagccttggacatccttcagtcaggagctttagttcaactgaagcatgggcaggttctatcaaagctaaatttcatagatctaagtaaaaaaaaaatattcgctacatttgatggcaaagtaacacccctcccaaaagaaaagagaagagagagccaaccaaaagctcattgctcccttcgtaacgatttgttgcaaccagccaatggaccttgacgtgttcatttgaagttgtttttttaatgtgtgtattgtcgatgtggtggtagtgattcacatcttattatgggatgtttttattgggtgctatgctgtagttacatacatgtgttatcctagattggtgttttatatcattttaaaccttcacatttttgccttattggttaaaaattcctgatttcaggtaacttgtggtggtgaacttgctataatgtttgtggacacccttgtcaaggcagcgcttccttataatgaagaaacctttggtcagtcttctctcatagtgaaaagctactatttctttatatcattaacatgctaataaattgcatatttatcctgtaagtaaatacacatctagatttcatttttggaacatatttacaatattttatttgtagcatactcctaatgtccatcacttgtaaagttttgaagaatcaaagttgtttaaaatgttagtggaagcagtgtttactagtcctaattgtggctctagctttactttgtcttctctttgtttgtttaccttcagaagatcacttttcccttagattttaattgaattgaataagatacttactttattatgaatgagaacatgtttctagtttgatttgttagtatcacattttgtgattgtaactatatgtaaaccttagatcgtatcagaaagatgtacgacgccttccccaggatatctgttccacacttccttggagatgattatgatgacgacgggcagaaattatccgaagctatttctgcagcaaaagtgcgttctgagagttgttcatcattcctgagagctgctatcaggtaaggttgtactaattttcattaatccaagtaaattgagtagaaaaactaaatatccttcatgcaagcatcaaacatcttcatctaaacatggcagtttgtttaagtggatcttaaggcaaatacatcaaactgttgaatagcatctatactatgaccaggacttgttaactgtagtgcttgaccagtagttcattactgacaaaagtagaacagacaattgagcttatcatgatggtaaaaacaaatgatctgttctcgttgctcacttgcatataaaaatccagatgttgattgtgtaagtttgtttattacaataatgctctcagaaaaaaatgaaaaaggagatggtcacgaatttgtgattttaagatgaactcaaggtgtgcaacatataagaatcatttccatgggatctttgaatctttatgtttaactctgttaatggacaatgtggtcatctagttgactcttctcaattttctgcctgctatatttatatgccactaatagcatatcaatcctttattaaggtggtctgctgaggttggggcatcaagaagtggatctcctgagctgcatgttatgttggcggaatacatatattctgaatctccagaaacggtactgtttataaattatagaactatttttctgacatgaatatattgtgtttgttttagagctgaaattttatgtcttttcaactgttactctttaatgcctttgtggtttgctaaggttcgtgttgactgccgttggatgcaggacatgactaaagtgtcaagtcattttgtgaggggaaatgatcctaaaaagtttgcctctatgctggcgaactttatgggaaaggtaatggtttttagaaaataattgataatagacttgcagctgatgattgtctaatgccaaattctattgaactgttacattcttctgttctctgagcaatgattaaaatgtcttatctgaatatgatcagtaggttcacattctttacaacaattttcattttacaacgggtctcttgcttatagtttttatttgagttggaggtcatccttctccgaaaatagaaacacggtgccagcaagtgattgttcaatcagttatctatatccatttttgggttggattatttcaagaccaacataatcttcgtgtaaagcagtattcatagatgttttttctcaatcaaaaaaatatttttattaatatttttcttactgcacagtgctaccctggtgaagatgatactgcaatagcacgtggtgtcctaatgtaagatataatttctttcttttttttttcctttcaaagagtgcattgttttgacactggcaaaatttctaaaagccatggaagatgtttgcatcttgcaatgcagaaaccgaatttcatagggagttctctatttcatgttctgtttacaatgagtaaacaatatacatatttaggaatgtgctagcaaatcatgcattaggatatatttcctcaatatgcatcaatacaatatcctgctaagttatatacaaatctcctttggatacttaagcacatacaggagcacactataaagtgctccatccaaggtaaaatattagaatttgatcgaacttcggaaatagttacataatatattattttattatgtttatagtactatagtatgttaaaaggaagtgtcaaaattcttgcactggggaccagaaaaatcaaagctaacttcagaaaaatcaaagttaagaaagtgtttcgttataggatgaataaataagaaatttttggggaaaaagacgtgctcagatgcttgtttttctgatatactgcatttttatttaaggtatctatcacaagggaatcttagggatgcaaatttgctcatggacgagctgaaggatcaactaaaatctgctgacttggaaatccccaaaacagatttaattcagttcatcaagtatctcttaccgacgtaagtctttcctgtctttcagtttgcattatttttatgtttcttttccacatttttgttctgcaatgttctcatgtatttgtgtgcattcatgctgcaatttgccatgataacttagaggacacctgcagagtagtttcatccttacatgtttctactaaaaaatactgatcgcaggaacaattcttttttttttgaaagaaccaccagttatgggaaaatctttcatggcctaggtacattacctgggtattagactattttccacctttgagatatgttcatagtttatgtaggatttgttttcagtacagatcatgaatgcatataaaaatattaaatatttctttgatggttattgaaaaattctgataaccttatataacttagccatgtttaagttctcactgatggttaaagttcaaactgttagatttggttgatgctttgctgttagattgcatgctatgcaggataatgattatatttgactgtattgatgatgtgataattttaacactgtaaatctaggatctattgtgtgcttgttgtgtatcactgcgcaatatgttgatctaggttgcctaggtagctttctgttcactgtaaacaaactgatcctacagtttcaattatccaagtttccatgcatctttcgaataattgatgagatagttttgcattttgttacttgtacgtgtataccaagcccagacgttattttatacaagcaacaagtttttttttttctcattgtttcctctggtcgtggttatattactgactgcatgctatgtttacaggctcgaaagagatgcttaccctcttttcaggacactgcggcagaagtacaagacaagtacagatcgcgaccctgtatttgaggaggtagctatttcatcaaatatagtgttagcttgctaaacagctgtaaaacatgcaccaaaacatcttattctttcaaagattaacttaacaagaactgggaaaaattatatttttcatgttccctgcatagttgtcataaaacaatgtgttcacaagagttatattagatcatgtaggaaactctacaatttaatccaccaacaaccttgttatcatgtgctgtccatagggaaatgtaaacagtgttgataaaggaccatctgcacttataatgtgcttaatatttaactctactagcagagtaatatgtggatagaacttccattacattaactagcagagtaacttgaagaaggtagttaatgctttctatcatatatgaaaaacaagctgaaacagagctcacgtgatattatggttgggtttcagttattagatgaaatagccgcaaaattttatggaatacggagccagagcgctttggaaggactttttggtgatatgttcagggtaagatttacatctttcatctatcattcattcatgccgattgctagtacattgcattgattacttttgaagttgagtacacaccagttgcttttcacaataactaccgtcgtatgcctttagttccatatcagtcatgccgaaattacgtttcatgaagtgcatatcatgtttagaggaaagaatatatatttctataatttgaaattgcagttgatctaagcattcaggaattgaagtgcaaattttatgtagcttatgaagtcacggatgtccacctgttacgtggtaaacaaacaagaaaaaaaatttgagttctttctttcagttataaatattgccatcttcattttgttttgttcaattcaccttttctgtacgttcatgtaatttcacgtatagtttcccaagtacaatgaagcaaacagataatcaatactaaaccattagtgtagccaatattagtacaatgactagaagtcggcaacctagttccgatacaagccattattgatcttgttctttgtattctgcaggtataatgatgagaaaaggatttcgtcataaatattccagcacaaagctcccgacgcgcatttcgttcgctaatacaaattgctgctggaagatgaacacccggcccggcccgaaaagagcataagaaaaagttctgttgctgccttcctcagccttgattatcctgaggccatacatttagctccaaactgcatatgatgatatatgctccagttaccactgatctcttgtaaaaccattcaactgttttgctcgtatcatggtcgtgttctaatgatattactattctttaacattttttgtagttccagttttgcagttttaaaacggcatttatcctgactggtctcacgttcccttcatcttcgcgtacacgattgtttggttagacagtgcggcccgtcaaaatatgtgggctgaaagttagggcaatggcctaacgttaaggtccatatataacagcttgaaacgggccgtgaattcaggccattactgggtaatgaccgagagatttggcccatgccactggccaaatgaggatggaagagttgcagacagtaggctaaaaaagctgtaatatactccaattgcacattaaacatatctgggaagtctaaaatatcatagaaatttaaacaacagacattttccccaattggatattggagtgagaaatacaaccatataattgcgtcagggctgttctccaatttgagaattgagtatcaataacttagctatagcacgtattactattttttttccctaaacgcatgtaaaatggctgtagaaatatcaaaatgatcaaactaagcctccatacacaactttatacaccggataattacaagtcaggataggcagcagacaccagatgctcgtaatctataattcataggctcatagcgaacgacgagcagatgtgcgtgttcaatgggattgggagggcagcatgacgctccatgttgaaacttgggacgctcaaacgccagcaggatgatgtcgtggtgggagtctaaccatttcctcgccagcaggatatctcgtgtccaaatccgctgatctgtccctccacgtgccaatcacgtcctgctcgcacaaaatcacataaaccatgcattgctttattaataaacatatgatgcagcgtgcgaattgccacctatggtctatgctatctactggtaaacactggcacaggtgactattatgcttcctctgtttcaggttataaaacattttgactttagtcaaaatcaaactgcttaaaatttgattaagtttgtaaaaaaagtagtaatattttaaacacaagacaaatttattatgaaaatatattcaattattgatttgatgaaattaatttagtattatagctattatactacatttgtctataaacttataaacttagtcaaacttgaaacagttgactttaaccaaagtcaaaacatcttgtaacctgaaatgtaaggagcagtcagcaattcacgaatttgagcatagaaagtacaatatactccctctgtcccaaactatatggcctatatttttttacacggttttcaataacatactttgatcattattttatttcattctataatcccaacaaatatgaaattagcatcacataaatgtacttcaaaatatgaatctagtgatataacatgcataatacatagtatagatatagttagtatgattattggtcaaaagctaccgaatatgttttttcttaaaaagggacgccctatcatttgggacggagggagtagtggtattatgcagtgcgcaacatgtttcattatacataatcttctgatgttacatgttaaatatgcagataatgttcaataagatggttgtgaagctaattcatcatgaagtgtacccgtgtttcttaacgtgcctcgccctaatgaacacacatgctatttattacagtccaagttttgtttaagaaagatgattgtaggcttatagttatagcccagttatttacaataaaaaatcaagatatttagttatgactagaaaaccatatgacaaagtgagtatcataccgtcgtatccatccatcattcgtatgccatgcagcatttatcaagactgtcagttgtctagtcgacatcgagcatccactgccataggcttcattctggtcgagtcctgaaacaaactacttccaatcaacgttatctcaagtgaagcactggaacgacaaagaaaaacatgtccgaaaaaataatatagttgtgcttgatagaactccgagagattccttacactgttctacgagcagcaccattcagagtacttcagccaccactgtcaccaactatttgcagaactctttccttcagatgctgaatcatctgcaagagatcaacagaaagtgacaataagactgtccatcttatcagaacaggatctctgtggtgtgaagaaacttacaggatgagaatttgaagcccatttttcagcagaagtggcagcctctttgagatgtgattttttaggtatctcgtgggagagactataggtggagctctctgtcgcctcagctacccacacgtgcctcatctggtctttatctcgcttgaccagattactaaaaccaacctgagaaacaaacgtaacagtgagttaaagttgcacttgcactacaaaggggtaaagctgaagaattatgtgaagggcctgcagaaaagaaactgggatatagctcgtctacacagaaaattacacgaggcactgtttaattcataactactcgcatttcatatgggactcatgaatttcggacttcaaagattagtcaacttgagatatagtcagtgcaatggaagatcacatactatatgtccagaaagggcataattgaagaatgcagaatcctcgccagtggttttggaagaaaagctaactgccagaagacagtcatcttgctcttcatacttttctccagagataaatttagatccatctgtcaaaaagagccactgcctattctggttgttcaataaataaacattcccaacatacaaaataacacctgcaatgtcaaattcgctgaaacaaaaaggaacggctcattataaaaggttcataatacaacaggagattcagcaagtcagcttgagacagggctgaccttgtaagtggcacttcaccaaaatgtgacaattcaactgctttacgaggggtgaaaaatggtctgcatcatgaaaaagggacatggttaagttttctaaatgcagtgcaaccatcatgtccaatgaggtctcttactcaaaatttgtagtctgtgcggttgctaaaggcgtccatgctgtagatgatcctctaccactcaagtaggatacttctgtaaagtagcttgaagccaacagtcctgtgacagaataaatttgtccctccaccaggtcggatttctgccagtggcaatacagaaatgaaaattgttttaggtatatttgctcattagcacataactatgggaatattgcaaagaaaataggcatgtgcatcttgttgtcctaaagacatatagcaggtaacgctacacacaaaaatatatgacaatcactggcttgttttcttgatgacataacaccaaatcttttgttctttttttctgttcataagaaagaataaagatgatttctgacacttatatgctgtagaattattgtaccgtacttgcttctcggtagggttccaaattgttattaacccttccctgcagccagattttgtggcggagtgtttgctgataaggcccgtcaccctcactttcaaaaatggtgtaacatctcttgaactaagcccagcaactttaagagcattttcaaccttcttagctacttcattttgcctgacaatctgcaacataatggtgtagtttaaaaaacataaaatattagcagacagatgagatgctatagttatgcgtccagaccttttgcttttcttgataatatgagaaagacagcagctgctctgaattcatgctggacataagaatttcaggctcagctgccctctctagcattttgcatatttttgccccttcatcgttatcatcagtgttgtcgcagtgttctccatgttctgactgaatgtcttctgcaatcttagacactctgcataaggtaattattattattataattataatttataatggcataaaaagggaagtattggtgcaaatacacagtttgtgctactcatgaatattactacgtccacatttaaatatatgacgctattaactttattcggtctttgatgtgcaattttgaccactgtttttttctattataatattgtaaaagtacttataaattaaaaaatctacccatatgacatattttcaaactaaatattttgagagctattgacaaagtttcaaaaatttgagcaaataaagtcaaaagtgtcacatcacatttcagtgaactagactgatgatgaaccccaaaacatattgagaaagttttggacagaaaaaaaaaaggcaaacaggaagtatgcttcaagaaactggatgtatccatgcatgattgcttgtcttctattggaggtgtgataagcatccattgcacttaattgtgttaagtttactccaataggagaaataaatacctctggtgatacagctgtagtgcttttctttccatcctttcagacctcaccacaaaacgaccgtcagaaaacctgaaacaaacaattcagtgtgtgcaactgagagagagtttagtaatggatttatgtccagtagtacacctctccctgtacataacaggataaatccttgtaactccaaccagtgtcctaggaactctgccacctgaagcttttatgcacttgaatgccagtgggactccagcatgcttgcctgagatgcgcacaataggttataaaagacaacccagctgtataaaaataatagaacagaagtgtccagttttgtgctcaaattacatacataaccccaaagtctcatcccatcttgcacgataggtgccatttatgtggatcattaatttgacggtacccgatgcctgtaaagtgagatcaacaaaaaattgattatatggttcaatggtagtcaatgttcacagctaatgaggttaaaagacttagaagattagtcaaacctcatgaaatgacacaggcccagcccacccacatagtgaagctccccatatctgccaagatgaaatacatattaggtgctatgagtaaattatagtcatgtctcatgactagttgaaatagcacagtacccgaagcttctgtcctataaaaagttttcttttctctagttgctccaaaagtgccagatctaatgacgcatctagagaatacctgcgaaaaggaaaaggttctaacatctttcagcttcaactcgtgcaatacagagaaagcaaccacataccatccatcagttagttcaatctttgtaggcatgttccttttagcaggtctcaagcttttattctcactgttgtcgtcgtctgtatgtgccctatcatcctctggcttactgttgtttaggtcaggacaagagtaaatagcagaaatgcacagcaccatcatcaaagatggtgaagcattcccttccaaaattttctttatggctgagcggtggccattgttcacttctctgtcatacctaacatgcttgaaattttcattaatcaatcatatgcgtccatacagtaggaatggcagaaaaggcatgtcaactatctcacctgtacttcagctcttccaaaacattaccaacttttaagaatttgccagcagctctagttggatagcatctctccaatgaagcaagcttccaaacaatccatttgtagtggttgctgacccatctaaaaaggaaattttcgagtgttgatgttcaggatttaattgccatggagtctctcaaagaatccagcctaaatactatgatatgcccccaaggaatgcattatcacacttataaatcgcatgccataggaagaacatgtaaatccatttgttaatcctaacaatgttttgctatggaacagagacagaaaaaagaatggcaccgaggagacatgaaaaagatattcacaaattatgccttcactagaaaaaagtgaaacagtaaagtaataacaaacatgtaccagcatctgaaggccaaccttgtatagtgatattatcagtatgacaatgaaaaacgacgatcagaattaagaatgatgcttactctttagttgtgtatgtcaatgaagcaccacaggcaagaagcatcttctgaaattcttctgcaccagtatctgttttaaacttgtacttctcagccttttttgcatccatgagcttcacttcatctgttacatcttctgtctggtcacaagagttataagttaacaatgtgaagaatatagtgcacctacagaaattaactgcaacacaataaataccaaatatttgaagcatgggggaccaccaaaatactcttcacacgattttctttgatgttgaaaaggatagcatgaagatagctttgttcgacagggattaatctgaataggtagtttggatactcctgtgaaaattagttcaactaatcaagtaggaaggaattttcagaatgttctgacatgtctaggccatcagcttaccagaaggggatggattattgatgttgataggtgcgatgaacctaaccagtttcatcaaggatgtcagaagcaaggtagcaaggactttccaatttgctaacaatgatgcaaatcaaatcacctggaagaacgaggacgtttaaagggagatatggagtttcttcccccaaatcttctcttctcaccggccaggtagtcagtattaacagaatgtgtaccgatgtaattagtgatgtcaatcaatggtccagatggcatttggagtcttcgagccttatctttagtgtcacttgcattttcagttccaaatgaacatctggaagaaggcttggatatctttggaatttcattgataggatgaaaatctcttggcgcatgaa

SEQ ID NO: 57606 - DNA, 1960 bp, Oryza sativa
  unsure (1)..(1960): unsure at all n locations
ttcattttggcgtgtttaattagtataaatttatcataataaacataaaattctagtttatcgtgcttctaatggagttgttcagttgagaggttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaatatatatatatatatatatatatatatatatatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaannnnnnnnnnnnnnnnnnnnnnnnnnnnnnnnnnnnngcgggaggtgaatntcaattcaatggcacgg

SEQ ID NO: 57607 - DNA, 1182 bp, Oryza sativa
  unsure (1)..(1182): unsure at all n locations
cgcggcaatggataagcgntttgagaannnnnnnnnnnnnnnnnnnnnnnnnnnnnnnnnnnnnttacacggcccaacagaaagcccacctatcctctccccacggcccaatccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctccccttcccgccacctcgcgggggtgagaccaggccttcgcgaccctcgccggccgtccctgagcgccggccgcaccggcaactcggtttcgaggctgatctcggcaggtttgtgtctgccctcgatccaaaaccggtgctgtggtttggttcacgatcccgttaaagttgtcgaatccggtcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgntggtcttcttatgtctggtcctaaccctttcctcgcatagcatttgtattctataaactgagcttcctctttattttgtagaaagaatgtatttgt

SEQ ID NO: 57608 - DNA, 8425 bp, Oryza sativa
ccccactgctccccagcgacagagctcacagctgctgcccctccccacctctcaagctcaagctgccaactttttgtttcaataacccaatcaccgagcttgcgcccagtacattgctctgctttgctcagaatgggaaaggggaagaaagaagaggaatgtaaggatgacagggctgggttctgtgatgcttgttgcctcaaaagtcaaaacatgaggtttagtgaagcaaacatcataatctggggggtttgaatcttaaaaatatggcatgatattgcacctgttacaatgaaatctagaaaaactccctatggtaacatataaatctttctcacaaatgaaactccaaaccaagtagcatggattaactaaaagccgcttgctaccttacccacatcaaaatttcaccaatgcttccactaaaggaagtcacagttcaacatttagctggcattccatcttaacagcacaatgtgaacagtgataatgcaaatcaaaccaagcactagttttcctccctcagtgttatggcctggtggaagacacatgggctgtatgcagagccctgggccagagtgtggtaggccaatgaagaaaggtgcaccgatactggtgcagaggtttacaggagggatttagctgttcctcctggaatcattcttaggaataatccttattcaaatagtgaatctttttgtaacgaacatatggtagccaaataactatttgttatggacttatgggcgcaaggtctaggctcacaccatgtattgctcatgtggttactgtaacaccacggtgaattttaaattttagagatgacattacattagtatatcatctatttccatagtattggagagaggtttcttaggggtcaatttatcatatctgtggaaggatatgttggcatctcttttcattaaaaaatgaaacatcaataattagtctaacaatcagggagaagcctactagtggctacatgagagaaacacccctggtcttcagaccctaccccaagccctcaccactcatcaaggaaactccccccaagtcccttttcatttctcctttttaacatgtgctactcctggaaacccacactcaagccatctccttcagctcatgctgccacacagcagccccacatcgcaaacaataattcctcatcgtgatggaagaactatcatatgcaatcaaactatagctacatagtttcaccagcttcttaaatagataaatataaaataccactaaatacaagtgaaagagagtaacaagcaactccacagagtaaaaatacagtatgccatggtttctgatttaataatctcaaaggaattcatgaaaaagaaaacaaagcaaattttctgttttgaacacaaaaaaaactagatttgctccaggacactaaatttatggcatttgctctacgacactctagttttgtggatttactataggacactctagttttgtggctttgccaaaagactttcaagccattattttaatatatcatcttccaattaagagatagaactttgcaaaagatgattttagccttggaacaccttgcaaaattaaaatttgaacacatttggctgaactttaaaatattttgcaaaaatcaaaacttgttacaaataacagaaataaaaaaaaactaaacaactttttgtaaaaaaaaaaattagttttggataacttttaaattgtgcaaaatgtttatagttagccaaaatttgttcaaatttaaactttgcaaggtgtcccaagggtaaaatttgcagagttttatctcttcactggaagaggatatattaaaacaaaggcaaattttgcttaaggacatagtaacttcgtggttttagctccaggagacggtaaaagtcgatctttggtggaagatactctcaaacgttgttatttgctgttggacaccgtagtcattaaaatattaatttccggttgaataggagataaacaaaacgaaagatcaaaaatgcccctgagcccacttgtcatattatttctcttcctatctctcttcatcaagcagtggcacaaatgtcagggaccacctctcccatctctcttcggcaagcagcggcatagacgcacggtagtgcaagggggtagctgtggcgagcagaggagctggtggacgcatggcgagtggcagcacataagaggagttgtggcgtcgtcgccgcgggcagccgcacgatgagtggtgaactggtggtgcaggtggcagcgcaagggattttgtttgttcttctcagctttgccatggattggcacattactcatctctgcttgctttaattggattcgcctatacatgcttgcctctgagagaattaaatatgttttgctttagcatagtgagcagtgtgggggtgaagccgtgggggagatgcactcgacctatgggcggtgaccccagatccgtcacagtgacgtgttgtgctcatggacaatgttgtcgacgccactgcgagcaggatggtgccatcaccgaagcttcacctgccactggcattggaccccaatccctaccagaccctaccctgactcgactcgaagagggcagcggggtattgcaaatgggccaaacaaagaggaagaagaagaatataacaagtgggtccaggggcatttttgacctgtcacgttgtttatcactcctattcaatcaggaaataatattttagtgcgtgtagtatccagaagcaaataactacgttttgagagcgtcttcctccaaagatcaacttttatcgtgtcctggagctaaaaccacaaagtcaaggtgtcctacagcaaaatttgccctaaaataatggccagagtgtcttttggcaaaaaacaaaaaaactagtatctcctatagcaaaaccaaaactagagtatcctagagcaaatgccatgaatttagagtgtcctagagcaaatttttcccaaactttttattagaaaaaacataaatggcattctgttgacaagtcacatttaaaggcatttgaagaaaagacaaaaaatgtttgcagtggaccaagatgaaagaagcatcatgcacactccaaatgttttttacttaaatcgaagacctgccactaaagcaacctattatccaggtatcatagtaagaacaacagaaatgaatgcaagagcaaaaaatctaggttcacatttttcagctttataatatctaatatttaatacatctctatatacaccatcccctccatctgaaaataataagacctaacacttcccgtaaatctaatacaactctttggtcatcaaaaagataaatttacaaaattacacagtccgcataactaatagggaacaagacaattaaggctgtgttcttttgctgactttcccaactcaatcccatcgttttccgcgcgcacactttccaaattgctaaacggtgtgttttttgcaaaaaaaaaaaataaataaataaatctatacaaaagttgcttttaaaatcaaatcaatccatttttcaaatcaaaagttagctaataattaattgtgcgctaatgagtcactccgttttgcgtgtcgaatggattagttccccaactcactccaacgaacgtagcctaagattttattttacagaaccatagaccaagtgtaggattgtgaagaaattacaccccatcacatggaacaggttttgacaagacaagccatgtatcagtgtcatggcattccttcaaatgagctggcctgccttgtcagaatcccaacaaccacaatggatatggagttacttgacaactctgaggtaaacatataactctgagaaatgcaatgtcaagtatgcagtttgacaatacttttgccatccaaagtataaattgtaaactaagaattttctctcccctatgtacccttgagaattcgttcaatcccttatgtacccctgaattttgcctcatcccttatatacccctgagtcttcattttgatctcctctatgcccattccgttagttgaccgttaaatgtttttgaaattgtctatattagccctcacttatacttatgtgctagtttaatgataaaacacaattcttatatgaaaaaagaactatttgtaaataaactaagggaatataattatttgacaacaaattttaaaaataaatcaaaaaaaattaaataaattttaaattaacttttatgaaattcatacattgttttcatcaaaatttgaacccaacaaataaataattttggttcataatttctagctaaaactcttatatggattttgtccaaaaaaaataaatttgctcaacaatttatattttcatttcaataaataattatgctccatttgattttatcatgaattacaatttttcacattgtgaattatgaagtagagtagatagcatgtaactgtaagtatgggaaatgggtaatatggtcattttagaaaaatttaacagtcaactcacggtcaactaatggaatagggatagaggagatcaaaatgaaaactcaagggcatgtagggaattttctctaatattagagaaaatcagatggcgaaacttttcaggggcatgtagggaattttctcttaatactactagcagttactactgagtgcaggacttgaacaatagcaattgattaatcaattgtccctttgttttaaatatatgaaataattgttcggttgtctaagtatgaaataaataagtagttaaacgcttcaatcttttgataagttgttcccttctttgtattagttaacaaggagtaagaacgctagattgagtgaagtgttgggtagcacccctctaaaggtgtcctttagaagggctttggtgggggaaaaccttttagattggtataaggtagtggctaaggtggctttgataaagctcttgaacgacccagaccgattcagatggaaagcatgtggaaatagagcatttttcagtaaattccatgtacagatctttaatgtacaggaatgttgtgccaagaaagtcgataatctggaaactaagaattccaactaagattaagattttcttgtggtatattgagaaaggagtgatcctaactaaggacacgtgggtgctccgcagctcgggtgtgcatgaggctagtggtagtctggtggagcttggctgcttgggcacgacagccatagctgctctggtccgaatgggaggtgacacaaggtgacagcaggagaagatggaagagattagagcagatttggtgcttcacacggcactgtggcaaaggagggattaacttgactaggcatttttgcaaagcccacaaactttgtggtaaatataagtacgccctcaactgcattgcgaaggagcaatcttctcttatttaagaccataaaattatttaattggatcagatttacaccctatagttagggttagatgatcgtttcgataacaggaccaaactcatggttgttttgccatacaagaaaccaaattttgcccgtattagaaaattcagctactggacattccaaaataatggtctttgccacaagacaccacaaaaatgtgggtttgctggaagacactctgaaattacagttatttgctggtggatgctgctcacataatttattgtttttactcaagtgaggagagagaacacttgcaaaatgtctatttgcccttggaacatgtattattaatccctttttgctttacatagtggtgcggtgcctgggcccattttgaaaagctaaataaatagagaggggagaaacagattcgaactagatggagaaaacaaaaggtagtgacatcatttttcaaagtttctctctcctaatcatacattattttgattggagaagtgtccaccagcaaattaccacaaacttaagtgtgtcttttagcaaagccacattttccggtgtcttttggcaaagaccacaatttaagaatgtagcaaattttgcctttttctatgtggtccacctcaagaatgttttcatcaacatagttgacctgtttcatctatccgtttaattatgcgctctgtttttactcttttaatcctccatcatcttaccttaattcccaacagcaaataatcaatgttaatgtagccaacatgacaaaataaactggagttcgctcactgctaacaaaacctccaaaaccgccttaaggtttgtttggataagtagggatatctacaatctttaggactggaagagaaattatactgaaataaccaatctgaaaggagttaagaggctttcatattgccaaacaagttcttagggtgtaaactgatccaggtttgtgggcttagggtggtaacaggttttaaaattcaaggcataaaatggactatttgcagaaattacagagttaaaaagtgggcctatttcagtgacaaaaacattgatttaagttgaaagtttattatctacaatcaatcagcaatgtaaagtttgaaattcaaatagcacttctattttggaaggcttactatcaccctacattgtgcaagcatggcaagagtagtgctatatgaacaaaattcatgtaaaatactggtaaacagaactacatgaaatggttaaaggaggtatcttacttaaagataggttttggccaattctgcctgctgcattgctcattaagcttctgtttgcactccctaagctctccaatctcatcccccaatccgttgccaaccccagttgttaacacttgcttctttgcacctgcaagcttccttgttgcatcccgtgcagcattaagcttagcaattaccttctgctccgaggaaccaataccaactagctccccagcaacaaatacattgaccactgtcatcccacctttttgccatgtcttgaattgtgccatcttcccgtgtttctggcatagttcatgcaacatagtcacaggttgctcgtctattgtttctgctgtaataattggctcaaacagccaccttgtgacctaaatcatatacaacacagctattactatcaccaccagtaaatccatctactctatctatctccgtgtatgtgtatgtgatcataaatgttggcttagatatcatgcagttaaatttctccttttcctcaagggaccatcaaaatttcctaactgcacaattgtaggtacatcaatatgatattagtcatatgataaaaaaaataccagacgcttcccataaataaaattgtttatccaatcttttatgttatttgtattaacagtccaccttatttcttggaggccatgtaaccatgtgagtctctgaagaatgtaaagaattgttagcagtagtacaccataaagtaaaagctaagaaccttccagagcttctcaagatcaaatttgcaatcaacatagacagcagcagcaatggcctcaacaatatcagcgagcaccttgggagccttgacaacactaccaccataaggtacagtactaagatcatcctctggctcttgcttcactgtttcaataaactgacctacctgcattattagtagtatagccaattacagaagaatgataattaaaacattaagtccaatatctacctcataaaaatataatgtagatgtaatagcagaaaaacactaacagttcagagcacctattcaaaagcatttctatagtgtcaacaaacaattgatacaaaatgatgcaattcattcgaaaagattaaaatttgcatatcaaattcccgttatgaataagaggtcaaagacaatggaatttgagtcagcatttttttttcatttcaggtagaaaccaactgttgtccagaatcaacattgcttccttttaactacatagtcaagaataaagacatgggcttaatttcaaagttgagaggttgaactttgaactaccactacacctacggtgtccccttctctttttattgctcaaggagataaaacatccagttatagcagtatactaagcattggaatggacacaaaaaatcttctatggttttcacaggtttggaagaatagcacttagtacattcaaaagatatattaatgccattacttgcttctttttctttctataaatgctaaacaccaccaaattgcatataaacagtacaaaggaaggaaatttctaaaaccataagaaagagaatggcgtccatgtggtctaaagtttaagagaaacatatagtacatgaaaactggtcttgacgtttaaaatcaattccgagtgtcaagccgggagacaggaattaaaaattttccaatgggcgattgagcacaccagtttatcccttccttgatataaaccgtgaactcacttatgacgcaatggtctaagcaaagtgaaaggcacaaccatagcatttgtgtgaccacaatcttacttaccatg

SEQ ID NO: 57609 - DNA, 10239 bp, Oryza sativa
aatcaaaaatcgaaattgcatgattctccaataagagaagagatggattgtctcggcacgtacgaggagatcgaggcgggggcagttgcggcggagaagcgggtagaggtcgtggcgcacggcgacgcgcgcgagcttctcggtggagatgttggcggcgcggagcgtggagagcgggccggggccgagggtggggttggtgaggtagaggaagttggagaaggcgaggccgagcgccgagtccccgacgaactcgagccgctggtaggagacggcgtcgtcggcgaaggactggtgcgtgagcgcctcctccagcaggcgcccgtcgcggaactggtagcgcagcagccgctcgacgcgggccgccgcctccgcgcggtccgccacgaagcccggcgggggaagctccaccgggtccggcgccggcggcccgcgcttccgggaggcaggcttcatcgccggtggcggtgccatgccgtcgagcggtttagggtcttaggggttttgggacggcgtgaaatccggagaatttcaagtgctgatatataaaattttccgaaactgcgcagtttgctctcgggagattttcagatttttcgaaaatatttttgaaatttccaaaatgttattttgcctagtttctggaagtctccatgcggggaccgttcggattttctaaaaaacagtaataatgctgtgcaagacacgttttttactatgtactaatatctatatctatatctatatatattgttggcggtatggcatgacgccattcgaccaaacctgccaaaatcatgcgaagagtggggattcaagcccaagacgtcaaaattagttagggcgaagtccccccatagcgaagactatggaacaaggagaggcgaaggatgcagggcgaagagtatatgccgaagggagacgacttcgccatagcaagttcgccctcgcgaggaccgaagaagcctttccggcccatcaagcccaggggctattgggtcgacgatcgcccgacggcccatcaggggaccatgaaccacaattacactgtgtacccatgtaaatgtctctttctaagggcaaccatataaattctccctgtataaccaaaaccctagtagtaagaatctgtaatagtggctataaatagtcttgtagggtcatgtaatagggggatccgaagaaaaattctcaaattagtacagtttacttcttttccaaccactgttgagtaaccacgtctttcgacgaatgcggttgtcgtttcgacaacagctagcgccgaccgtggggatctccgagcgaaaccattgagagcgaatgctaccgaagaaggtcgtgaaggagaaggttacgaggcgaaaggaaagcgaagccagggagatatggccgccgaatagggagcagagccttcggcgcctgtcgccgaagatggaggagcgccatctgcttccgcacctacgccaccactactgccttcggcccctgccgcctctgcgcaggtgctgaacgcggctgacatggcgaaggcggctgcggcggcaagggcactccaaaccagagcagagatcctttcgacaagctaactgctggtgccctaagccgctccgtcgcagccggcagcggcctcaactgcgctcgccgcagtgcaagatcaagtcaatcctgaccccgaaacacaaaccgaaaccaacatggaagccatgcgacataacatgacacgactccaagacatgcttcgccaaatgcaagaacagcagcaagcatacaaggcggcaaggcggtccaaggtcacttcggccccaatcctacagtattcggcaggctatgtcccaccccaagtctatccacaagcaccgacctagccccttcctccaccagttgcacaagcgccaatgtacttcgccggacagccttcgaccgcagcagtgcatccggcccctcacgtgcaactgcaagctcaaccggtcgctacccaagtacatcctcaaccgcctggccaagtgccacaaacaatggcagaaggggcttcggctctgcaggcgcagctccaagctttccttcagcaacccagccaaccccacagcatttcaggtacagccccttcggcccacccggaggggaatacaagtcaaggtgcgcctagttggttgccgtcgaatcagccaggtctgggggcttcaccgtggagtcaaggaccgcagttcgacttcatcaatgcagctcaagcaccagccgttcggccgcaagcaccaacgccaggcttcggattaaaccaagcaccaaactaggtcgccatgacatggtcacaaccaacgttcgacccagccatggcagctcagctagcatcaccaatcggagccgggcagccgaatgccatggcccaacctcacgcgcaagccgtgatttcgcccttcgccacgccgtacccacagcaaggtgccgtgaacagggcagggggtgaaaaggggctaccctgagggcccctttgaatcgtaggaatgaaaaaacagaggaataggaaaaacacagaattctgataggaatacaattgtaaaacagagaattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggccctgagtgtgggaatcaagacccatccaatcccgccccagttcaagttcccgcccatcccatgctactcaagcgaaactaacccaaaggaattcctctccatttatgagtccgcgatcgaagcggctcacggcgacgaaaataccaagacaaagataatacatctcgctctagacggcatcgcccgttcttggtatttcaatttgccagccaattgcatttactcatgggagcaattgcgcgacgtctttgttcttaactttcgaggcacctatgaggagccaaagacgcagcaatatctactcggcattcaccagaggccgggggagtcgataagagagtacatgcttcgcttctcgcaagctcggtgccaagtgcaagacataaccgaggcgtctgtcataaacgtcgcttcggccgggctacttaagggcgaactcacaagaaaaatcgccaacaaggagacacagacgcttgagcatttacttcgcatcattgacgggtttgcaaggggcgaagacgattccaagcggcgccaagcaatacaagctgagtacgataaggcttccgtcgccgccgcccaagcccaagcacaatctcaggttgccgaaccaccttctctcgctgttcgccaaggggccgacatgttccgacccaacgaaaagcacacgaagtgacaatgcaaaaatagcgaaaaggaaataaaacgcacctttattgattttgaataaaaatgtatcgaagaatacaaacccgtcacaatggtacaagtgaaaagaaaagagcaatggcgttacagcctagcttacagataaattacatcttcgcccctgcgatcattctttctcactaaggaatgatcaggcgaactaggttcgtcatcgctactaatatcatacacaaccataagaggagaagggggcaaaacacagactagactgtaacgacgttgggagatcgcctcctgccgatcagtcttccgatagtttcgccaaaagcgagccatatcctccaaacgtcttgaatgaacaagatcttagtcttctaaggttcgcccggggtgcgcccacagccacccggcaaccttaaaaaccttatagctgcggccgtttatcaccatttcgcgataaacaggccgaaatgggcatcgcaccttcggcaaatccttcagtgccacaaatttctcgttttggcttcgccaactcccagaagggggccgaatgcacaactttcggcgaacaccttgacagacagtgcaaaaagggcaaaagacgattttcatagtaagaataggcgaaaaaaagagaaagtattgcataatgtgaaatgggcgtaatcataatacgccaaagacttcaaccacaaaaaaaaggtggctaaaagtgagtcgtacattccaaatatccaaggggccctttttcggctacaataaggggggttagcggtggcttgccgaatatacatcgttcgccactcccggcaaacacaaaagaagaagggaaactacaaaaatctaaggaaagggcagagagcctcacacctctgggtgatcctgggcatcgcctccacccgcttcagctgccgcgtcctcttcttcgcaccggtctgccgtctctgccttcgccagttgctccaaaaggcgcgccttggcagtggaccggccgtccttctgccagaactgttttcgccacgcgcgaagagcgggcgaaatgttctgcgcactgatctcccaatcccccttcgcatagttagggaactcgtcgacgtgctcgcagtcgaactgttgcataaggcccatggtaaaggccgccgatacgcgcgcacaacaatcaccgtacgcagtggcgcagtccgaaacagaaccaccagcctgttgggtccactcggagaagtcgaaggccgaggcatcttcgacagggatccctcgcacctttgcacccatgtcagtaagggcgaggcggagagtttggcacgccgttctcgcggattcggtggttttcgccatctcccgcaaaaaccgctgcgactcctccacagcgctcgcttcagccttgctgaccttcaggcgaagagcctccatcttcggctcagtgaggttataataatcggtcagcacggcggaatgagccttttctttctccagctcggccttgaggcgatcaacctcagccctcgcctcttttcctttctccaactcggattagagctgcttgttttcggctttcgcctctttcaaggtgttggcgagggcttccatctccaagttcttgcggcctattttgtcgtccttggcccgaagacggttcttaaatccgtcaagacaggcccgcaaggatctggatgcaagataggagcaggcggagagaccaaatgttagttatgggacatgaaaaaaaagaagaggaaaatcaagaagagagaaaaagcataccagaaccgccaagcttttaatagcagaacaccactcatcgaactcattcaattcggtgaataggctcagggtgctggcaggtaaggcaagattgcttactccctcgacaaagggaataaggtctgcccgggtctcgaaatcgctaggggcgaagtggggcgccgcaagggaatattccgaggtagaagttttgacggccgcacccttccccttcgcattgactagcggtgaaataactggctgacgtcgagggctaccgaagaccctcgccgcagctgtcacgatacgctctgcggaggctgaagccccggcggcggcgctaccgcctgccccatcagcgccgagtgaaagaatgggggtggtcgaaaggtccaggctgcggccagcgggcgaagtcggagtctcgtcagaggactcgtcgtcgctgaaaatgcgagcggcatcgacgagtcctttctttttggagatctttttgaccggacctcccttcgctgccttgcctgccgaaaacgcaactagcagcttcgccccctccaaatcctttcgacaaaggggggagctgttcgactccaccccggtctcgttgtgacctggacttggagtaagagtatagccaggggtgtcgacgcggttttcaacagcctcatccgcggccttttcggccatgacctccgcccctcttcttcctctccttcctcctcaccgtcacgctcttcgacatcgtcctcgtcatcggcgtcggaatcggaggaagcaggaacccttcgcttcctaggtgcaagcttcacttgtccgcgtgttcgctttctcgaaggccctgcatcgtcgtcggctttgtgggggttcgctcggggaggcaattcgccgttgtaaacccggttcgcccggccagctgcttgtcgtgtcagcaactggctatactcgacgactgacatgtcgccgatcatcctgcgggcttcggcgtcagcctggtcgagggtcaacactgcaaaaataaagggtgtagcttcattaagcgtcgaacaaaacaaaataacaaagcgcaggagtgcatagcgaaagagcagtcttaccgttcgttccctcagggataaccaactcagcaaaccgtcaacctcttcgccatgatcaactgcgacttgccatgactaggagaggggaaagatgcgaagcatgcagaattcctccaccaagtcgcgacagctaaggcgagagcaaaccttacgcagcagagcgaaccgcgcctccatagcgccgcccacggcgatcttgggttttcggttcggcgcaatcgccctgcgccggcaccggagggccttcactgagtcagaaccagccttgaaggggatggtgtggcaaaaccaccacgccatccaatggcggtcccacttcgacatggcggcgttcaccggtcagaggtcggaccgctcggtgcgaacattaaagttcacactcccaaacactgttttcttcgttccagccgggataatcaccgtctttgaattcacggtggtgaaaaatatggcaccgaagagttcggcactaggctcaaacccggaagtccggcacgcccagtcgaagatagcgatccggaccagcgccgacgggctcaactgtgggagctccacctagaaaaggcgaaggatctccggcaacaacgcgttgcacagaaactggagccccgcctcaaaaaacacggcgaacaccactgtccagttgtcgacaggcttcggcacaacagctttccccggggcgaaagcctgcccttcgactaacgccccaaagctaaccaactttgccaactcgccgtcgtctatgagtgaaatccctaagtaggcggtggtgtcgtcgtcaatccggccggggtcgggccctttcgccgaagaagggttaggcttgcggggagccatgacgaaggatatatgcagtgacgaaggatatatgcagtggcgaagggtgtgtgcagtggcgaacgaagggggcgagcgaagggtctaaagggccaaggggtgccataaaagcaagaacggaggaagagcgcgtgagcggtgaaagtgacaagtctggtggtgaaaagggaacggggggagaatatatagaccacccaggcgacgtttcgcctacccacaagtaataaagcgccacgtgtcgcgagggtaggcgaaacggtagattcccatcgaccgagttgcacagtaaaaagcccacaaagggagggcccattactattcctttcggcccgggaaaaataaaaataatataccaccgtccgcaggaggcgaagagcggcaaaacaataccagccgcacagacaacaaactctatttgcaggaacaatgtagatttcggcaggagcatcggtcgaaagggggcgccacataccataccacatgatttgcacggtctcggccgaagctccaatctcacccttgcccatgaggggcttgttggcggtatggcatgacgcccttcgaccaaacctgccgaaaccatgcgaaaagtggggattcaagcccgagacgtcaaggttagtcagggcgaagtccccccaaagcgaagactatggaacaaggagaggcgaaggatgcagggcgaagagtatatgccgaagggagacgacttcgccatagcaagttcgccctcgcgaggaccgaagaagcctttccggcccatcaagcccaggggctattaggccgacgatcgcccgatggcccatcaggggcccatgaaccacaattacactgtgtacccatgtaaatgtccctttctaagggcaaccatgtaaattcccccgtataaccaaaaccctagtagtaagaatctgtaatggcggctataaatagtctcatagggtcatgtaatagggggatcggaagaaatattctcaaattagtacactttacttcttttccaaccactgttgagtgaccacgtctttcgacgaatgtggttgtcgtttcgacaatatatatatatatatatacatatgtatatatatatatatacatatgtatacatatgtatatatatatatatacttatatatatatatatatatatatatatatatatatatatatatatatatatgtatatatatatatatatatgtatatatatatatatatatgtatatatatatatatgtatatatatatatatatatatatatatatatatgtatatatatttatgtatatatgtatatatatgtatatatgtatatatatgtatgtatatatatatatatatatatatatatctttatctttatctctactacttaaaaaataagagatgtttccatcgtccgtcaaaaaaaccagacgaaaaaaaccgagtgaaaaaaaccggaataagaaaagaaaaaacaaacataaaaaaacgcaaaaaaacaaatatgtctgataaaaaaacccaggcaaaaaaaactcttaaaaaataagaggtgtttccatcgtccatcaaaaaaaccggacgaaaaaaagggaaaaagaaaagaaaaaccaaaagataaaaaaacaggcaaaaaaaagaaaaaaagaaatatgtccgataataaaacccgggccaaaaaaaaccagaaaaagaaaagaaaaaccaaatctgtccgatccaaaaaaaaaaggcgaaaataagggaaaagaaaaatgaatccgactccgtcaacgcggtaaaaaaaaggcaaaaaaaaattaaaaaaaaatctctccgattctctatctctatctctatctctatctctttttttaaaaaaaaatagatgcttccttcatccgtaaaaaaagatagcgaaaaaaataaaataaaaaagtccaactcatatatccgattccctcttacaaacaaaaaaaaaagtccaactctagattggtgaaaaaaattgatgcgccggattgaagatctgtttgcaaaaacagaacctccaggtcgacgagagcattccatttttatatgtttttaatttttgagtttgtacttttgcatttgagtccctgtaatttttatatttacatttgagtccctaaaatcttgcaataaggtatttgaggttgtttttgttaaaaaaataatataagagagagaacaaaggcagaaaggtgcataaaaagaaaaagaaaagccgcacaaaaaagaaaataaagaaaaacaacaacaacaaaagtctttttcccctaagtggtgaaaaaaaatgtagatccgaacggaaaaaaaaatctgattcatataaaaggcaaaaaaaaagtgatgaaaaaaaaaggctagatccgattcctttaaaaacggaaaaaaagtctgattcctataaaggcgaaaaaaatctgaaaaaacatctaaaaaagttcgtccgattccttaagaaagtggtgaaacaaaatccgatttctaactgtcgacgtttgatgtcgcgattccggtatttgcatagtatggggatcactggtactaggatatatgtgagactgaggtaaaagagacggaggcgaggatttttataccctacatcctgttggccgaaaccggtcgttgctcttattcatcataatcacaccagtacaatatttggggtagcctatctaactgttgtcgacatgacggttcgaaggtctgactcgtagtcgacagcagggtagccttcctcctcgaatgtgtgcccggcgagatcaaagataacgctttcgtctctcctgacagtatccggagacaccgtaggggactagccatgcttatccctgaagtcgatatccgacggcttgtcttggcgtatattggcttgtatgttgatcttctgtcttgatctattgttccgtatcttctatggttgtggtgggtgtgtcccctttcctcctagggggccttgtatttatactcataggtatccccttgtccaagtagaactagggaaaccaatatggatagaatccgagtagtccttgtcgtttcatgtagaactctagttgtctttc

SEQ ID NO: 57610 - DNA, 1198 bp, Oryza sativa
  unsure (1)..(1198): unsure at all n locations
cgcgagtgatttcgcttgannnnnnnnnnnnnnnnnnnnnnnnnnnnnnnnnnnnnnntagagcttatgaaagcaatagatcaatatactataaagaaccaagttgctatctatttaaatgccctaatcatatttactactgtacacaaaacataaactgcatcaatgacaatgagaccaaataacattgtgaagtagcgtgaaaagagatggtaaatgaatctggattccttgttgatagagcaaatattaattcaaaatttgagtttgtagaggaaagtcaagatgacacttgaaggcagcatggaaagagaagaaataatggattaacacatattaagcatggtattaggcgtacatgtcaatacttttccggtggacattccgttttgcctattggaatgaaacattttgcactggacccatggaccataccagtgtagattgattgattttaattaaaaatgtaccggcaggcatacagctatcttttttgtacatattggagtatacacaacatttatctagccatgactgtgtttgcaaacatattttggtgcgagttaaaaatagagaaacaagtacgaagctatgataaaggagcattacaagaaatcatgattgtctgcatattacaattctctatattgcaggtttgccctctagctgtgtagtaggttgtcacaagattaatacaagaactgccggtctgtgcaattagtaatggttgttttgaagcatgccgattctcctgctattcaaggtgaagcacaagtaccctaatgcctagaagcgccaatttccggcagaatttaaatgccgacatgaacagccttaccgatggaaatggattttcgcctggtttttggttttttctgagaaacaaaagtttcggagatattggtgaaacaaaatgtgtttttaggattgcccctgttaatatatttccgggaaggggggagcaaccctatggggagaattgcgcccaataatattctttaaaaggaggttttccgccaaacccctttggtcaaaaaactggtttaaaatggaaaggagggggtacccaaacactttttggaaataacggtttctaaataaccctggggctcttcttaaggtccaacacccttttttagaaaccttatctgtttggactaaaacacttacaagacaattccttttttgaaaatttgta

SEQ ID NO: 57611 - DNA, 11750 bp, Oryza sativa
tacatacatacactttagtcaatattatctactatataattatatagccaataaccccttacgtgatacttaggcactgagaacccgctgttcccagatgtcgctctactacatacccggacatggaggacttaagtactcttaagggctgtcaccacctctatatccacctcaaacataatgtgggatacgcaacaattactgaatattaattacctaaacaccacgtctaatcaattaataataactattatagtatttataactcactaaagtaatcactatattttagttgattatagtgaacaataatcgcgtatgctgattaggaactaaccaagaggtaattctcacaagtaaatctaaattactcagaaagatatttctattgaaaacagagtaattaacagaataaaagaaatatgacataattaccgacaactatggaattcctccgacttcttctactctactctcttcatctcttcatatttctagtatacaaagtggtacaatatagcctcttataattcagctcaagcttggaagtgtgtgttgagagtgaaggagtggagctcttaaataggcaggtaatgatggttgtggaacgggaaatgtccgaagtgccctccaaccgccatcaggaatgcatctgggatgtccatgccaaaccacaggatcaacggtggagatcctggttcggccaaacctgggctagcccacttggcccccagctttggccggtggtctcctcctgttctgccacatctaattctatgagttttgggctgattttttgggagtttaagagcccattcttgaatggatggattccctcttcactttaatctgaatttcctcccaacttcggtggtctatgacctgcatcaaataaacaccaacatttgtagaatattttaaaaataaaccctatcactatgttggttgttttattatctaagttttatgtagatgttggcggtataaaatttgcatttaacagctgccaacaaaacccccacacttagctctttactcatccctaagtaaaggttaagaataaggctccgtttgacagcggcagttcggaacctggggttggggtagggaaccagtggcactgttcatataccgtagcacatactgtagattgatgtgaggacgcacgcacgtgacggcaccgtttcgaccactgacaatttctgtcaaacgcatcgtgagacattgccgtcgtgaggagtcctgctcggactctgagatgggaaaaaaaatcagcttgtgcaagccgtcatgtggcagtagtttagggtgatattttgttacacgttttgaagaaaaaaacatatgagcagtaatattggaaaattaaaatagagcatcagcttgtgcaaggcttttttaacgttcgtcgatctggtaaataaattgaaaaatatttggtgattatatttgactacattttttacatctttccactatgcttatttattttatatggcacgtgtaagcatgtttattaaatttgtacaaggcacatgtatttcatttttattgtgaaccgggaattattatagttcaaccgggtaactctttttgtatttgaatggccacatatttcttttagttgttcaatttaattaattcattccggacacatgccaaatcgctttcaacatattccgataacacgtgggaaaaaacatagcacataatggagatgactcagttgaaacatgattgtacataaacagataacgataaaagaaatacaaacactctaatttaataaataacagatactggtctgaatggagatgacatgcgcggctcatatcacctaccgatagtgattgtagacagcatcagcaatgcagtcacgcaatgcgctcatagcttgctcgctatttgttgcgtagtacatatgaatgaagtatggatgctcctgtacaatgggattaccgttgtacagaggatgattatgccggtagttcacatcgcgactatccttcttgaaattgtgtaaagcaaaagctgcttgtatgatgcgtgtgtgaactagatcgtcgtcgttttgtggtatttctttgaggattttccattgttttttaatgatcccaaatgttgtttcaataatacttcacaatgaggagtgtcgatggttaaatgtctcttcctgtccaactggttgcggtgcacggactccaccaagaacatccctgtggtaccgtacatgtgggtacggtgtcaaaaaacccattctactaggaaatccatagtccgcaagtaaatactttcctgcaaaacatatgataaacatgatcgcataaatgctcaattattaggagtggaaataaatgctctcttatttcaaaattttggatactcactttgcgataacctggggaaattgtctagataatattgtattgcttgattcaaaaccctttgatcgtgcactgagcctggccatccagcatcaaggaacataactcgaccgtcgtgatcacatacaactagaacatttctcgtcgtcaagtggtgtcggttcctgttgtcgatagatgtggctactgatgccacgatggacacatgcgtgccatccacagcaccaactgactcatagaatggtcagaatttgttcccttcaagcagcctaggatgagtgtacgtgaagttgggatcaacaggcttcaatatattcctagacaacgcgtgcatagtgttcaacactcggttaaaatagagcgagactgttgagctcgagcggacccaccggttgttggtgtctctgtttggacgatttcctgccatatatacaagaacatcccaagtgcctcaataccacatacctcccatgatccgtgaaggtggtatttactactcaggagatcatgtaaactatgtatctgctcagccttcaatcggaacatggccttgcattgcctcggattcgccatcgtctccagcatccaactaataccagtctgaaccggaactcgtcgtgcagctctctgattgagctcaagactgcaggctagcacgttgattatggcatcatcctcctcgctccaatcttgctctcctgtgccgtgtgaattccaatcatcgttactcatcgccgttggccttattatcaacagcaaagattacaatacattgaagcatgcacaaatattatattaaatcaaacatatttaattacctagaaaattgtatttaattcatacaaagttaatagtagcacatactcacgtgcactcactacttacgaaatggtagcatgcaaagttgaacttactgaacacatgcttatttaaagtaaacactcaacatgcaacattattacactcaacacattgaaattaaatgtccactgccatgagcactacatgccacacctaacgaaccaagtcctggagcactagaaccagcaccaccatgccaacctccaaacccagttgtgccctgtgaccatggtaccgctggcaacgattgggccatcatcaagatgtacacagaacgagcttcagcggtcgggagtttcatgaagcacgagcagtagtgcggataggtgaacactcgaaccgcagcgtgccaaaccggtccgggaacagggtgaccatcagcttccaccaactccatgcaagcctctgaacctttagacttcgcctcaaccttcgccctagccaggcgctccatcgactccatccatagtgatacaagcctttcaagggcttccccggcggagttgccgcgggacttctttgaacacccctctgaggcagcagtagaagtggcagccctttttcccttacccctcactgcactcgctggtgcggacggaggtggcaatggtggactgtacgctgctgtgagctgagcaatgtcaatggtttctcactgctgttgatcctgtgtaggggctggtactgctccggcgacatcggagtggttcccaacaacagtgcatcctttaaaaaccgcgtggtaagaatcaatgtattttagaggatcatttctaaagcaggcaacgcctttatacacctgccaaaattaatcaagtatgggctgtacattagaggtgttccgaaacatattaccaaaaaataaaaggcaaagtaaagtatatgttgtgatgcatttgtaaaatcagtaatcagtattcaaaataaaacaagaaaattaaattgaactattggcacagtcgttgtgatgctccaatctttgtgtgtgataatggtggatctgctctaatggtcatcttgatgacataagtaatctgaacaaaaactaatcttctacttatcgtatagacacataaatttatatcgtactagttgcacatactgttgtgaagccaaaactagtaataggattcattgtttactgaatctgagatgctcttgttcatattctaatggatgcaaatgcaaaacacaagaaaccaattatgctagcgcttactacaacctaatgacataaggaatacaactagttttcacccaggcttacttaatctgacatgatactaaggtaccagcaaagggaatcttttcacccaggtttttaaaacaagtgccattcagaatccatcaatttagcactactaatatttagctctggttatccattgcttgaaaatttatgtgtcactttctatcttatacaaggataactatcaactatgaatcacagaacatgacgctggccttgatcctttctaccaaattgcttgattggtttctggattggtttaacatacatagataaagccctcttctaatatttcataactgctgcagttcataaaaaatggaactattggcacacatatgtgttggcattagtatgaattacggagaagttatgctatttgttgcattatgaaaaaatgttcaagaagtcacatactacgttttttgatttccaccagtaggcgtcggcaacaatggccgatgttaccggatcacgaccgaggccagtagcctgtccttccagccacacccacatgttcaaccgcttgcgacactcgccccaaaaatacttaacttgatccccggttacccctttgcggcacttctcatacattttcttggccaagttgtcgtaagcctaggccttgggggtgttgaaggtgatggcgtaagcttgaatctcctccaagcagctttaaggaacacgcgtgtctccaaatcggtctagcgggatcgggggacagacatctaccaatcgaaggaaatgaaaattgatgcaacaaaaacataagcaacaagctagcattaccttggtggaatcaccgtcgcggacgatgtcccaattcagcgaacgaacggcggttgcagggctcactcggcaaacgaaatcgatgaccgcttctggagatttggcgcacaccatggttagggcattggcagcatttaggacatcgtcgtcgcaaccttggcggtgctggcgttggaggtgttggagtcgcaagaatcctcacccgactccagcttgtgtgcccggatacagggtgggaggtgtatccaaggggattgaacacgagccggagaggatgggatggccaacagctcgcgctctcgcttccgcttcttcccccttgtctccatcggcgcacccacaggctcggcctcaaatagagggcagctgagcacaccaccagctttgcctccttcttgcaacgaatctcgccacttctgtgccacacgggatgtacgaccacgcgcgccaaggacgatgcgtgcagcgagcacgccggccagcttgtaccatcttggaggatgacgcgacagatcaagagcactatgcactgctccgatgcagctcgaccgaatcgaaggaggacacgacgcttccggcagctttaggcatgcagctacttggaagagtacccgctctagccctagggaagattcgtttgggggcaggaggggttgcaggcgaggggaatcgattcctgccgccttggattcctctgctcacctcgacgaccgccgattcagggggaggaagaaaggggatcgaagggagtcgagagactggttgggggtggcgttctctcggatgaaaaacgcgaggtagggggtgatggatattgacggaaatcgtgggcctccaaaacggcaacgtgggaaacagttttcggtcgaaacagtgccgtcacgtgcatgcgtcctcacgtcaatctacagtacatgaacagtgccactagttcccaaccccaaccccaggttcccaactgccgctgttgaacggagcctaactgtagaatgaaatcttccaagatataattcgagcacataaattattcaaaactatacctgtacctgtgaactttagcaatggctaacttaccatcttgggtaattgataaatggaactgtcttgattcctgtccttcttactccttctatcagactcctggggtttttataaatttttgcaatagcacaaagatttaactcatctagttaaatcttgggtaatcggtagagttccccaagtcctcaatagtagtaggtgcacaaagatttaaaacattaagaacagctcgacggtgctattgggaagaagaggcgcgaggagtgcaagatggttgggccgggccggcagggtggtcgaaccgacggtagaccatagagcttggacatttagcagtggtggagccagcggcatccttaagcccgggcgactaataatgttttccgataatcgattatttttataggtgtcgatggctattggtagtggagacggcaacgatggagcctgggcggtcgcctgacctgcccaggtggttcaacagacggatggttattgcaggaacttgtggatgggtccaagagaaggacaagaaggttctacggtttggatagttcacaaatgtgaagggcgagtagactggtgacgacaggttagccaggtcgcttataaaattatctggcggagacatgatatatcagggacttgacgaggagttgagatatatgaagttagaccagaactgaagaaatgatcctggaccacagtgggggaaatcgttgagggtgtcaagaatttgcaaggtctgcatgatggggatatatagaatctgcgtcactgaagaggaagagcaagcgctatggtggtgttactgtgaaaacacgacagcttgggagatctgcttaactccagtataagtccaaggcttgcctcgagttctaatagcgtgccagctagtttgatcatgcaatcagcaaggaaacaacaagcaggattagtcagccgatagccgatcggccaaaaggccgatagcgtatatttagtagtcttagctgatggagttagactgaattggctatgggctggatagatcagagaatataaaaccttaaatatgccctatcggctgtaatactgtctagcaagattaataaaggaatttaagacaatattatgaaaagagctgatataacaatattcaaagcataaaagataatgtccagctaatactcttgtacagatctatataggcaaatcaatctataataatatatcaagtagagatcaatagtcaatattgatagcccagccgatatgacctaaacttgagatattactattaagtgatccgtctatatagatggcaaatatacatggaacagataaggaaacatgcatattaggtaagttcggctgaaaccccgatattgcccatattattagtcaaaataggctagatattatggttctaaacacgacttagtaagttgaatgtacttatgcaacactaagtatgaaaaaaacacaatatctagacaatcaagccgttgactaacttttcagggtggtggatgtctaaactaatctaatctagcaagaggatttagccgatgccggtagaaaccataaagggagaagcaaccgatagagctaaatcgatatgctgagactagattaacagaatgatagcaattgtcatgaaacaaggactaaaatatctaaaatgacataatagccccgatagcacaagctatcgagacgggttacctctgcaaagagaactcaccgaaaaaacaagtaaaagaaaagggtggcgatacgccgaaattaaattggagttcgtcctctattacaatgctatgggattcatatttataccctgagtacaaacttagtccattatggacacgactcaaaccttcctaaagctaagatatgaacaagaccatatacagcggtctcttaccaaaactatcaaaaccgacatattaatatataccattgccttaattgagctttatctctgattggcaatgacggttagtccaatctaggcccatgccgatcccaaataataccatatcggctgcatcggccatcagccttatcaaccctgatcatcatcaacttatgtattccagccgatacgatctccaaccgatgcgcgaatccgactctgagtccaattcgattcaacaccaaatttgtttcaatcttcttccttcttctccgtatctgatgccaaattccgctgttaacaggtggtaacttctttaggtgattcaagacaacagtgattttttcaaagtatcatggggttcagtcaacagatgcgaaaagcgtggatgttggatttattagctcggttcataagatgataaggaagaaagggttctcttcatgtctgatgagtttgatttgttatttggtaatgacgcgagttatctggccatgaattagataaaatcaaatttaagacaagagatgaaggtgaacatggttttcgaggagtctgtgatacgacagctaaggaggagttcaatttcgcttggtaagacgactatgaagataggagcgaaggtggagcattgttacaggtggagtccagaggaagaagttacatggatgaagttacatggataacagagtctctgatgagatggtgagtctggtgtaggctcgtcgggcggcttgtggtgaagctgcaaaagaagacaacccaagtctgaaggacaagtggatcggtaaggtgattctattacttctgggtggcgtatattcgccaaggtggagtttgttagaataggtgtcgaatatactagttctatttggttacagttgaacttagagttgtaataggtgataagggggtggagttagagtcggactctgtaacccggcaactcttttaaatagagagggggcaccacaatgtaactatagcgactacaatgtagcatagacacgcaaggagatgatcacaacgaggccatggactcagtagcggccaggagctatatattggttagagaggaacgcccataatcagagccccatggatataggcttcagctgaaccttgttaataaatatcgtgtgttcctatgtcgtcatctggcatatcttgggtgattaatgactgaagagatcaagaagtttaatcatcgttccggttccgctatatcgactagctttttaacagactcgaagtatcaaatgtttaggtcaagacttttaatattgtgcaggacaagtctaggtcgttttgcagtgcacaatttaattggcctgagttaggccatgtgtaattcagcgtagtagtcagttttgttcagaagctcatcattttggctgaagtttcctcctctttaatgagagaggggccagccatggtagaccgtcggacaatataaataaatcaactctttgttagagttcaaactttatctaaaataaataaacttaccttcttattgcccttcatccaataatcgagaaattttatcaacttaataatctatccaccaactaatactatttttctattaatatgagatattttagtcatttcaactcaactaaatatgcattagtacgttagtacttacgagttgattttttacgtgacaggaagtggtacaccctatggcacaacattgtgggtatcctcccgcatgtatagctgggccgcacatgctcttctgcctgggccatggatgtggacctgcatgtagctaggccatgggtgtgtggacctttgcccccgctaccgctagcatgacaaatttaaaacgagtgtactcactgtcgtatgctatctgtatcactgtaataaaacgagtaaaattatcaaagttttatcttagatcatctttcgaactagttaattttactctcttatactttggaccaactcaattcccttatctatccatatctagccacttcttcgataatgatatggctttgggcatggttgagggagtttaccttgtttggtttttactttgttgaggatactttattctattatcttaaaaaatggtcgagggagttcatcaacgcaatggaccacttaagaggtctacatgggaaaaaatcgatttttctatatgggcgtcttatgtagccgtatgcgaaaatacctcttgattttttccagacgtgacaagtcatggtccttttgcaacctatcgagggtctcgctcacaaaaatcgtttcggtttgtcaagtcattagagttccaataccattggcattgagctctatactgaactaaaacaaagcgtaggccttttataacaacatggaacgtataagttcaactccccaatctgcatctttttttagttttttttcccaatgattgcttactcttttttgttcctttcaaaattgtcatgtcatgtttgttaatttgttttattttagatttgaaaaaaggtgaaacgaagaataatatattatttaaaatttgtgttcttttcatattaaaagatgtatattatgtgctcttttaaaattttcatcaaggaaagaagcatattaaaaatgtgacatctttaaagggttttttccctcgtgactacttactctctcctttttcttcacaaaagcacgtaccttgtttgtaataatttgttttcttttcaatttgataaaataaactgaaaatgaaagtatgttatatgttttttggtcaaaattatgttcttttcgtatcaaaagaagtatattatatatgaaaaaaaagtatattgtatttttcatctgaaaagaacataaaaatacgaaaaacacatatattatacttcttttcacatcttttccaaattcaaaaaagaaacaattttacaaacaagacatgtcaataaaaggtatcagcagagtaagtagtcaagagagagagaaacggtgcattttttgaaaaaactttctatagaaaagttattttaaaaaatcatattaatctatttttcaagtttaaaataattaatacttaattaatcacgtttgcatattgcgtatcttctcaatcttctctattctcctcttctcaaacacaaaatgatgcaatgactaggacttgaacccaacactcagactcaggatgtgttgggttcaaactgtgacaagtcctacactcaggttgattaaacttgtataatctttgacatggcaaactgtcacaaggtgtggccggtaaatgacttgtggtttttgaatctcctaaagatgaaagatgaagataaagattaagtgtttcacacaaaatgaggtggtaataacgtgtgattaatctgatattttaataattacaaacttgaaaaatggattaatctgatattttagaataacttttatatagaaagttttcgcacgaaacgcaccatttaacagtttgaaaagcgtaccacgagtatcttaaaagtttatctaacttttgttggaaaaaagaacagggccttagtagtaaatgcatacg

SEQ ID NO: 57612 - DNA, 1333 bp, Oryza sativa
  unsure (1)..(1333): unsure at all n locations
ggccaatggcaacctaagcaaggccaaccctacctgaattaaagggcaattccaagaataagggccaggaccttgggagtcccgataattacaacaagttcggatccgcgtttttgaaaaaccaaatgttttgtggaaccttgttttccaaaaaatagaggccaggaaatgggnggggcttcaaccaaaggcaaccacatttggcaagttaaaatgccaaatattggtaaaaaccaaaagggcagaaggccacaaggtggggagaaacaagtgctgttccaagttcataaagggccaaagattaatttgtatgatgtgcacaactcaaacacatagataatcgcattgttggattctcgctagtggtgtttcagaagtgaaaagcataatctatgtctggctccatttccacccctcaaaattatctatgcccaagttgccgctaatcaatctccacgccaccccattaataatatgcctatctagatgcgtgtgttgtgcacactcgaattccgcgctgtatcctgaatttttggattggacaaagtgatgaccaaactaaaaggaaatggttgtagcgcaaatttcccttacgaaaatcgacaaagaagacaaggtgaaaaaacataaatcacacattccaacgctggagcatgcgatgcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactgaaaaataaattttgatgaaaaaactctaaaatcaatttcaaatttaagcctgaaaatttaaattttgaataataaacataagcataaacgaaaaaatgcggccgtacaatttagacccttgttgtaatgagcggtgtcccatatctctgtccttggccgtccgatctggaaccgatctagaacgaacggtcggatcggatgggcattttttcggtgcttgtaccaagggaagggacaaccttcctaaacatgggcggctgcgatatgtgataatgggtatgtttggggagtttttgattcgattagctacagcttattctagaattaaaagtaccataaacattttagcttttttgatggattaaaacgaagctaaagctttcctaa

SEQ ID NO: 57613 - DNA, 791 bp, Oryza sativa
  unsure (1)..(791): unsure at all n locations
tacggggngggattannagnanagtnctgccggggaggaagccgaagaacgcagatgatttattacccctcccaataacattgttactgggagtgttatagcttatgttacattttagatattttgtacaggggcctatttaacattccaccaccacagcgatggcgatgatacaaatcaggacagcgacgaagggagtggcaaaggcttggaggatgttgaagctggagcgaagttgttgaagctgggcctccaattcctcgttgcggttagctaggttagcgaaatgcgtcacggtacctgcaacggactggacgcgggatatttaagtaatgtgcatgtatggagcaaacgccaatgaggaaatagtttagttatagattgtaatgaagtaatgccaagaaactaaaaagatcataaaacatcgtactgttcaattcctacatgcaattgaaattgaaaagtgaacagtacatgcaagaaaagaacaggataacaaacacatcaaaggtaggctatctatatatgaagaagggaaattaattcatattttgcaacaattccaatggtatgtatcacctcaacttgaatttcatccctttccattgaaatatatgattgtaacaattgtaatttattttgatctttgcatggacagattctttctattcaaaaattaacattttaacttttagaaattgtttagcatcgtaacacatacttatataacatcgaactactaatgggtaacatgaagttgttaagccccttgacgaaaaaatataacttgt

SEQ ID NO: 57614 - DNA, 1874 bp, Oryza sativa
ctggagcgaaggagagagcggacgcgggagctggagctggagctgcaggaactgcgggcggaacttgaggtgctgcgggagctactgatggaggtgggttcctgggcgcaagctggatgcgcacgggtgcagtcgtcgtcttgcggggcgtggtgcggatccggactcctcctggcgcgggaagcccctttaactgagcgttctccctcttcaggcgcgctatctcgtccttcagagcgacgatcctcatgagcttcccatcattcaaggccttggtcgccttgtgcaggtccgagtgcatcctatccaatcccctcatcacagcacacatgtgaccaaaggtggtgtcgttctcgccggctgtcggacggaaagtactgacatcatcactgctggctcgacgagggtgaaaccggtacgccgtgtcgtggaagatgtagttgtggcgctcccgtagtctggccatcatcaggtatgctgcctcctgacaggcgtgatctgctgtgcctccagatgcctcaaccaccatgttagctaggcaggtacccacgtagccgtggacctccaggcgaacacggtgaggaagctcgccactgagcggtggaatcgtcgtgtactctggcgcgttggggtagcccaccaccagcgtcatgcgtgccaactctgccacaaagtcgatcatgccttctccacggtggttgggtgggtgaccggccatctagagaagacaaaggggtaggatcaatgcatgctcaaatccaaacttaaataaagcaataaaagactcaaataaaggaatcgaataagagcgaaatttttatgcatagatcgttttgcatgagagcgaataaataagacagactcacataacgataaaataatggggaaattagctacatactaataataacaataagagcataaataccttgcaacccatgttcctgagctaggacctaatgcatttcacccatcaaatcccaactgactgacgaataaatctcaatagttttactaaaaccctagactgactcgttttgacaaatctcacttaaacgagcgaccaagatttttcccttgaaccacaagaacagatcccaattttcccggaacaaatccaattgcaaagaacatatgcaatgaaaaggattcagaaggctcttaggtttttccatttggcttgtcctacggtcaaggtcggctctgatactaacttgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaggagctaagccttgactaaaactgcagcgggaacaccactccacaggcatcctcgacggcacggacaaagcctactcctcggagaaaccttcatctgacccgaactcgaactctggggttgggaaaagtagagcaagactgagtactacccactgtactcaacaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacaa

SEQ ID NO: 57615 - DNA, 1177 bp, Oryza sativa
tctttttacctccagaagtccaataattaattggtataatatcacacattactaatcgtataatattatagcatatagaacacaaaattggccataactttataaattgatagaattgatcataagtccaaattctttaacatatataagtactaattgttcgacatatgtttttggcaacatataaaacatgtaaaggatagaaaatggtaaaatgattaaaaaaatcttaaaatttagaggagaacttttcgatgcttgatattttaaaaatgagtgatgatgtcctcatcctttaacttgtaaaaagaattctcttccaatgaatgtagattgttgctcatcttgcctcttgtttttatatagttcatcgaagaaaacaccctctctaaattctctaaattcctaacagcagctcatatatataaatttaacactctgaaaattaaatattatggttctaagtatctaaattcctaatatttacagctttatactatcaatctgtcaataaatatagacttctgaaaaataaagaagataggaactaaggaagttgaatccttcggtgctagtgaactattgaactggagtactaaagaacaaatcaataaatcaagccgtcgccgccagaaaacataactactattgaactacctaggacaaatcaatgcaatgaatcaagctgtggtcgttcggccgccgcatcgcgtacctgtgtggtggcctggcggactggcggcctgcacgccggcgacgcgccgacgcctgacggcccgagccccgacgccgcacgccgcagccgccgacgagcacgctgcagactggactgcagtcgccgccgcacgcccgacgcgccgcctacccgcctcggcgccggcagccgccgacgcaaccgctgcagtcgccgccgccgcactgccgcacgccaccgccgccgcaccgcgcacgtctatcctgcggaacccgaagaaccctagcgccgccggccgccgacgacgagcgcgaagtgggagagtgtgttactgccgctacgcatcgaagcaagcggccgaggggatattgcgatgggacgcatgtgggccttctgctgttgttagacaccaagcccaccaaatttacagcccggaattatgttcgaggttggaaaggcccaatacacaacaatactatagtt

SEQ ID NO: 57616 - DNA, 1975 bp, Oryza sativa
  unsure (1)..(1975): unsure at all n locations
gcatctggagatagaatttgctgacgtgtgaaagtcagggaaaggtgagatggacagcaccaagcatgttggattggcctcatctcttctttatatcatcaattgacaccatcttatatattcttatcccaagattatacaatccattcaatttggttctaatgcactctcactcctcgcttttcttgccaagattttgccagagaaaaaaaaaggacatttgagtgatttgttcattctgaaatgaatggtgggcaagcacgcgcaatcccagaaagtaacatttcatgcttaaatctgtcccttattggggcatttgacttaagtttgtcgcttattggatggagctttataatcataaaaaggagggaaacgatatggtgtccatgggatcatcaatggatgggcccgatcgatccaaacctatccttccaaatccctatccaacacataagcaggtagaacagcacaatgcataatgcacagcactctgctaaaatggatcacatattactgttactataaagacccaaaccttatcatacagctcaagtgttcaactagcccaagtacaaatatcgcaggaatttcacacgaaacagaactcgattccgctaataattgagcctacatacaaatggcagcattatctttttttaagaaaaaagaaagaaaagagaaaaacaaggtattctaaatggcaactcgaattttaccagaaacagaacttaagcctacggatgaacaaacgcaagaatttcacaggaaatagaacaaattcgagctggacggaggatcatgtcccggccatgcgtgcgtgcatggggatagctgaccttttggtccctggaaagccaggccaagaagatggatggatagatagataggctaccagcagtagtagcagagaaatgctgggtgccattgccacttgcacaggtacccttgctttgcctttccatctgccaaaaacgtgccgtctcatgtacacgcatgtcatttgctttcctgtgccagcacaacacatccaaagggagctacagatctagcagtacaggccaaaggtcaaacaaaaaaattgccagcattggaggaggcagtgcaacttgacgatgcaaaggtaatgggcagaatagtagttgtgggggaatgacatgggagcaactgggcagcacactcactactgggttctggaaactacatgttttatctgaagtcgccgcgattcatgagtcattcatgggcagcaaaggagactaattcttgacactagaagtatcggctgagatcatcacagcaggaaacatcatcttccctaacgaaacagtcaccaaatggtgtgaatatgatacatgatgaacaaattcaacagaagtgctatcatagttgatccataacaagaaagaagtcagttcaattgaagttgagcctgggtaagatcatgattcattgacccaagtgttgggaactatagaagcaatcaaatatcagcactacaaagtgccttaggcagcaggaaagctggtggccaacaagggaaagaaacagatcacctccagccatcatttgaagccactatatcagattcaaacttatttaggcagagcagcattcttatcgagtagcttgagctcagctctttccactctcctcctctttcatctttttctcccatctacgtttctgaagaaacaaaaaaatcaagtacacaagagcaaagaacagccagttagatattcaatatttttgccaaggcatattacagtaatactccctccgccccattttaagtgcagttgtgggtntntatgtncancgtttgactgtccgtnttatttgaaatttttttatgaatagtatttttattgttattagatgataaaacatgaatagtactttatgtgttacttttttttaaattttttataagtttttcaaataagacggatgacaaacattggacacggaaacccac

SEQ ID NO: 57617 - DNA, 735 bp, Oryza sativa
  unsure (1)..(735): unsure at all n locations
cggcgtttgatgatanatcnnnnnnnnnnnnnnnnnnnnnnnnnnnnnnnnnnnnnnnnnnnnnnnnnnnnnnnnnnnnnnactaatccgaatatattgtgggcctaaaattcggatcacatatttaacaaaaatgattcctataagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttcctttaacatacaagtttggaatttaacccaagtccctttaaagatattcttatctatacatggcaccccatacccagtcggattataaatgccgtgttggtatggggtatccataatc

SEQ ID NO: 57618 - DNA, 1793 bp, Oryza sativa
ccatttttttaaaaaaatagctaatacttaattaatcacgcgctaatggaccgctctgtttgccgtgtgcactgttaaagttgggaaccaggctgtccgaacacagcctaattgggcttattcaagtccgatagcatcaacaataataaatttacaagaccacaaagccactcccagcagctgatttttttttatctggatatggacttatgcttagcttaggtattagaactaagctgatccgaattcagttttttatacttggagaagaaagcttatgtttaacttaggtacgggaactatgctgatctgaatgataagctaggtatcaaggacctgaactatgccacaaactgtacctagatgcctcatgtttagttgaaggggcttttttgggctttaagtagatgggtttttacgttacaaggttgataggcgcagcttcttatgattatgcttgcaactgattaggcacaaatactaacactctctgaatttcattatgccagtaatacaagctagctacagaaccaaagtatattgcaaaacaatctctagattttcttttacaaggtgtaagagagggcctaaattagaactgaacaacttgtgcatataagacaaattaagaaatccagctaggccaaacaggccctgatacaaggcaaacaagtcctagcatcttctcaatatagggtataacatataagcaacatcatcatgtgttatacaagaaattaaggatcaaaaggcaggaaaaataggcccttatgttagacaagccagacatgagtgacatgacaggttctcaaatatgtatcagaattagtgaactatgaaactccatgtttttctccacagctcatatataagactatactagataaaagaacccaaaggaatgaatttgtactttgtagtaatacgatcaagactgacactgagatactgcgccatctatagacaaatagaaaagattatgcaaaataccgcagccaaatgttaacattggcagataaaacaatacacctaaactggagccatgcaaatgcatagctagacatgataatgagctcggaaatgcatactacaatatacgaagattagtaataccaatgcaaagcgtggagaatggaaaagaacaggcaagatgaggaatcaaaccttgtagtcaaggagcatctggggcatcttcttcatcagctcaaccgtgttcgcacgcctggaaaaccacgggatcaaaacaacaaaacaaatcaagccacggggcaacaaattcaagcaatcgaaaaggaggagggatccaggggatgcgcgcgcgtacttctcggcggagatgcggtcgcacttgtggcccttccgcttggtgcgcatctcgccgcggggagggtcgtaggtccagtcctcgccggcgaggaggacctccttcctgaggcgcgcccgcttccgggcgctgaggccgagcggcttccatgccccgagctcccagtacccccacacccccttcgtcagctcccccttgtactttgcaagcttctccctccacgggtaaaccctcgccgccgcctccgccgccgtcgccgtcgccgccttcccggccatcgcctccacccgcgctagggttttgcctctcccacctcggcttggtacacttcacccactggacccaattaaatgggccaaaatatcatccggcccaacttaaatgggcccaattgttatgggccgcgtgaggcccggcccattagaaacccttcttcttccccgagaggaagagagagaaaaacctcgca

SEQ ID NO: 57619 - DNA, 620 bp, Oryza sativa
tttagattaaagtttagctttgatactttgccgtgtaatcccgtgatcggttagatcgccagtttgcccgttacggaatcccaacttatcatttgtattcaattcctatctgcaattcagattgcttttatcttattcttgcttgtttctttgatttgcttgtaggaataaggttgatctgcactggcaagatcaacaacccacagataggtgtatcgatcgctaaggcgcaacacaacaacgtctagtacggttgtagttgggtcgtcaacgtttctctcaaatcgtagttatctacaactcaccgaaagatcgggccaacaacagccttgagtctctcgagtggagctcagggttcatcaggtggtatcagagcttttttttgctcagtgttctcaaatttggtcgttaacactactaccagaaaatagccatacaaaaaaattgcatcctatacctagccatatttgtgccattgcattgttcattcagtttttgctttgttgagttttgcgttgcattgtcgagtcatgttgctggtcttaagcgttagttcgtttagagtttcaggttctggtcacgtttgtaccactgtcgtcgtcgtcgtcgtgtacttgtta

SEQ ID NO: 57620 - DNA, 1584 bp, Oryza sativa
  unsure (1)..(1584): unsure at all n locations
cctcccccttcccgggaatccaccccctacctttttccatgataggtttgttttgtgtgaggataataataagtgggatttgtgggtttgcttgttgtgaagcgcttcaatttgcgggaaaccaacccccacatgccgtgggagttctcgaaggccaacatgaaaaaggggctgttgttagtctcgttcattcatttcccggtgatttatgatttggatggaaacagtggatgtttttgaagttagttgtggcagattttgttcagttttgtngngggatggncagnantggngggtagggnnccannnnannnngnnnnnnnnnnnnannnnggggggggggagcgaggaaaaaaccggaaatgagagtcggtcggtcggtagcgcggctatggacgatgacgggggtgacgaggaacgtgaggtttgcgttctttgctttgtggactttcttcccgctttccccttttcgttttacccgctgcactgcggctgtgcctgtgttgcatcgtgggatacatacatgggatcaatttggaaagctttaagattatgccgagtagttagtagtcaacttacgagaattcgtataggcggctgtgcctgtgtcgcgccgtgggatacgtacttgggacctgtttgggaagctttaagattctgccgagtagttagtggtcaacttacgagaattcgtataggatgggctttcgagcttctgacttctagttttatttttagcttctatagctatagattctcagaatctgaacgagaatatgtatcattggaggagttggagattctaggagaaactatagttgctagaagctctcctaaatagggcttgaaccagatgacggcggaggtgacgtgagattgtgagagggtatgtgagctgcttatcatgaaaaattctttgttttgtccttccatttttgtattgtgtttggcatgattttcaggtggaagcagatgcatctctcgtacacaagtcaagcggctacttgggctctgctgcatctatactaccaactgccattgatgtttgaaagaaagtgaaaagtcactagaaactaatactagtcgctcacaatcaatggcaccgctagcggcatcattgttttttgtatgtcaaggtagaggtgggttgtttttcattggcaactatgtgtacgtgattgtcataacaacctagtcctatattttattctatctattttctgtgtttatcaaaataatcacaatgttaggtttacatgaacactactccataatttcactattaagatgtgtatttttttagatgttgaacttagtccatgctaacactgataacagtttaatccatacatatgcagagagctagagatgttgcgtttctacatttcttcaatcacttgtaaataggtatgtgtcatgatagataattgaagtacaagcgccaaaaggattggtagcactgtgtgtctatcattacctatgtacttaaaaagattgtccattaatcctgtattatcaatgatatgttgaaacaaatgcttaggcaataattggtgtacaactagaaagtggtcatattcccca

SEQ ID NO: 57621 - DNA, 6242 bp, Oryza sativa
acaacttgagagttattcatgatttatattcgcaaagtttgacttaaacattgtcctaaatgacttcctttatgagtacggaggaagtatttgaataagataaatggtcaaacatatatataaaaaaatcaacggcgtcatatattaaaaaataaaggaaatactacgtaacaccaaataaggtgatgcaccaatacaccaaaaatcgccagacatgtgaggcctttcctgtacgttcaccctaagtcatacagaaggcgaaagatgagaagtgacactttgatttgttgttggtagatatatcaagattgctatacactgattgacagggcggaaccaggagtagggcagctagggctagagccttactcctggtcctaaatacccattgaaagcactccaaatttaagaatttagaaaaaaaaagaaagtaaacctataaaaattacatcaattgagccctactcttgagaaatttttggctccgccaccacccattgttactatctaaccccgcgcatatcgtgagccgttgttggtgcttctgaaacgttggagacagagagagaaaaaaaaaggtgatctaggacctgttagtcgtggcagtgagaggcgacaaatgtgaaatcaccaacactagaagcagcagaagaagaagaattcgaagaaatgggttgttgaacacgcatatgacagcaacaatactgcagatagttgcaaatggtccttggaggtatatacgacaaagaggcaaagcaaacaagcacgatattgggaaatagaagtgtcacattggggaattgaagggtcagaaatggccggggcacgagccaggcacgctcaaattaattgcagccatcgatcgatcaatccatggatgcagcatgcagcgatggatcgatcgccatcatactctccagctagctagctcgtcgatcgttgcaatcatggaccaatatagatagatcgatgtgcattgcactagctatagcttttgctaagctgcagacatcacggcgcactgatgatgtgagatgatatgatacagacggcaatgcacctggcacttggcacttggttaattccactcactcatcacttaatttgctagctagtagcttatttgtagtcgattgaggtttgccaattgtccatgtctgcttgtcctcttcctccaccctctatatatatcccaagtggccactacagagcctccattattaatcatagctaacaagtatatcctctcttcttcttcttcctcctcacaactcacaatatttcagagtagtatacctttcttgctagctagctagcttgttcatcgatcttgttttgaggtgttgagatagctaggatggtggtgaagaaggcggcgacgatggcggaggcggaagcggaggaggagatgatgatgaggatgatgtgtggttcaggaggcaacgagatgatgaagacgaagatgaagaagaagaatagagaaggggaagaagaagaagaagtaagtggaggaggtaggatgaggaaggggccatggacggagcaggaggacgtccaactggtatggttcgtgcgcttgttcggggaacgtcgttgggatttcttagcaaaggtctcaggtttgcgcggtggcgggtgacctagctacatgcactgcatgcctccctctctctctatatatatctccttcccatcaaacatccatccatccatcgactgcttctttttctttctttttttttctcttcttgattgttcttgttcttgttcttctttctctctctcttatcatgcaacacccacacatgcatatatccatccatccatctatccccttatcacatttaatttcttcttcatatataccaatttggcaacagctaatgattctttttttatttgaaactctgaatgaattgatttagatgcatgcatcaatacaaataattgatttctttttatctggagctctgaaattgatttagatatgcatattgataaaacaaaatttgatattcatctgaaactctgaattggttaagatgcctacacataaatgttccattttcagttgtggggatcgatgtgatggcttttacatatatgcatgcgtaaattaacatgcggtgttgcatgatcgaagttaattaatctagaggcggtcgatgatcgatggatgatacagtacttaactaggagatggaggcatgcatgcatgagcttagaacgcacgggaaactgaggtgttaaccatctgcttcttcttcttcttcttcttcctcctcctctggatggctgtctccctggcacatgttggccttggtggtttcacctttcaggtttgaagcgcacaggcaagagctgccgtctccggtgggtgaactacctccaccccggcctcaagcgcggccgcatcaccgccgacgaggagcgcctcatcctccacctccactcccagtggggcagccgctggtcccgcatcgcccgcagcctccccggccgcaccgacaacgagatcaagaacttctggcgaacccacatgcgcaagatcgcccaccacgccaagaagaagaccaattcaccatcgcgggcgccgacgacctcctccggttccttgtcctcctcgctcaccacggcgacgacgacgatggcgacggctgcggcgctgcaagaaagcagcagctgcggcggcgacgacgaggccgtcgaccagctggtggcggcggccaccacgccggcgagccagctgctgacgatggactacaccatggaccagctctggaacgacatcgcggcggcggaagccgatacgagctgctacgacgcggcggcgatggcctcgccgccgtcgccggtctgggaattctgcaccgactactcgctgtggaggatcgacgacgaggagtactacaagaagatgctcgatgcctcgcaatagtactactcaaattgcaaacaagcaacgccttaattcaattgctgctcttagcttaattagctgacgatcgatcgacgacgactctcatcatctgatgaacgaactgcgaaatctatatttgcactgcatatccttgcatctgtctactgtaattacacctgatgatgcacgtattatgcattgcttgtcagacaactctgctttatatatatctagctatagcttgatcaatcagcatgcctagcttgtgtacatgtaggggagagagtattagtagttaagactgatgggatcaagtgctatatgtatattgctttaatttcatggtatatgtactatgattgtactatgtgtcatatattcagtgtaagcagtggtttgcaattaacctgttctacctcgtaaaaaccggccttctgtgactggttttaatttgcttgtattggtgcagtgctaatgaggtttttcagatgagagtggacccattattaagtgcttaacagagtttgacatatttgaagaagtagaatttcaattgtaccaaaatacagtcaaaagtagactcatgcaattaatatattctattccattatctaaaaatatatgaagagaccatattcaaagaaaattatgtatatgaagagctcattccagggacttttttttccagtgattcactaattaatactttaacatctcataattaaacttcccctaatttacatgaggagttaattccagggtggttagctgtgcaaattatgttcgtcaccaagcatcaaacaagtactcatggtgctgccatatcagatgacctagatatcatctgaaacttggttctatatatcccaagaaattaacacaaaagaatcttgactctctcccaacaacattgagagcgcatatagagcatgcacaatatacagaatcttcaccccccaaaaaattttatatattccaagataccagcaagcaatcacagtatagctagtgcatggcggcagtggtttcatgggaatctaataatacaactctctccaagcaacacacaagtcaagagagagtaactcaaaaagatatatgccaagctcagatcaagaggccatgagcagcaggttgaaatggtagggaaggaattcagaagccagggataatacatccatccattcatcaccatgcatccccaatatgccatatattgtgcatgtccctttccagcttttcctcacatctaacttttccatccctccaatagttcaaaccacatctcatacagctgtttttaatctcactgtcattaggagagtggattaatggctgatctacaccgtctattgggctatgggcaccaaaaattgctacgcgcgctagcaaaaaaactcggtcgcttatatatatatatatatatatatatatatatatatatatatatatatatatatatatatatatatatatatatatatataaaatctatcctaactaacggccgcaatatatatatttattttctcttctttggtgaataattagttctagtttttgaagaattgatcagataacatgtcttcacattgcaaataattaattgttagttattagaatatggcatatatgacatttacggagccatcgtttcgcttgttcgtggaataagcgaaatggtataatagcaaacgaaaagtaatttgtgaataaaacttttatatatgtgttcttagcgatctaaaagcaaatgttggaaaataaacttcgatgaaaaaaaatcttaaaatcaactccaaatttaaggttaaaaattcaaattttggttgataaatataagcataagcgaaaagatagtgcccttaaattgaaaaccacaaaaccaagccctatctagttagcctaaaatccagttaattaatttgcaactcatgcttagaattttctaaaatccaaaatctcacgcagcaacacgctgagtttccacctagtagtcatatcaagagctagcttccctttaaaatgctccactgacagagtgtgtgttactgttgacaactcactgagaggaatttcatgccctatcctatgagtttattttgtaggtgtagctctagcataactctccacggttgatgcaacttgcaagaaaggaaaaatgccaagtggctttggtgataagggatgaattgaataaaaatttatggtgggaaaggtggtgataaggaggcaggccaaggcctttcttttctccttttgcaatcactttatgctcctaattctgattaacctagcattatctctgtgatttgtttacaccactagtggttaaccacaatggcattaattagctagtgacaaagtgtgtcagtaaccccacacaagatcagtgagctcacctccgttaattatgttcccccacggtccactgttttttttttttggctatcaaattctccaattattttgtgttttttgagagtaacatcacattgatattttctgatggcccctggtagagagagcaagaatcatgcctgcccttgtttctctcttaccggtacatcataaagtagagctagtgttattttttttgtgggaagaaacatgttacataaagctgaatattcttggcttattattcatcaaatgtacacagattctgtcagttgttgcagctgaataaattccccccctacgcgtttataaacttttcatcctccatcgatgctctactttctgttactgaaagatgtgcgtgatgaccttacttgtactagtagtatatattgttttttaaataatggttgtgttcgaaagtcacagcgctataccgcaagtctgcaataactggatcagcaatagagacactgtttaagatgctgcagtcttgccacaataactggcttccaaacaaagggtgtgtttagttccatgctgaaattagaagctcgattgaaattggaaatatatgacgaaaaagttggaagtttatgtgtgtagaaaagtttgatgtgacttttttttttcaaacttgggaactaaacacgggcatagccaatagaaactaactcctataataaatttatgatacaaggagacacgatatggtattgtcagtatagctagatataggagtttattgcccatgtttcagtttttatttttttttaacaaaagggataatgatggatcacacagtctacaacagatacagctgacatcagcgagcaaattagagggtccttttgattcaaacaaattaattatctcatcctgggtctgtggatagcatagtaagattagatgcgtcagtgag

SEQ ID NO: 57622 - DNA, 2760 bp, Oryza sativa
  unsure (1)..(2760): unsure at all n locations
agaagtgtatgtgagagtgcatgaagtgaggtcctttcataaggcagttatgacggttgtgagaaggggaaatgtccgaactgctccgcaaccgtcattgggagaacatctagagcgtccacgccaaaccctaggatcaaccgcgatcaggggggttcggccgaacctaggctgggccctcctggcctggccttcgttcagtggactccctagaccttcctctatccatttctcggagttttgggttgattcactgatgtttcgatgaagtacacaacccctccttgtatggatgcataattctcctcactttagtttgattttcctcccaacttcagcgtttatcatctgcatacaaatatacaccaatacttgtggaatatgagagattaagaacctatcactatgttggatgttttattatctaaactttatgcagatgttggcggtatgggattggcatttatcagccgccaacagtgacttggatctttgtgtgtggatttggagtttgggagcctggtgtgtgtttcttgatcttgagcactaggatttgtccaagagttgtgtggtgtttattactcttggaggttgaggactcctagatggctaggtgtcattcttggccaccgatctacgtgtggttggacaagagaagtttgtgaaggccggatcgcgcctccgcaaggaaagagatacccttagtggaaggaggagtgcatttgtccaacctcatgaggatagggttgaaaaagacccggctctttgcgagcccctcaacggagactagaatcccctcaaggatttgaactctgggaaatacatcggcgcgtaaacctcggtgatatcttcactctctttaccttcttgttccattgctttgtgctatgctcatattgttgttggtcgagctcacctctttgcctgtgtataatctagagctcttaggttgttctcttgtttgtattgttgttgtgcaggtcagatagtctgatctcagttcagacaatccgatcacataggactatccgatctgatatcggacaatccgaccctgttttgttttagcttccgtatttatttttaaaaaccgcctatttagccccctctaggcgacatcaaggtcctttcaattggtatcagagccaagtctctctattaagggctttaccgcctagagagtaatgatgtcgactagtggtttggtagatatggttctttactccttttggatggttcaaattatgattcttggagtactcgcatacttgacaaatttaggaccatgggtccttaaatagagcgagttgtagatgtgagcatttctcctcctaatgataaagagctatcatttgaagaggaagagaaatgcatgcatatcaatgctcaagctactattgttttatttggtgttttaagtgaagatgtatttaaaaccgtcatgccgtttgaagatgctcatctcatttggaccactgtcacaccctgaaaattcaaaatatataaattgttgtttaattggaatttttagaaatgattttaaaagcctagaagagaagatctaatttttaatcaataaattccaacataaaatggggccagataaaatttcaataaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagccggcccagtccgcagccgcccgcgcgcgcgcgtcctcgctcgctgacaggtggggcccgcctgtcaggtcgtcgtcttcctcgcgtcggccgccgcccgaaaccctagcgccgcgccgccgccgtttccttccaaatccggccgctcctttccttctccggctgaatcaaaagaggggaaatgatcctcgggatctcctctaccttttcccctttggaaacatcggctaaatcggcttggaaagtgtttgattcgaggtcgaatcggatcggcttttctctctccgagcccgatctttccttctcgtcgccggtcgccgtgggccttcgccgtcgcctcctagcccctttaaaaggacccccgagctctcctctacccgccgccaccctcgccttcgcctctcgtcgtccgtagcgccctagcgccgagtagcctcgagccgccatcgccgccgtcgctccagccgtgcgccgccgccgttccggtcatcgccgtcgctcgggaagaccaccgtcgtggtcgccaagtcaccgccgtcctcgtccgcctcttcgtcgccgccggagatcgtcggagcaccgccgtcaccgtcgacccgatctccgccgccgctttgacctcgtcgccgtcgccgtccgttcctcttccgccgtcgctttggtcgccggtgagtttgccgtgccgtccgctacccgttggtgtcctccgttcgtgccgaagcgccgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcatgaaccgtcgncgtgcgcccgggccaccggaaaccctagccggtgatgcaataattccctttttcttttcaaaaata

SEQ ID NO: 57623 - DNA, 2758 bp, Oryza sativa
attattataccatagttcacattttccatttccaaaatggcaatcatatccatcaaaatccaatttgggtacacttatttctttgcaaagaagggacataaaaaacatctcgaaataaaagtgtgaagccattcgcgagctctaggcaaagatctccagcaacttcaacttttgcttcactccattggcaactctaatggatctttcgcttctttgcatagtcctcattgaacggaatccctttaaacaattacacatatgaatagttgctctagaatcaatccaccatgtggatctataataactaatcataatgagattcatttacaaatgtaataatgttctcacctttttttgccatgatcactatcaggaagtcaggatgatctttcttggaatgtcttgtcttcttgcagtggagacactaatcctgtctcaactgtgaactgttgttgttgaggcagatactgaggctgttttgcttttgaggagggtgacctgtggctcttttccttgatatctttaacaaggttaatggagtcaccattggtctctttgattctttcctcctcttgaaccaccattgatctctttgattctttcctcctcttgcacacaattagagatgagctcttcaagattccatttttctggacttattttgtaattgacaacaaagttgtcaaaatgctttggcaatgaggttataaccagatggaccagaaagtcatctgagatgcccaaatctttttgcttcaacttggaagccatgttgctcatcctaagaatgtagtcttttacaccatcaccatggtacctctctgtcacaagctgctttattagctgtgtcgcataaaactttgaagaaccagtaaactggctctttatactctcgaggtacttagagacggtgtcatactctgggattgagcccaatatggttggctcaatcatgttctttaccgcagccaaacagttcttgttggctgaggaccatttcgcatgctcaatgtcatacgacatgatgagggaagcattgtccctctctctcttttgccattcagcatctaactctttttcacctttgaaaagtttagcaggttctacaggacatggggtagtcaacacccagtccacctctcccaagataaaagcaaggtcgagttctcttttctattctccgtagttatctcctgtcagggtcagaatatctttaatgtaacccatcaaggagtaccacctgagataatcatgtattgtgagaacaaaattaacattaaaatatatgtattaagtctacatcaccgttgggcagaaaatagacataacacatagagccataactataacattgcaatttatcaacgttggtcagaaaattacaacatcatagcacataattaatgttcctaaaattaaattctcccgttggttcgaaatttaattttagaaacactaatttttcatcaatttcatctatttgcagcggaagatctatatacaattcatataaacagtaacaacactctgttatttactctctgtaaaaattctcccgttggttcaaatttaaacagaggtaaaacatgcaaaaacaattcaaaattctattgtaatttgcatgaaaatatacaaaatacatgttcagaagcatttctcacatttatctattctctaaacaattttcacgttgaagaaataaacacatttaataactataattgtaaatgcttctgaaacagggacctagaccgaacttcttttcttttgattcggccccaagggacctaatatagacttatttaggcgcagccggtcggcccacggccggctttcgcgcgcgcggttgccccctccccccaggctgcaacctgggcctgggctgagaaaggagcccccggcgcgcgccctcttgggccaaaatcagcccagccatcgccggccgtccgatcttaggttttcgatcggacggccgggcacctctttcggggtaacaaaaaccccaagccgccaaagacgccgtccgaaaccctagccgcttgctggccggaaccctagccacggcggcacggcacggcggcagggcggcacggcgcggcggcgccgtcgcacccccctttgccggcgcgcgcactcacccgagagtgagtgcgccgccgtcgagcggctgtgcagcggcgcccggcaagccggcggcgcggcgccgccccctcttttctctcccgcgtcggcgtgaggacgaccggtggtggcatgactcccgcgcgcgtcggcggcggccggcggcggcggtaggtgagtcttttcttttcgacccgtgcggatcgtgtgctgttctttcttttgctcttttccggggatcaattcccctcttctttttatttggatttctatccccgaaccgatctaagccctagggttggtctgataccattgttagagttctctgttggatcacctaggtttagatctagtcgggttgtctctattgggttgatgaacgacattgtagatgaaagggagagggtttagataccgaccggttgaggtgttcgtggaggaaagggcgccggacatcgtcgctgtcgttgcggctcgacgtggacggcggcgacggtgtgcttggtgccaatggcggtgatgcagcagcggtcgcaggcagtgacgcggttgcggcagcgatggtgtcgacgacgaggcgtggcgcggcggtggacttcccgtcactggctacgcccccctcgagatcggtttaggg

SEQ ID NO: 57624 - DNA, 8537 bp, Oryza sativa
cttcggagaggcagaagactctgttttagaattctccagttatgaactactgagagttttggatcttgaagaatgtgaaaatttgaaagatgaacatctcaggaagatatgcaagctgttgctgccaggtatttaagccttgggggcactgttacaatgctcccaaaggagatcacaaaactgaaatttttggagacactcgatgtacgaagaacaaagataaaagttctgcccatacaagtcatcaagctgccatgcttgacacatctatttggaaatttcaaacttcaagatgtaggccagaaaattagcaagctacagaagtatctgtctgagaaaagtaagctggagacactagcgggattttttgccaataatgaccaaggatttcctcaactcattgatcatatgaaaaacttggccaaggttaaaatatggtgcgagagcgagaccccttccaattctagcagcaacactattcacctttcaaaggccattcaagttttcatccagaggggcaccaatatgaacgatgtccgctcgctttctctgaattttggggggtgcttccaagaccaagagaatatgctgaagttttccctggaagattcctgctacttaagctctctgaagctaaaaggcaaaataaacatattacctccatttgtaaccttgctgaaaggtcttactgagctgtgtctatcatcctctgataagctcaacagggatgttcttgctgctctaagcaatgttcgctgtttgcattacctcaaactgattacacctaatctggaaaagtttgtcataggacagggtccactcaaaagcctacgacgcttgtgcatcatggtgcaaaccatgaccgagccagaaatccaacagggggctctgccaaatctggagtcattccggctgctctgtaaggatctaaatgggctatgtggcatcaacatccagtacatcggccccgaatgcctcaaggaggttgctcttgacaaaagaattagcgaagaaacaaaaaagaagtggaaggaaacagtgaagaaccatcctagatggcccaaggtctcatttgttaatacaggagaggttggtcagatgcagaatatggaggttgctcagcctacagaggatgctgcagcactggctttggctgccggctccctaaggccggttccggtttttagacgtccaaaggcagatcaagaaaggaccttagatctctgttccatgggccaaacctctagggaatcttgcagcaatactgagccatacttcaaaactaatgggacttcaccaggcaagctgaaccctgtgaatgatgaatgtcaccatttctgctagatagcgagaacatcctctgggctggctctgctcactgtcgtcatcagttactctctttctatctcgctcttcaccacaagctgcatcatggtgacaccactctttccaagttacagcaaaagagtggtgtacagatatacaagaatctgtagttgattacaaatttgactgcacttctgtttcaacattattatctgctcatatcttgctacactgtgcactagctgcatattataatcagtagagcaagcatgtgtatttcagtgttatcacaattacatattcaaatggcagtattgatccataaatttgtcgatttcctagcggttgttaaaattgtttctataaagagtgaaaccctacttgggaggacaattgtgattattgatttccacgagcctttgccgttacgaatatgttacatatacaaaggtatgatgcatatatcataaagaaggaatatgcagcgggtagtgggaatcgaacccgcaaccccacggttatgagctaggagggatagatgataagggattactagtaacctacactacaaaagaacccttctttcgtaacgggtggcaacatacatccgatgacttatctttgtcgagtggtaagttaccactcatcacggatgagtcatccatgacgattcgtagctcatctttgtcgggtggtaagttacaacccgtcatccatgacgattcataattacgaacattcacacatgagaatttacgatttttgaattttaatgcacaaaaaacgctaaaaatattctatacattactaggacattccaatatctatctatttatttatttatttattttagagaagggtatttttttacccggcctctacatccaaccggatatatgtagcctttttaaattagtaagttagcctatcaaacagggaacttagccctcaaataacccaatctgaaattcgctcctatgtgctactcaagtcactgtaaccactaggccacatgccctttcactcgaggacattccatctatggtcacacaacactagctagaaattcatgatttttcaagtgacatttacatgcacgccacagttggattcgaacctaggacctctcagcacatgcaaactaattgtaccatctcatttatagaccacatcttgatgagtcttcagatattaattattcttttgattattttgtccaaatatgaaacaaaaatttgaaactctagatgacttcaaatgagaacgctttcaactacaaagttgcaaatctcatcgagttctacaacttcagcgtagggcatgtctccatccaaggtgatttgaaaaatcaaaaaatattttagaaatagatcacatcacttatagagcatattcaaggatgtaaacaatctcaaaagaaaatattatcaatcacaaagttgtagatctcatcgaatccttgcactttgatatagggcatgtctccatccgagatcatttgaaaaattcaaaagtacgttttccaaaatttatctcaccacttataatccttattcggtcaaatgcaaatgtcgtcaattttaaagttataaatctcatcaagatctacaactttcatataaggtatgtctctatccgaggttctttaaaaaattcaaaatttttgaatttccctcatccgtgacgggtcgtaaatacccttcacggataacgttatccgtgaaaggtggtagttacaacctgtcctggatgactgttctcatcttaaacaggttatcccattaaacccatcacggatgacatgttatccgtgacgacggggcatttttgtgacccgttatagccttacaggtcatccgtgacttgttacaactacgtcccaaaaaagatgacctcatattggtgatggttcatccctgatagtcatatcttaaacgggatacttttcaacttgttagggatgagtcatcccaaatgagtcacattagcccgacacgaatggctcgtcacagatgctcggatctgtagtagtggaagtaaatactcactctgttaaaaaatataaggtgcattttattttgttaggataaggctttgaccatcaattgcttaactaatgtacgatttatgtgatagaaagcataggtataagtaagtagtccattgtgcaatattataaaggaaaaaggatgtagggctactatcctcaagaaggccagctaaatgtgcactaaattatggattaacctcttgaatgtcccatatagatccaatgattgtacccaaattatgttgttattgagcccgcagctacccacggttgggcgtctaattactacagccggggggtgaaattccgtatcctgggttagttcgtttcgaattccccccccccccctccatttggtttctaaacactgtgaacgaaattactggcagaatcgaacggaacaaagagacatcagtttgtttattttttacgaattttcccgggatagaagtttaccggaggagtagacgagacgacgaagctgagcgagctttgccagtcttccgccgccgcgtcgcccgtacggcttgccgctgtgctgcgccgccctacgcctcctttccgccgctcccgtgcgcgatccggcgggacacagacacggccccctccgcctctcgcctgcgccgccaatttgctccgctctctctccggtggacacgaggataatcgacggagaggaggacagcgaggaggcttgtgggtttgagtgggctcgatgggagcacgagatgggccggcctggtcggcccataaagtttttcacaagagtaacaaataataaaacaacaaaattaaattaaaagaaccggacaatctacctaccagtaaaaatgtaaaaaccgaagaaagggattaaaagtaatttattccacacctattatgacgtggaatttattctaactcaattctctctaatccccatcaattctctccaaaccaaactaaggccctgttatttgtttcagtttaagattattgtaatccagattattaaatcatattactctaagctggattataatagaaagaatcccttatatgccactagaatttgaccagttcccttatatgccactcaaaattagcttctcccttatatgccactagttcaagtttttccaccattttatgccactcccaccactatagtgttagttgactgttagtcaaaggttagttttttttcgtaaatgaccaatataccctctcaactaaaaaatgtgtaaacttcaaaaaattataactaatttattttaaatcctttttgagtcaacaaaatttggttagaaccagtgaaaaatgctctttatattaaaaatattgttagaaaactgcatgtttcatgcttatattgaaaatttatttctgatggtaatggctaaaattgcatgtgatgcagagaacatcaattttcatatgttgtatccaatagctatattagtactaaaatacttattattgattgtatactaattcttaagggcaaatgcgtctttttacaatgaagttaacggtcaactgacggtggactgacggcaatggcataaaagggaggagaaacttgaaccggtggcataaaagggagaagccaatttgaagtggcatataaagtagccagttaatttagagttgcatataagagattctctcattataataagctgacatagaataagctgcgagctgtttgtttttctagattattggagacatataagggtagtgggtctttagccacccaataatctaaaaaagctcctccagagaagattattagattatagtaatttggattaatctacttgtttgtttcagtttacttctaataatttagattataataattctaaactgaatcaaacagggtctaaggcctaaagtggatttggggaaaatttatccccccgtgtccgccgcgctcgagtccggccggcgcagcagttcgttcaccggcggcgcagccgccgcagtgttattggccgtctccggctctccgcgcggtcgtcatccgctgtgctgagttccgagggcttcgtctgtgatatgctctaataggcatctatctaagccattggccatcaggtcgcctggtcctccctgctgcttcgttcagtattggattatttcgctttggttttggttaatgctcgtgattcttgtggatgaggtagtgattcatgagaaaatggacgatttgtcactttgttagttgggtttcgacaacatgaaccctaaatcgtatagggtggcattttgtcaaaaacccaacgaacaaagttgtatttagtccattttctcggtgatttattggggtctcttggtaaacaaattagggttcagatggttcagatgaactgggtgttgttactgttattcaagctgtatttccttatcattaactacctggggatttatccatgatatcttctagcataagcattagagcaaatatcaatttaaaatataaatgtgcgactgctgagaaaaatccaattgctgagaaaagaacgtctgctgaatgaaattcttcaccatgtatgcaactttcccctgtcacaatttggaggaaatttggagaatgaacctttgcattgagttagccctgaagagcaatatattgtgtacaagaagaaagcgaaatgactaaaatacccttcaacgtagtctaaaacacttactctaacacccctaatcaaatgcaatgtgtatgtaataatattgcatttgaaaggtataactaaatactaaactaaatccaaagtctatgcgtgatgatgttgtcaaagcataaaaatcataaataatgatgaggaagaaaaaatccatcccctcatcaatgaagtggacttcagtgccttcacaacctgttcttcagcccttagtgcgaaaagccttcacaaactattcttcaactcttcactaattcagagacgatgatgatgacgagatgaatgaccttcacaaactattcttcggcccttcaatgattgacgatgatgtcaactccgattaggagctggtgatatgacaaagatcagctccgacgtggagctactgatgatgacagaaggctaactccgacatggagcgagtgagatagtgataatgattgacaagcatgacttcggctgcgttcgaatgtccaacgattcttggatgaaattttagattctcgtggcacgcttttcaaactactaaacggtgcatttcgtgcgaagactttctatatgaaaattgctctaaaatatcagattaatccatttttcaagtttgtaataattaaaactcaattaatcacacgttactaccatctcgttttgcgtgaaacacttaatctttatcttcatcttcagaagagatggactttgatggacttgatgatatagcaaaaataaatactgacatgtacagcaaccaggccaagaagaagaattaaactaggctaagaagaagattaattctgctaataacatgctccgggacgaattcaacgagatgtaatggattttggtagactagataggaaacatagcgttggtgatatggacccgggggtatcacgtctagagggaggaggctgccctcaaacccacgtggctctccccgagggggatcgagcccgagatggagcggcggttgcctcctccctctagcctcaaacccacgtggctccccctaagggggatcaagcccggagtggagcggcggctgccccctcccagctagagggaggaggccgccctcaaacccacgtggctccccccgagggggggtcgagtccggggtggagcggcggctgccccctcccagctagagggaggagaccgcccacaaacccacgtggctccccccgaggggggtcgagcccggggtgcagcagtagctgcccactcccagctagagggaggaggccgccctcaaacccacgtggctccccacgaggagggggggtcgagcccggggtggagcggcggctgctgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaggagctaagccttgactaaaactacagcggaaacaccactccacaggcatcctcgacggcacagacaaagcctactcctcggagaaaccttcatctgacccgaactcaaactctggggttgggaaaagtagagcaagactgagtactacccactgtactcaacaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggctgtgacaggacccttcgcctaaccccttctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcggctagaggagagctacactacaagcccagccgttgcccacactggcttgtggtaagtacgataagttcttccagggcatcccgcgaaccggtccttaactgccataggtgcgaccagcaaaaccatgcacccacagcccaccatgtgatttattttaattaaccaacaccaaagcggtgttactaatccaacaaaaccattagaaccaacagtctaaacattaataggatttttccccattgtgaactagttgaactaagcatggctaagcaatccctagtccaaactctaatcatgtta

SEQ ID NO: 57625 - DNA, 3095 bp, Oryza sativa
ggtataattttcttgcgatatatgttgatggtcgttattgatcagtttcaactgtcaatattacaaaaatagagaactagtgatgcttgcaatgcatacatatgctagaataataatattccactagtattaggtatactaacctcttgcagggaatgacactaaagtggaggagaatcgacatcaacatagacgataaatcaatcggacgatgtcgagagtcagacttatgaatgaatgggccaagaacgtagaattgacacgatgaattaggccaaaattcacaagtctacgaagtgaagcaacggaggaggccaccagccgaaattgggctggattgggccggccccaggttcggccgaacctccctcgcctccgttggatccaggttttggctggacggttgagatgaagccccaatgacggttggatggtattaccgaccattccaaccgtcacaaccgtcatagttcagctataaaaggacttcaccttctcacttcacacacacacctcaagcaatagctctctcatttctctcaattttagtttagtagtatctagctagtggaataggaatagagtagaaatcaagagtccggaagccgtcggaagagttcgggtatggctctagcagctttcctttcctcttttgtaagctttgtacttttattataatactcttctaaatacatttatggattgaaatactttccaagtatataaatacctactttacattatgttcttgttatactaaatatacggctagcttatctgggagatgctttggtgcgggtataatgtttgcttatgcagttactctatgtcatgacgatgatattggagtagtatctggtagtttagacgtggtgtctagattacgggatattattatttggggttatatattgcggatgagaggtgggccgctgatggtgacagctcagtacgtatttctccacgccgatatataatcctaagttaattccctgaggagagtattcctccatatttagccccggttgtatggtcatgacgggctgtcgtaaggaactcgacagtcaggggtggcttctcaaagtaccaggagggcatcggatagagggtattagctagtatatcagttaactagaatgtatgtatactatgtatattaaaagtataggaatagatcttctttctcttttctttccacttagctcagataatatattatgagaatgagaatgagtagtaatacttgtgtgtcactctacccttggattatcttaaccactacttagaatatgattatcacaagtaatatataaattattagttgagttctctctacatgatctttccacaggataaaataaatacgatacccttggaatactctccggtgaaatgctacaatggtatattcgtacgcttgcggatgaactctgtaaccataatataccaggagtatttctgcaccattgctgagaattatatttctagtaatgtcgttaagaaataccaacaatatattacaaaatttgtaggaatggttaatttattactacctagatagcctttccttaaattttctgttattttaataaaagacaatattcacccctctagctctcccaccacaaatggggatagtacatttgatcaggattcctttccacgaagtggttgggagtattcatagtaacagccaataaatggagaccatcaataactataatcctcagtgacgggccataacattatctttgtggggccgtcaccagtgcggggttaggttgcggcttgtcaatgataatctttatcgggccgccacctatcctcatcaccgatgagtgtcactggtgacgggtctggccaagaggcctatgatgagtgcctatatggttgcttctatatcggggtttattccagcccgtcaatagtatggcctatgtgacaggtgataggccccatcacaaattcctcattcacgactttaaattgattatgtggttacatatgcttgcctgactaatactatggcagattaggaaatacttagatgttagcactacaatggcatgtaccgtacacataatacatatgcgccggagctaaacctaacgtgccttgggaaattgattgacttgagaaaatacaggttgtctacagagtatatcgagtgtacttcccgttatgcatagcattgtacacttcacgacataaattgtcctatttgaaatcccctctcctactcccacctctgcgggaaagccaatctctccactgcatattggagttgtcctttatcataaaacatctattcaatttgcacctgcttacaatcatactgttattgggcaccaagaccatcattgacccttagacgacacatcaggaagtgtcacgaccggaattaacccaacgggcgttccttacgtgcgtgtattattccttatcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagagtttgcagtaaacagcattaaaagacacttagttgctcaaagctattttgtaaacacgattccagagctatacaatattattaatcaaggccgtgaacccacacgaacctgccttaacccaaggcctacgatgattcagactcaactagcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatcttta

SEQ ID NO: 57626 - DNA, 25935 bp, Oryza sativa
  unsure (1)..(25935): unsure at all n locations
gagagaaaagaaagaaaaagaaaagaagagaaaagaaaaaaaaagggagaaagagaaaaaggaaaaataaatagaaaaattaggaagaaaattaggggggataatagtttagaaaatttaaaataattagaatttaagtatagaataatcatggtcctagaattgcaaaatttaattattctttgtaatttctataagaaatcaattcgcggtagtaatttagatgtaattaataactaaacaaatagatgaattcttatagattattatagattatttttgggtaatccctataagtaatcaattcacggtagaaattcggatttaattactagggattttagccatgtgttatatttaatcatttagtcatagactaaattaaatcgtataatatttctaggatttcgtccgacatttagctcgcgatagaaatttctaacctattatatggatataatgctcgggtagattaaattaaaaacttaggacaacaaaatatttatacccgcaaaatagtttaggatattaaaactcgaaattgggtttgccttagttcgcgaataatcgactttcgcattcgactttcatttgaatttatttggatttttatttgaattctaaccgaattcaaatcaatttttgcacgtaactatagcgcctgagggagttgcggatccaagcgaaggccaagacccgcaagactttgagcaaggcaagtcatcactattccttgaacatgttgatcccaattgcgaaattattttgtttacaaataaaattgcatgcaatgatgaacatcccacttgtgattatgccatgccttgattattgttaacccttaaatctttgtaaccatgtttacgtatgagtctctattcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtagggccgagaggcgtgccctacatcggtgtcaccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccatgctcgcggttattgagcaccgggacatgtattacacttggctagactctaaaattcttaaacttgtgtgggatgggatctgcatgatgatttttatactgatggagccacttcctgagaggcgggaatgtggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctctgaattcctctgtcatgtgcatcattgctgtgatggcttgctgagtacggttggtactcacccttgcaaatataaaattaatcagaagcaggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccagaccgctcggtccgatgatttaagactatgcctgcgggcctatgatgtaataattcgtattagacactcgtgtatgtgcacttggtattccagctatgaattcgtgtgtaccaaactacttgatccagggaaatggtactgtttacacgattgattcctgttataaaaacgggggtctacagagctggtatcagagccatacgactgtaggaaaagaccaaaaggcgccccaccccttttctaagttggccaagggagaaattcccatttagtaatactttcaaaaataaaaacgctatgtttacaaaactcggtacaattttcatcttactcttaactattttctttacaaaaacaagttttaccctcaactgactttgggtttttcttaaaattagatggcagattcggattcacccgctacctgggagttgagcttacctcaatcagaggggtatgtcattgagctgcatcggatgttgaggcgtctgcgataccctgggttcccgtcataccgagtgagacagtgtggctcagtttgggaggctcgggtcgagattcacccccgagtcccttccaagttggactacagcttccagacacgtcaccaccgagacctgccagagaccgcgatgcaggatgccgcccgggaggccttcctccgactcagctctattcaccgagctgagttagtgagtaccaagtttgctcatcacccgttccgggaggagggcaactcagtttgcacagttcaagacacgccctgctgctacaacccgatagtgactcggttgtcacgatgggctgaggcagtagatgactactacgaggaggctctgttggagattgacgaccaccagagacgtatgggagagctggagactgagttgactgacctctcagtgcagcagcttcagttggaggaggagcaccaggcttggggcagtgagatggactcactgaaggcacagctccaggtccacggcgaccagttccagcagttatctgaccagtacaacgatcgccgcgggatgatggatactcttgaggagcagctgagagagagtcaggagcacgtcagccagctggaggagcagcttcgagcagccaagatcagcactacaggggcttctacttccacagcagtaggccgtgaccgctacttcttcctcaccccgccgtacccaccggcgttccacgctcttctgggagaggctagtatgctagctaccgagtcaacgccctacctagtggacccgacagcggcacagccacctgttccggagttggtgcacactccactgatccctacaccttctccacagctgggttccagtttggagactccgatccaggtcgactccgagacagagggaaccgacaccgagccagagatcgagccagacatcactgatcctttagaggatgagacccctgttccccgcatcaccttccttggaggccctcgcacccttagcactgctcgcaagagcacacgacctccgggcaagaggcccaagccagatccaggggccactacctctgagccgtggggactcaggtttgcgcgtgccagtgaccaccctctacctgccccgggatcctgcggatggctggaggactagactgacggactccttgaagcttcgatctcgtatcagatggtttttggataatatgcgagacaccccctcccttacctagattgacgagtagtttgatgattagttcgttgtatcttttggatgaaccttatttggactgcgtatgtatgcagtcgattgcatcatgattcatgtaccatttgtgaaactctgtgatgttatttatgatatctattgttgttgtattataaatgagtttattccaccatgcttgcaaaacaaagttcatatcaacataactcccttaatgggataaagccataggagctagttagaaaattaggatacttactccatcaacctacacagatggcaagccgacgttgggcaacaaccagcaatgacgaaactcagacacccgacttaaccactctggccggagttatggccacccaaactcaacttctgcaagctatcgcgaacaaccaaggcaaccgcggagggtcaagctttggagagtttatgaggaccaagccacccacattcgccacagctgaagaacctatggatgctgaagattggttaaggatcattgagaagaagctaactcttgttcgagtacctgaggccgataaagtgatctttgcggcaaaccaattggaaggaccagccggagattggtgggacatgtacaaagaagcccgagaagaagatgctggagaaccaaactgggaggaatttaccatagccttccgtgacaacttcgtgcctgccgcggtgatgcggatgaagaagaatgagttcaggagactacggcaagggaataccacagtacaagagtacctgaaccgtttcactcagctggcacgctacgcgactagagatcttgccgacgaggaggaaaagatcgacaaattcattgaaggcttgaatgacgagttacgcgggcccatgattggacaagaccacgatagtttccagagtttaatcaataaggtcgttaggctggagaacgaccggaaggtcgtggagcacaatcgtaaaaggaggcttgccatgaaccgcccgcctcagaccgcaccccagcgtcctaaagggacaaccccctcggcatggagaccaacagtggtgacaaccagtcgacctgccgcctccagcaatttccactggccggttaccattcagaatcgctctcctgcgccaaatcaggccgccactggatcagtaaggccaggaagctgtttcaactgtggagagtatgggcattttgccaataaatgtcctcatccaaacaagacacccattcgcaccggagctaatgcaacggctattcacgggactgctacccctgttgctggacgaggtctattcaggactccgcagactaacaggaccgctaccggatttggacgcgggcaagtgaaccacgttcgagctgaagaggcccaggaagatcaaggcgtactgatgggtatgttttcactcaactccactccagttaaagttctcttcgattcaggagcatcgcattcatttatatctttgaaagcaagtcaacaacacaatttaaccagagttaaactaagacaaccaatgttagtacattcacctgggggtgagatagcagtggatacagcttgcattgacgtacccatccgccttagggatgtggtatttccctccaatcttatggtgctaataccccaaactcttgatgtcattctgggtatggattggttagcaaagcatagaggaataattgactatagacgtagagaagttaccctgaccacaccctggggatcggatatgagagcaaccatggatcaagatcctaggctaaccgaacgtgttggaggtatatttaccatgctacccctaaagggaatgcccgtagtgcagcgatttcctgatgtgttcccagaggatttacctggaatgccaccagatcgtgacatagagttcattattgacctgatacccggaactgccctcatatccaagagaccatatcggatgccggtcaatgagttagaagaacttaagaagcaaattagggagctgcaagaaaagggatttgtacgccccagttcgtcaccttggggagccccagtgctattcgtcaagaagaaagatggtagcataagaatgtgtgtggactaccgctcactgaacgaagtaactatcaaaaacaagtatccactaccacggattgatgatctttttgatcaactcaaaggagctaaggtgttctctaagattgaccttcggtcaggataccaccaattgaaaattagaaccagggacatacccaaaaccgcgttctcaacacgttatggattatatgagttcactgtaatgtcgtttggtttaaccaacgctccggcatactttatgaatcttatgaacaaagtgttcatggactacttggacaaatttgtggtggtattcatcgatgatattctaatctactccaaagatgaggaagaacatgcagagcacttgcaattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacggaatggaaagcacccaaatctgtgactgaaattcggagttttctaggcttggctggatactaccgacggttcattaaagggttctctaagatagcccgaccaatgacacaactactcaagaaggaaaagaagtttgtgtggtcagaatagtgtcaggaaagctttgagcagctcaaagaaaagctgacctcggcacctattttagttcttcccgacatcaggaaagactttgttatatattgtgatgcttcaaggcaaggactaggaggagtactgatgcaggacggaaaagttgtggcctatgcgtcgcgacaattgcgaccacatgaggaaaactaccctacccatgacctagaactcgcagctgtggttcatgcgctaaagatttggagacattatctaattggaaaccattgcgatatctacactgaccacaagagtctaaagtatatcttcacccagtcagatctcaacttgaggcaaagacgatggttagaattaatcaaggactatgatttagaggttcactatcacccaggcaaagcaaacgtcgtggccgacgctctgagtcgtaagagccattgcaatcatctgagaatggaagggatggtccctgagcttagggaagaaatagctcagctgaacttacatatagtaccccgtggacagataaacaccctggacattcaacctcttttgagaacccaaatagaagaagcccagaaggacaacgaggaaatccgagaggtgaaggaacgcttagctgcaggacgtgcaaaggaattttcaaccgacgaaaatgatgttctatggtataaaaagagaatttacgtacccgaacagggtggactgaggggattaattttaaaggaagctcacgaatcggcttattcattacaccccggaagtaccgaaatgtaccaggatttgaaggagggctactggtggcccaacatgaagagagatgtggccgaatacgtagcactctgcgacgtatgccagaaggtgaaggctgaacaccagaggccggcaggtttgttgcaacctctcaggattcccgaatggaaatgggatgagataggtatggattttattgttggattgcccaagaccgcaacaggatatgattccatttnnnnnnnnnnnnnnnnnnnnnnnnngacggcgagattcattcccgttaagacaaattatagcagtgctaagctagccgagttatacatgaccaggatagtatgtcttcatggtgtacctaagaaaattatatctgatcggggcacactgtttacctcacatttctgggagaaagtccatgaagccgtaggaagttacctcgcatttagcaccgcttatcatccacagacagatggccagacggagagaaccaaccaggtcctggaggacatgctgagggcttgtgctatggattttagcaaggactgggagagatgtttgccctacaccgaattctcctacaacaacagctttcaagcaagcctaaagatgtcacccaatgaggcattgtttggtcgaagatgtcgtaccccgctaatgtggtccgagactagagaacgggcggtatttggacctggcattattcaagaagccgaagaaaaggttcgcttgatccgtgaccgtctaaaagtggcacaatcacgacagaagatttacgccgacacccgaagaagaatcctggagtttaaggaagcagattacgtttatctaaaggtttctccgatgaggggaacaaaaaggtttaaggtcaaaggaaaactggcaccaaaatatgtgggaccattccagatcatcgccaggcgaggagaagttgcatatcagttacagttaccagagaatatcgcggatgtgcacccagtcttccatgtgtctcagctaaagaaatgtttacgaatgccggaagagcaagctccgctggaagagattcacattagcaatgatctcacatatccagaacacccgatccggatattggatgaagccgaaaagaggactaggagcaaagtgtggcgtatgtacaaggtacaatggagcaatcatactgaggatgaagccacctgggaaagtgaagaatttttgaggacggaatacccgcatctattcgaaaactggtatgaaatctcgggacgagcattatttaagggggtaggtttgtaacaccctgaaaattcgatcgacaaaatcaaaactctaaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatataaattaaaaataaagattgggtgtggatagtaataaataaaatattatcgcgaccatatttggatcaattaaatttaattacgatggaataagaattaaccctaattaaaactcaaataaattatataaaaataaaatatgagtaatattaatctagggtgaattcattagttaaaatataaaattaatcagaagcgggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccggaccgctcggtctgatgatttaagactatgcctgcgggcctatgatgtaataatattattacatcgtattagacactcgtgtatgtgcacttggtattccagctatgaattcgtgtgtaccaaactacttgatccagggaaatggtactgtttatacgattgattcctattataaaaacggggtccacaacatagtaccaccatataggacatgtacaaaggtagagtcatggtggagtacacagtaccaccatataggacatgtacaaaggtagagtcagatatgagctctacattatttagatactagcatcctacaacagttagagacaatatggtttctaatcattaatgtatcaaaatactttttcttacttttattttctttcttccaccaccatgcaactaaatttgctctaataaatgctaagagtcgactctgaactgttgtcatgcataacaaccatacccatttctctttcttccatgtcatcgaatttgcttgtatgacaatagagagagaccactataaacggttgtatatgctctaatgcttgtgcttccccatctaatataggaatttaattgcataattggtgattttaccactgtccactgtggtttgtcgcgaccgtgggatgcgagcatagatacaggagggcttctttaccaggggagcaaggagggctacgatgggtttcttttttagtgaacctgcaacagcctcacattgtactagcggattcttcgtgctttgctgcaggaattactaagtaattttttatattatttttcgttacaattcagcgaggagtaaaaagaaaaaaaaaatctcaggacttatcaatatttatcatgaaacaaatgaaattcgtactttaatgtagaacatgttgataagtatatattaaatattataaaatgatagagagatttgtaaaactattggggaaatgatgtgagaagtggtgagtgaatatgtgttgatgaaaaaaacacacactggcctagtagatttgcttaactccagtgcaggtccaaaatcttgctcttgggttcaaaggcgtgctagttgatttgatcctgtaatcaacaagaaggaaaaacaagaaaaacgaggttaaatccataaacaatagccgattggcttagggtcgatgacatatcgttaatcattgagccgacgttattggcattagatcggcaatgaagattaaatcaatataaaattaaatctactcaatcagctgtagatatcaataatatataatattcctctcgaaatatatttaaaccaagtgattaagatagatcgaacagtaagtcgaggcagtataaatcacttatgcttaaaagtactttaagacgaatattatatatacactcatagcatagccgattagatagatttaacatgtgtcggctaatactctgataccactctatatcaagatattaaatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcgaaagactagggcgacggccacaagcgcttgacggctggcacgagctagacaccaaagccttcatcttccaggaactccacttctgggtttgggaaaaattgagcaagactgagtacaaccaccgtactcaacaagacacacccacaagtgcagaataaatgcaagggagtacaaggggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagactgaactagcaacccgaccctgggtcccagctcgtcccaagccaacccaggccaaccattccacattttagttgttaagcaggttttaagaattaaaacattaacttgggtacattgctcggcttgcccataaccgagggcgcggctatttgaatagattatactctgatcagaggtgtacatctttacccacaagacacatcttcctcacgtgtaaccacgtgtcacataccaccacggtatacggacggaagatgtgacatagtttccaacccatcctagccatagacaagagtaccgacccaaccccacctacggccggaacccctaggacaggtaggcagaactgagcccctagcagcaggacaccggccctgtgccatgacatctcgactaccgggccgcagctcgtgtagctttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagatgctactatcaaaaccatgcaccccgagcccagcctaaaaccattttgaggattttgaataaagggggaggtgtgaatccaattccacaataatccaaccattccatagtatccaggtgatatgaatatcccaaagtctagagttgtaaaaccgcctaatgttgcctaattaagcggcgaagcatctaccaaaaatcatactagtggtaccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaaaataattttataaactgggattcaatatattcaaggatgatgtgacttgccttgctcgctttccgaaacgtcggcttcaacctccacgaagagcggatcttctgaagctgcagcgtctacacgaccaacggaaaagaaaaggcttttactctaataaaatccatataacaagcaggaacaaagcacaaaaatgggttcttgacttcttaaggaaaaattagagacttgaacggtccaattctgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccatgggagtggggcccacgcggcagcctcacggtccacggtggaccgggcgcacccgggctcgcaccggccggcgccgtgggccccacgcgtcagccgcacccgagggcgcgtgcggctgacggtcgggccccacgcggcagccactcggcgcgcccgagggcggccaagccggcgcagccggcgggaggcagcgcccgcccccctatggtcaccggcggtggccataggcacggcggagcggtggccgagagaggggaagggaagggggaaaacaagcggcggtccatggctcaccctaggtcgacggcgaagacgaaaaaggcggccggagcggaggaaggcggcggcacggctcgggtcgacggggtcgacggcgtttcggcggtcgacgagcgaaacggaggggtggacgaggtcggtgaggatgcggtgaagccgaaggaggcgacgccgaggtgggcggtggtccggggcgacgacggcggcggaccggagcttggcggcgactgcggagagagagagcgacggcgcgagctcgatttcggcgaggaggaagggcgcctaggggcgtaatgccatggtgtgtttccggggagggtttctatacagccgggccgagagagggtgtccggaaaagaaaggaaaccggcgcggcgctctcgggctccatcaatggcgccggcgggattagggaagggtttcctaatgaatccaaggcagagatgtagggaaaattgggggaaaggaagagggaatcacgggaataattcccccctattgattgcacgcggggaggacggaatgcgncggattcgccgacgacgcgggcgcttggcgcgggcggaacgcgggaacggcagaagaaagggaatgacgggtgggccccacccgtcagcgagggtggcgggcgggcccgcccgtcagcggcgcgcgctcggggagaggccggatgggccgcgggggagaggagagagggggagggagatgggccggaccggcccaagggagggaagggggacttttagtgtttttctttttataaaatcattttaactttgtttatttcttaataattattatttgtgctctgaaaattccactaaaatttatttacgcattttaggcttttaggaaatatacaaaaatcctctaagccttatttggcttttaactttgcacattttaattgttggaggctttcacacggattttaattattctaggcatcatttaagggatatattttagagtcgttttgggacgtgacattaaagcagacaaaatatatcaaatagtaagcctaatatactttaatgcaataagatgttaatttaaagggcagacttagcatattaagtgaacatgtaaagattaaagtagctaaatccggtaagatcggctgaaacctcgatactgtcagggttacggataaggtataccctctatccttggatataggttgtatactgatatggtatacccgcgcgtatacggatagttcctgtatgcgttaaggaaatctatcacgtgatagaaacggagtccacagatagaaggaatccgactcgaacagaactgggtcgttaccatatcgtgaggggtccgatatctccgagttctacttagagatcaactgatccgtggtataaaaggtaccccctgggtaagacctaaggcatcgaatctcaccgccaacacatccaccacagcctacgaagccgaagcctacaggagccaaatcgccgggtgatctagtcgaaccaactcgactacggtctcgtcggtatcatcgagttccattattccctttgtaatatgtgattttcatcatataatctcataccaactggattagggctattcctatcaagggtcctaaaccagtataatccttgtctttcgtttgcttgatgtcgtattgcatagatcctcgttctaatgtaccccaataccctctatatccggtctacgggtttcccccatcgacagtagcgcgccatgtagggggacttggtgctcaaggttctactagtatgacttcaagccttcttgacgacagcgtcaaccccgccatcaaccaaggatcttctaactcaacgatgctggtgtggacccaagtcggcgaaatcgtcttcccggtctacaccacgatgccgatcttgactggcccagcaatggctggaagcgagagcgacgtggttacgaccccgacagactccatgtcgaaggatcctcccgtaaaagcggaaaacggaacatcgacaacgtctgagcccgagaaggatcctaatgtggcccaatcttgtccttccgacaagaagtacgagccgacaaggacaacttccgaggcaacaaggtcctggtgtcctatccataaaaccagaaaacacaccttgcaagcttgctgggattttctcgacgtacaagccgaaatccgtgcttgcagagagcgcggaaatcaatgaacttctttaacccgtgatgtctattgtcctatccacaagacaaagaatcacgacctctcaagctgcaaggttcttctcagtgtcatgaggacgtcacctcctaaggtctagcagtcacaaatctctcctagagatacggacaaggaacgagaagcggcagctatctcagatcgattcgttggggtactcgatatcgatccccacgagccatctgttctacatttgctcgaagaccaggcctcatcgtcgacaagtacaccatgcgacgtgtacactgtcgatgggactagcacatctagggacggcaacacggaagcggagtatcaagtggctacaccggcccagcacatcaggaccatcaatgcaatactgagggaaactccttatgatcccgtcctgaacgcggatctcgatcagtggacagaacgactacgggaatcagtggccaacctcagtaacgcgttcgaggaggccgctgccagggcaccgccagagtaaccggcggctggcggcactaatagggaatagcctgcgcagcggacgccacctcgtcaagctacccttctgcctcgcggcgccagtgatctccgcgaccatctaaaaggccgccgagaagcacgacgcgcccaaggcaacgagagtcgttcccaacgtcgtgtctcttcgcgacatcgtgagaacgaagagcaaggaggacatctcagcgagaacccagaccgtgataatcgccacaaccgccgcgaacatgataatcgcgaacaacgggtgcctggcgatactggtcgaggacgccgacgcaatgatgatgacgacggagatcagcgccagaacaacaatggtgggcggcgacaaggttctcgagaacccgagcgcacaccggaaccgagtgtagacatcggatagacatccgcggaggacacatgatcgccgacaacccactgcccctggcgacgggtgtagggctttcagtcgtgccctgcgagatgtccgattgcctgagagatttcgaccgggagcaatagagaaagacgacagaagcaccgaccctgaggagtttcttctagtttattccacagtacctacgctgccggagcagatgacaacgcagtagcaaattatttgccggaggcgttgaagggatctgcacgtacatggctagttcacctcctgccctactcgttttcttcatgggcagatctgtggcagcaattcgtcgctaacttccaaggaacatacaactgccacgcgatcgaggacgacctacatgcattgacgcagaatccgggcgaatcattgagggactatatttggcgcttcaatgagtgcagaaatacgatccctgagatcaccgatgcttctgtgatccgcgctttcaaatccggtgtccgagatcgctacaccacccaggagttggcgacaagacgaatcacgactgctcgcaagctattcaagattgtcgatcgttgcgctcacgcggacgatgccctaagacgcaagaacgacaagccgaagatagggggagagaataaactagccaaggacgcacctgagtcaagcaagaagaagagtagcaagagtgggaaacggaaagctcgaacggaggtcctcgcagcagaatatgcagacccacccaaacactcagacccacaaggcaacgacacgaagaaaatatggtgccctatacacaagtcggacaagcactacctagagacttgtttcgtcttcaaaaaggcactcgtgaagcaactggcattgaagaagggcaagcgagtacgtgtagtcgagaaggttgctgaagcaactactcaggactcagactcaacatacccagactccgatcttcatgtttcacacatgttcggaggttccacggcgtactcctcaaagcgagagtacaagagagtggagcgcgaagtttgttcgacatggcagggggctgcatccaagatgaagtggtcagagcagaagatcgaattctcagaggcagacgaccccaagactgctgtcaccccagggcgatatccgatcgtggtcgaacccactattcggaatatcaagtttgcacgggttctcatcgacggcggcagctccatcaacctacacttcgccagcaccttggacgcgatggggatcccacggagcgagttgacgcccactgatcaacccttccatggaattacccctcagtcgtcgtccaagccattgggcaagatcacgcttcctatgactttcagccaagcaaacaacttccgaacagagcagatcacctttgatgttgctgagtttgacacagcatataacgccatcatcgggaggattgcactcgcgaagttcatggccgcatctcactacgcgtatcaaatactcaagatgcctgggccgaagggaacaatcactatttagggaaacgcgaagctggcggtgcagtccgacaagcggagcctcgacatggtcgagcacacccccaacccacccgccacagctgagccacccaagaaagtgagcaaaacaaacaagacgccgaagccagacggcgcaatcaagatcgttccgctctccagtgccaacctcgacaagaccgtcaagatcggggtgtcactggacgagaaataggtactcgcgctcatcatcttcctccgtgacaatgcagacatgtttgcttggcagccgtctgacatgtcgggggtccccagggaggtgattgagcacaaactcatggtgagaaccgatgccaagccagtaaaacaaaaactgcggagatttgcaccagaccggaaacaagccatacgagaagagctcgacaagcttctcaaagttggcttcatcagagaggcactccatccagagtggctagccaatccaatcatggtgcgcaaggccaacgggaagtggaggatgtgcgttgatttcacagacctcaacaaggcgtgtcccaagcatcacttccctcttcctcgaatagaccaactagtggactcaacagctggttgtgaattgttaagctttcttgacgcttactccggctagcaccagatcagcatggcaaaagaggacaaggagaagacaacattcatcacgccgttcggtgtattttgctacgtcaagatgccgtttggactaataaccgcaggaaatactttccaacgcacggtccaagggaacaatgtcgaggcctacgtcgatgacattgttgtcaagactaagacaagcgactcattgatcgatgatctccgggaaacgtttgacaacctccgacgatatcgactcatgctcaatctagagaagtgcacgttcggagtaccatcgggcaagctactcggattcctcgtctcaggaagaggggtcgaagcaaatcccgagaagatcaaggcaattgagaacatgaagtcgcccacaagactcaaggaagtccagaagctaactggatgcatggcggcattgagcagattcgttgctaggatgggagaacgaggacaacccttcttcgctctgctgaagaaacaagacacaggaagccgaagatgtgtttatcgcacttaaaagctacctgtcaaatccccctgtacttgttgccccccaacctaatgaagaattattccgctatattgccgccacaccatattctgtgagtaccgtcattgttgtcgagagagagaaggtacaaagaccagtttattacgtcagtgaagctctctacgacgcaaagacaagatacccacatatccaaaagctgttttatacagtaatcatgatatcaagaaagctacgccactacttccaagcccacagagtcacagttgtttcctccttccctcttggtgaagtcatgataaacaaagacattatcggccgcatcacgaaatgggtagtcgagctaagccaatttgatgttcactttgtgccacgaacaaccttcaggtcccaggtcctcgccgatttcgtagctgactggactatgcctgacaacaggtcagaaagtcagaccgacaacgagatatggacaatggcgtttgacggcgcactcaatagccaaggagtaggggcagggttcatcctgacatcaccttcgggagatcagttcaagcatgcaattcacctcaactttagggcgaccaacaacacagccgagtacgaagaactactcgctgggataagagcagcagccgcactaggagtcaagtgactaatcgtgaaaggggattctgaactagtcgcgaaccgggtgcacaaagagtacaagtgctctagccccgagttatccaaatacctcgcagaagtcaggaagttggagaaaaggtttgatgggatcgagatccgacacatatatcgcaaggacaacatcgaaccagatgacctagcatggcgtgcgtccagacgagagccactcaaacctggcaccttccttgacgtcctgacaaaaagaggcaaacaacgaagatagcacagtcgtccccgacattgactcgggggctacaaaggcagtacacgtcgttgccgacatcgagaccacagacgactagcggaccccactcatcaggttcctgaatagcgacgagttgcccaaggacgatgcagaagcagataaaataacccgacaagccaagatctactgtatgatcggcaacgatctatacaaaaaggcgccaaatggggtacttctcaaatgcatttcattcgacaatggcaaacacctcctcctggacatacacgaagggatctgcaagtcacacgccgccggccggacattggtcggaaaagctttccgacaagggtttttttggccgaccacgcttaaagatgcttgcgacatggttcagtggtgtgaagcctgtcaatttcacagtaaacacacaaggctaccagcgcaagcgctccagactatccctcttacttggccgttctcgtgctgggggctcgacatactcggaccattcccatgaggacagggcggctataggttcctattcgtggcgatcgacaagttcaccaagtggattgaagcaatgcccacgggggaaatcaaggccgacaacgccatcaagtttatcaaagggatattctgcagatatggtttgcctcaccgcatcataatagataatggttcccaattcatcagtgccgacttccaggactacttcatcaaattgggagtcaagatctgcttagcctcggtttctcaccttcagagcaatggataggtcgagaggacaaatggcatagtaatacaagggatcaagacccgtgtctacgacagactcatgtcacacgacaagaagtgggtcgaagaactcccctctgtcctatgggccgtgcgtaccacaccgacaacgtccaacaaggagagacccttcttcctcgcgtatggctcagaagctatgctccccacggagctacgacatcagagcacacgagtacagaagtactccgacgagaatcaggaggagcagtgaagcgacgatgggaatctactcaaggaacatcgagaaagagttaccgtcagagcagccagctaccaacaggcccttcgccgataccacgagaagcgcatcagagcacgcacgctttcgatcggcgattacatcctccgacgggttcaaagccaagcaaggcgtaacaaactctcacccaagtgggaaggaccatacacgatcacgcaagtcttgcggccaggtgcattcaagattgcagacggcgatggtcgcgagttagcaaattcctagaacattgatcaattacataacttctatgtataaatcaatagtatccatatttgtaagacatcttacgatttcaataaagttgatttcaggtgaagattacgatcaaagtgtttctttccgacgatcccttaccacgatgacacctagcgctgaaacctatcctcatgtccctttccgccgtcttgacaaggcctctgaggaacttaagggaacttcggctggggacgcccagagtggataaggccttgtcggatcatgtagagacaaacgaccatgtaagatctgttcatgtaagagttcttgccgtgcgtattaaccaagctgtgtaattggaaatttagttttccaacttcacggctgggggctagggtcagtgctttttcaaccaaggcaggtcaggggtccaagagccttatcctctgagaacgattcttcgacgacaaggttgggggctagggagagtgtatgactcaagtgactgatcgaagtcgcaaaatgagaaaacacccatacacaacatatccagagtaagagagcttagctagatagatttcttttctatttcacaagtacctcttacaattcgtaaatattccaaaatatattacatgtttccttgagatattttctacaagatacaaagactactaggacggccaacgccagtccatggactgaaagaccttctctgcgagcggcgccattgactgtgcctgatcgtcaatctctgcgggagtcctccgagagcgtgagaacccttcgtggaggaactcgaggtgcagctgcgggcggtgatctcggatacagtccagcacatgccctctggcatagcggctcgatcgatgacactcctgctttagggcctcgtcgatgcgcttaccgatcccttcgagctgtgtgcaggtcctattcaaccacgagatatatctggccgctgactcctcgggattcccgcgaggaactcggagtttcctgcagactccagccattgccgtgcagcagctcctgaggtacgagttgaaccatacctcgcgacctctgagagcttccatggccaggtctttcttcacttccaccatggtcttctcgagttcggccacctcgagcttcgtcctccagtattggattcgacgatctcggtcggccaacgcactctcgaggtctgcccaacacggaaaggactgagtcaggttcttcttctccctcgagaacacagcaaattaagtcaatccgaacaaaagagtggaggaagtaaaaaccaaggtgcaaacctaaggacgtcatagccatattcgtctccgcggacaggtcttgaccgacatcctcctgcgacacgtacggctcaagcgcaagtgccgggacgattaccggcatctcaggctgcccgtgctgctggacatccttgatgtcgacatgtctacaacgacaacaaaagtactcggaatcacatgctaagaaaacaaaggaaacagctgcatacataaaagcggtcagaacctgcggaagtttttacagcgtgttgattaaggggtacaagggaaacaggatcctactcttcaaaaaggggaagaactgactcccccaagtcaccgacttcctccatcacgcctttgcgcgcgtcatcggcggccccttgatccagagcccttttgaggtcaaggtcgggatatgccagcttcacgcatgcaaggatgtggcatgccgcggtgtagataccgttggacgtctcctcgcagatcctggcagcatgcttggatggtggtcgtgacgccgcactccctggcgagctggtgtaggccggtgtaagatatccgcagcgagccgcggatctccgacaagttgttctcgagctccgacatccggtgctcgagtccttgccgctgcctttcgttgccggccaccagcttcctcatcttcaggaggtcctcgcaggcctccgctaggtcgtgtgccagcttgtcagcgcattggttcgccgacgacaccgccgtcctggcctcctcgatcttgtggcctacgccacgagcaccagctggaggatgcgctccatctcagcctggagctccccccaggtgaggacatcagcaggcaggccccgagcgggcacaaggccgtcggcggggccgcttggcgtcacctcccagtccctagtcaagaccacgacatctgtcgaggccactacaagggacgcactggagcccgcaccggacccgtcttgtgccaccttcgcccgcgccaccctgcgaaaaatttccgctctttcataaaatcaggcgatcaaggtttcgtgaatgaaaagacttccaaaaacatctacttacttctcgccgatcttcacccgcctctgccttcactgaggcgggggagacgcgtccgtgacctaagcaagatagcatggtgtgaggttaaaacattccgattatgcgttaaaaaaaagaggcttaccgatggattaggcgcctttcgacgggtcccgagtacagaggagaatttcctccccttctttggaacgttgctgccgcttgtggtagaagcagcgacgtcagatgcctccttcgcgatgccctctttcaatgaagccgccgcttgatggtccgcaagcggcccgatgacgtccgtcagagggagggcctgtgcaacatgaagtcacaacacgatcctggcagaaaaggggtaatggagtcatcgagtacactcacgttgatcgcagcttcgcgttcagccggacccttctcgcaaagggggacggggatgttgctcgctgtcacaggagcgctgatcatcacctggccaatgcggcgtgccatggtgtccctgtccaaacctgtagatcgaggacagggactcgatcagtcaggagaaacagacacatccggaacaaattctggaatacaagaaaaataccacgaggagaaacccgggtcgcgtcctccggcccagagtagtcaaaggccaggcacgagcctggagcagttggatccgcctacctacgaagtcggcaacgacttcgtaccatgacaacccccgtactcagaggtcatcgataatgtcgatgaaagactggagggagggagtcagggcgggtttggcggtacactctggaatcttgtctggttgttcctcggggacaacaaggacaggatccgagttttctatctgaagatagaaccatctcgcccgccatttactgcgagaggaagggcactagaaggggatgtaacatgacatccggccatcccgaagtcggaatccaacgcatccagataccctgttggatttcatccagcgcaactcgtagtaaaagcggaagggatcaaggaatggctctaccccaatgtaggcctcacaaagataagagaagatactgaggaacgcgatggaattggggtttaggtgaagcaaggaaaggccatagaagttcaagacgagaagaagaaattcggagggcggaggaagaaaaacgcaagaaatgtaatcctcaacctcaaccatgcggcccaagatgggttcgggttcagtacctcctgtttccctctgcatggtcccatgaccagggagggcgccgtcgtcttgccacttctttagagacgcggtggtggaggtagacttatcgagatccatcgccgccggaggatcgccggagaacaaagcaagatgagcaaactagggtttttttttgcgggagcggagaagacgaagggcgtttgaagaccggagtgttctgtggcaaacggacttcaaaatggatccccaaaattcctttcaataagcacactaccgacggtgcgtattccaagcaaaggagagagattgccgccggaaaattctaggtccgttacgcgcaacggttttcggacttcaatttaaattcactcgtgaccgttgaacttcgtacgatgttgtcgataactatgtgtatctacggttatcacaccgagatcgactagatgagaacgacaacgattctgacatcagaagtcgcgatcggttgcatgagttcatttaagcagaagtcgggggctactgtcggggttacggataaggtataccctctatcgttggatatatattgtatactgatatggtatacccgcgcgtatacggatagttcctgtatgcgttaaggaaatctatcaagtgatagaaacggagtccacagatagaaggaatcctacttggatagaactgggtcgttgccatatcgtgaggggtccgatctctccgagttatacttggagatcaactgatccgcggtataaggatcccctgggcgggacctaaggcatcgaatctcaccgccaacacatccaccacaacctacgaagccgaagcctacagaagccaagtcgctaggtgatctagtcaaaccaactcgactacggtctcgtcggtatcatcgagttccattattccctttgtaatatgtgatttgcatcatataatcccataccaactggattagggctattacctatcaagggtcctgaaccagtatattacttgtctttcgtttgcttgatgtcgtattatgtagatcctcgttccaacgtaccccaataccctctatatccggtctacgggtatcccccgtcgacagatactatctctattgatgatcataagacaagctagatattgcagttatgaatattacttaatagatcgaactcaatcgaagaagaattaagcataataataaatacaagatccaaacatgatgtgatcatggctaccacggatgcaatcattgctcacatcatggatgaacaagaagatatcgagatcaagtactccaagtgctggaatccgattcggctacctactacactgctgacttcaaacggccaccgaatctgcatacgacctccattttcggcccgtgagtagttgatggaaagctctcggagccctctttctaacggatccagcctcttctctgaattccatctcgtgtggccggaatcacaggaacaaggtgctgcgtcacctataatgggcttatgggcttgtaacttcatttgggaccccggcccaggtggggcccatgtggggtgcgccccaagctggtggagcacgaccctaggcacccctaggttgtcctcccacccctatatatagctagttaccccttcagggtttctggggttttgatagattaaagtttagccattgctacttgcttgcagtgcgcgtgtctgctagactgtccgtctgcttgttcttcggaaccccaacttatcatttgtatt

SEQ ID NO: 57627 - DNA, 49140 bp, Oryza sativa
  unsure (1)..(49140): unsure at all n locations
cataggtgaaagactagcactatgatgtacgtatacgtgaataaaataatttataactattatgatcgttattgcctgcacacacatttttatgatgcataactctgtcaatgtgttgaggctattggattttttaaaaataatattatttgatggaaaatggtaaacaataatttctgcctcattataatcgtgaaagtagaagccaatcgaactcgtgtcgtgataggaggcttgtcgaacagcacaagttcgaccgagccatattgaccgttggaaacacggcgagccagaccaatcaaactacgagtggtacaataggggcttatcgaactttgatagttctactgggcccacaactaacagccgcaggccctgtcgaaccacagtagctcgactggccccagcatatcccatatcgaacaatgggcattcagtacaaccctttaaattccttccccacagctcgacaagggtcattttgatctgtagagggaggactagttagagggcagatcggcatctgcaggggatggggagtgaggagaccacacctgcggatagcgggagaggagcggcggtggaggcccttcctcaagtgatattaaattcccaatccctaagttacatgtttgatgttagcacaggtttaaattagttttactagattagttagagtagttaaatttgaagttagtacttggtgagtacatatcttttttagttagtattaatttattattatagtgaaaaaggtttttgttagcacgtatgtgactttgtgcttagttggtggtagtaaaaattgacacggagtattaagttgaagttgaacgtattttaatgaagttgtattgcatgagtaaaaaccacatgtgaaattattgggtagtaccatggtaagacaatttttcatgttctatcaagaatagatttagaatgatttaggccaaaagcttgctctagttataggataataggatggcaattcaaagctttcaatctcagcctcgctcaaacgaaaaatcctttttgcatacggccagatcaatttttcgcatgctcatgtggaccgcatgcaaagataaaaaaccaaaaaaattgcaaaaaaaaaatcacgccggccgctcccgctgtcggtgacgtgccagtgtcgcgccgtccggtcccgccgtcgaatctgggtaggaggagccctaccgcccgctgtcaaccgctgctaccgagccgccattgcgccgtccacttccgccgccggatctgggtggaaggagccccgccgctcgccatcgcccactgctgccgagcgggggatggccgctgccaccggatccgggagggagaagccctgcctcccgccatcgaccattgctgctaagctgctgtttcaccgtctgctctcgccatcacgggagccgctgcggacaccgctcccgtcgccgaattcgggcaggaagagtcctaccgccagccatcaatcgttgttgccacctcgtcgtcatcgttgtcggtggctccaggtgaggaaagggatggtggcggcggcgcggcccctagccaccgccttgtcattgtcctcggagatgaggaaggggatggcaggcggcggcgctgccgtccgccggccgcccactcgaagggagagagagagattgaggagaggaagagagaggaggagaggagagagaaatatctggagagggagagagcggagaggggtgaaaaaaatttgaagtggtgaggagggaaagaaagaggagtggagaaaaaagagcagatatttttgcatgcggaccattttaagggcccgcatgcgcatgcggcccttcaggaggactgcatgcaaaaaaatattcattttcgcacgcggctccttaagacgtttgcttgcaaatattgatttttgtatgtggatctcttaaaaagctgtatgagaaaataaatgttgatttttgtagacacggtcagttatggttcatctgcaccctaacgtggatctcgtccaggaaattcgtctaagtagtagtgtattgctactgatagtagtgtcaattgttctgccaatgctgtcgccgctgttgtttgtgaaggttaataacttatatttctgttaaacagttttgtcacctgtgttgttatttgtcactttgtcaatcgtgttgggtgctggtcgtggtcggtatcgtgaactatgttgggttgtaagtgaattttttgtcatatttctttttagtattcttaacatcacaactggagaactgatctttcgtgggtcatgcaaaaaccacattagtcccggttcctattcgaaccgggactaaagatcatcatttttagtcccagttaaaaagcgcaacgggactttatgatctttagtgggactaaatatcatttttagtctcagttagaaaagacgtcaggctacaggatgtagcgtgtcaggccccaatatctttagtcccggttgtttacaccaatcgggacgaaacatcgagaaaatcacgccgagccacacgcctccccgcctcatcttatctccttcacacgtctcctcctccttaactctttcgcacgcctcctcctcctcctccccctccttatctccttcgtcgctccacctccactcctcctcccggcccgcttcacacgcctcccctcctccccttcccctttccgtcggcggcatgcgaggcggaaggcgccagcgggcagcaagatctctcctccccctctcctctcctccccctcatccccttcccctctccgtcggcaaagacgacggcggcggcatcaggcggaacagcgttggtggcgggtggcttgccaagccgccggggccctcctcctcctctcccccatctattgtcggcgaggaggatgagaagcaagagcaaggaaagaagagaataaagaaaaaaaattgtgaatgattttgttgtagattttgtggatgattttgttgttgcattcgatctgtgatgttaattttgatgttgttgcattcaatatgtggcattggaaaaaaacaatatgcaagcaacaaaaaagcaatggaaaaaaagaaaaaaaaactatagtccgggttagtgttaccaaccgggactataaatggtagcgctagccacgtggcgctactatctttagttcagattgaagttactaaccgggacgtcccggattcggggtcccagtttacaaccagggacgaaagggagttataaaccgggactaaaaaccacatccccaatattcatcttccccaactgtcaatattttgcatttacatgaacttaaggatgatgctacaagctggtgctaaatgtgttgaatgtttgcaacagccaacaatgcaaagaatatagtactagtcgatcttttgtcggtaatctcattgttttacccagttatagtcctcatatttttttataatatattccctccattctaaaatataaggcacaaccacccttaatctaaaggccaagaaataattattatcagcttgtagtttggatcactctaataaatataatgcatgcatccaatagaattagagaatgtgagagtaaaggatttaaaaatgtaataatttaatggagaagatgccataattaattgcatgcatgcatgccttatactatggaacatcttaaaaaaagtggttgtgccttgtattatagaattgagggagtaatatatagatagctacatatagatatcgtataatctaaacggagaggcctctccgtttagtcatatcgcgagacacgcatgggagccgtcgatcggtgcgcgggcgacgtggctttcatccggcgcgcgcgcgtgtcccgaccgcgtgtcggcgtcccaatcgagcgcacccgcaccgcttttctgtccaaccgcaagagagagagagggctttcactgttcaaaattttgggtggcgctcgagagggagaggggtggagagagggagagaggcggaggcggcgagaatctctagcgaaatcatcggtggaggcagcggagacgttgccgcagcggcggtgtgggaggcgggaaggtgcgcttgttttcatggcgtcgcgccggcggcggacggaggcagcggtttttttctccacatctcgccggcagttgtggggggaagcggaggctgcggcttaggtggttttctgtccaccaaatccggcggctgtgctgtaaggtgaggcgtgcatagaggtggttgccatttttttttcagctggggagaggtcgattgatttttttttgtgcgatttttgtgccgggagaggtggagagacttttggtagtttcactgcacaatttttgtgcgcgatttgtgtgtgatttttgcgccgggagaggtggagagattttggtagttttcgcttcccatgtgtgcgattttttgtgctccacaaacggcctcttggtttgttttctccccctataatagctctatcccctcatttcccctctctagctctccctcatttcactccctctctatctcagctaagttacttccaaaatgtactgacttacttctaaacacataaatgttacttcctactagttgttaagttgtaatttggttagtttttggtgaaactaatatttaaaatgattttataggaatggctaggaagaaatccagtactgttaacaagtaattcagtacatattgtcattctggaagtaagttagtactgtttagaagtaactcacacattactaggaagtaagttgacacatttgcagagtaactaattacagttttgtgttgctgaaagtaaatcagttttgtttttgaagtaattcagcacatattgtgattttctagaagtaagttagtgtatttctagaagtaacttacacactactagaaagtaactttgcataaaacaaataccaacagaagtacctgaatagattgcccatgtctgtttttttcgaagtaagtcagtgtagtttgggaggtacttctgaatagattgtccatatctgtttttttcgaagtaagtcagtatagtttaggaagtaagtcagtgcagtttgggaaagtaagtccatgcaaattatggaagtaagtcagtgtagtttgggaagtaagtcagtgcagtttctatggttttttggatggatctcaaaaaaacagaggatgaactttatgtgtacctgtgatcttttttttttggatctactatactttcttctcctcatcaacttccaagttgatggtttcctcttcctctcccctgttcgtgcttttctgatttttttttcaccatggcggctgcgtgtggattgacgccgccggctgtccggatttgatgggttggaggggggaaggaggcgcgcagcgctctgtcctagccgggcccatgccagctataccatgcgaagcgagagccgtgcgttgcacgctttcctcttttggtaggggcgcgcggttgctttttctggcaggggcgcgcgtcgcgcgatagagctatcgcgagaccgatttcggtctagtcgcgtcctatagatatatatactcgccgtattgacgtattgatgcttttgagacccgtaacgcgtatctctgcatatcgcgaatcaataagaaaaaaaagaagaggcatatcgcgatcggaacaacagtcatgcgcgcattgtatacagtatacatacccggtctcgagggagaatggcagtgggccgtcgaatccaggaaggctcgtcacggcgacaccggccgccggcgccaccgtcgccgccgacgaggcaacccaacaaacgaagcagcaggcgagaggcagcagccaccaccaccacctcctccaatcacggcggctggtgcttctcctcgcaaccatcgcgcttgcttcctttcccatctcggctccgtaagtacaagcaactctatgtcctcatgctaacgatataggagtataaaaataatgccaggttacccaaatcgaatttatggtatcgaattgtatttatttgttgtattgattacgttggacacgtagctgtattgtatttatatcgtatacgatagtgttgctgtcagctttgattaggcgttcttttcagatttcagacagctacattatggatgttcaggccctgcttagatagtaactgaaaatttttcaccctgtcaaatcgaacgtttgaacccctttatgaaatattaaatatagattaaaaaataactgattatacatattgcgactaatttacgggacaaatcttttaagactaattgctccataatttgacaatgtggtgctatagtaaatatttgctaataacagattaattaggcttaataaatttgtctcgcggtttactgacggattctgtaataatttttttattagtgcccaaacaccccatgtgacacaccctatatagtactcgatgtggcacctgccgtcacgatcgacatttctagacaatttcaaatgcactgttcacgtttcatatttatgctgtgaagatttgatgcatgggaggatcgaagggactattggagtgtataaagtaaattgcccgtctttccctatcagcttaggcttttaagtgcaactggctggtgcatgcaacttaatatggtatcannnnnnnnnnnnnnnnnnnnnnnnnnnnnnnnnnnnacaattaaataaataattgcagcccactccaatattccacgcttaagacttgagagggtctcgtgtgagggggagtgttggagtgtataaagtaaattgcccgcctttccctatcagcttaggcttttaggtgcaactggctggtgcatgcaacttggcggacctgacaatgacggtgagggagacagccaatcggagacgatctcccccagagcggcggcgacctaggcggagacaaggccgtccgtcagccgcggagcccggcggaggtcgataagctgacggttgccatcggaggtaggggcggtggaggtaggacgacgagcaaaccgatgatgaccggacctgacaatgacggtgagggagacagccaatcggagacgatctcccccagagcggcggcgacctaggcggagacaaggccgtccgtcagccgcggagcccggcggaggtcgataagctgacggttgccatcggaggtaggggcggtggaggtaggacgacgagcaaaccgatgatgaccggagactcagctactgctgcttgatgacgatgcaaacgcccaagagatcgatctctctcaggacatcgacttgacaacgcgaaggaaaaaaaaacggtggccgcccccaggagattgaaaccctcctgggggcgacgagtggaagcgtgagagagaggcgactagatcgcccgctctgatactatgttggatagtataggagaggtatactgcgtatcgtggaacgattgtattgagcctcaaggagccggtatatataaaagtacatggggaggagataaggaaggattacagatatggaaggagtccacacaaatcaatcctatcctaatatgactctaactaccatatactctaacaagaagacattggcattcgaatatttgttccagactgacgaacactgctattctccaagtcgcaatcgatcatcagtttatcaatctcttgtacgttgtcatattggcacaccagtttttgaggtttccttcggtttgaaataccctctgttttatactccctccatcccactatataagcgagcaattttagaggggtgtaacacatcttacaactacaaatatctaaattcgtagtactaggatgtgtcacatccctcaaaaatcaggacggagggagtattaaaagtcattttgacttttttaaccaaattttgttaagtttgatcacatgggaaacattaacaaaatctaaaacactaaattagttttattcaatttaacattaaatatattttgataatatgtttgttttgtgttgaatttactaactacattttatataagcttatcaaacttactaaaaattggtcaacaaaaaatcaaaatgagttgtaatatgaacgagggaagtgttatactagatcaccatagaagtttgttgaatctctctcttatacctattggaaataaagatttgttatatgacccatgtcataaatgtagttagtatatggcatggatgagagtccacatgctatatactatgagtaaaaaaagttaaatatcccctcggaagttgatgaggagaacaaccactagcgcatcaatcttttgtcggtggccgccgccccccgacagtgaacttttatgatgctggttggcccgtattaaattgcacatgtgtactgtgtactgcaacgggaaagaccagcgctaaccagcatcattgccaatttttggatcggctgtgcacagccaccagtgtaatctttcatccatgcaaacctgtattctcgaacaagagtcaaatcatttcttcctactatatagtagttggtagaagttttacggtgttaagagatgtagaggtattaaaaaatagagaaacgtaaagtaattaacttgtaaaacaagtgtatttcattgaaggggattattgtcaactcaatctaatcggtagtaggtaaacgcaatgtaaatcactcaatcagttatttagatcggtaggggaaagaaagaacaaagatcttgcatttagtttgttagagtgcgtagcccggctcaccaaccgtgggccacacaggtcatattgggcctgctccaccacaggcccaaccggagccataactttagatcctggacctacacaacctaaaagactagtctgatgggtgaggaccgcccccaccttttaaatcgtgctcccccatcatcaattaccgatgtgggactaaacccaactttccccccatcacacatcgggcccaacaatctccaccatgtgacccatggaaattgttccgggtttcaaacctttggctctgataccacttgttataaaagttagttgatatagcggaacgacgactaaccttcccgatcgcttcaatcattattcacccaagacatgccagatgacgacacaggaaaacaaaaatatttgttaacgaggtttagtcgaagcctacatccccggagctctgattatgcgcgctcctccccaaccaatatagcttctagccgctacgagtccatggccatgccgccatcgtctccctgtgtgtctacgctacattgtagtcgccatggttatattgtggtgcgcccctctctatttaagagagatgccggattacagagtccgactgtaactccaccccctaacacctattacaactctaagtccaactgtaatcaaataggactagtatattcgacacctattctaacaacacctattctaacatagttgtgttgaagtgggttaaaatctttacttgtttgtggctaaaaaccataactcccgaattcctgtttcccttatctaccattgcggtctgtgtcaagtgcggagactcgaacggtatctgtatgacagcgggagacgaccaacgatagcaaacaccaagtaggcgtggactggcgatggcaactggcatgtgcttgttcaacggtgagggctttggcaactaacagggcagccggcggcaactagcagtgaggcaaaggcccagccaagcaagattcagtcatattttaactgatgcaatcacttatattataatctatcatatttttaggcacaatacataaatctgaaaaaatcacgcaaataatgtaatggatatgaggacgaattaacccatactgaagaattaccaatactacccttacctatgtatctatcactactgtcaaagacaatcctactcttacttattgaccagtaaaattatctttttatccttcctatctaagtatctcaatcaagtataagtatcttttgcatactacctttcactacgaagtgttggttctttactttttatttttatgcaaacaccattaaacttcttcatagttggaacccactgtagagattatgccaaccgtttgattgatacatctttcttctcagccattaggttaacagaaaagtacgaattgcccctgaactatcacggccaatcgatttacccctgtcgatgtttgatagtcacgactagggtatttggatgtatggggatcgttggtactagggtatatgcgagattgaggtaaaagagatggagatatggatttttatataggttcgggccccttatttgacaggtaatagccctacatcctgttggccgaagccggtgttgcttctttattcatctgaatcatacaagtacaacaattgggataacccatctagctgttgttgacttggcggctagataaccaactcgtagtcgacgacaaggtagtcttcctcctcgaatatgaactcgtcgagatcagagatggcgctagatccctctttctggccttcgtaggcaccggatggggtatgtctaggctaatctctgatgtcgagatctggcggcgtgtgttggctttgtgtatgttgcgtcttgtggctttgtggcatcttgtggcttcgtagattatggtgggtgtgtcctctctcctcctagaggggcttgtatttataccatggttgcccacttgtccatgtaagactagagagaccaatatggatacaatccgattagtctttatcgtttccatgtagaactatatttgtcatttcttatccgaaactccttttatatacgaggtttgtttccgtataagacatggtatgtggtgggccctgccaagtttagttaactactattaggtttgtggtatccataaacatgacaatccccttaaactcgaaaatcagacatcgattaccctgaactttcaatatcgaataaaacacccttttgcgagcggtttggggttcaactagcatacgtgacagtctagtcagtaattttttattttaaaaaatagtggagcccacctatcatattctctgttctctctatcccctctcacctatatgtgtctctcgtcgcctcgtcggaggctcagcactctgcttaattacacactaattccaaattaagttgtaagtaatcacgcaaggcaatgagcatctctaatcgcttcagctggagagctcgggagcttggacacgatgctggacatggcgaaggtggcggagccaccaacgacgcaggcgagggcgaccacggcctggacggcgacctcccttgggtactcctccgtgacgaggtagacaacggcggggccggcggcgagcagcagcagcgcgacgccgagcagcgcgccgggtgtcccgtggtcggtcgccgccgatagcacctccagctcttccgccttgtagagcaaacccagccactccaccgccgacagtgacagcccggcgcgctccgctgccgacaggagcaccgtcgtccccgccttcgtcagcagccgtagcttctccacgttcattagcagcttcaccggcggcgccgccgccttccagctcgtcgtctggcgtggccccggctctcccaacgggaagtacactgtcgtcccttgcaccgccgctcgccgctgttagctagctcgatcgatctacaagctcacacaccatggggaagaagaaaaatcgctagtcggtcagtcacttacccttcttgtgccggaggtgggcttctggtggccatggtggcgaccttgtgaatgcggcggtggctgctcagcctcgccgcggttgccacgactttggccgacgacagtgacggcatcgcctctcacctctctgtctcagttagaatttgtgtcgaatatgtgtacgtagtgagttacaatttaggacttggagttgtaataggtattaggactagagtatgagtcggactctatcctaggatctctcataaatagaggagcgtgcctgttgtaaccgcatggcgacttagcattgctgtaactctgatacgcacggctgccggcggcgaccggccgtgagtcgttgtaactttgatacgctgtatatgctggatcggggaggaacgcccgtaatctgtgccccggagatgtaggcctcggctgaactccgttatcaaatatcgtgcctcggtgccgtcatcgtgtttggatctcctatggtgtttattccgtgttttgtttccgatgtgatttcgggccggttttaaaaacaagtggtatcagagcctgtgggagatccatggtaacggtcggaaaaacggcaataagcgatactctcggagacacgggcatggcaaatccgaaacaataccaaatattccggacttggggggcatgtgttaataaccaaatttggtaatccaagtatcggagatgaagatagggtcaaagcggaatttgagatggaaatcgttccggaaacagagtaaggatcggctggagtctgaatcggctgcgactgggatcggcagagtccgagttggacaaagttagccgattgagccgaatccaacaatgtgacatggtatatgttgtcaggttgggttaacgtgcttcatgaggattgctacgcacggattgagtcctgagaaggcaattgtatctactaattaggatatttcatgtaatttccttagagatatgtttgggcaaaagtctgccgcaaagacttatggtatcttagagtttgttagagataagagtcatgtccgacacggacatattttgtaatctcgggtataaatagaccccaagccccatgtaatataacaacacacgttcaatacaatctttgcgcatcgccaccctttactttcattttgtttcgacgagttcttgctttcgggttgagctgcaacggtttcgatcttcaactacaagtaaaacttgttatggcggtttgcgttctcgggattagtgcttccatctttatgatactctaatcttgtttatgtaattcgtcgagttatcatatattctatataatctctaccaatattgtcatctaacctccaatcggctaacgtctgcaactagaaggtagccgatcaggttaaatactaatgttgacttagattatataggatatccaccactctatgaaacaaccagcggcttgattgtctatatattgttcttcttttcatacttatagctccatcagttgagtttgaccttataagtcgtgattagaatctcaatctctagcctgcttttggttgccgattagggtagcatcagggtttcagccaatcttacctgatttaactacttttatcctatatgcttgattgacatgttaaatctgccctttatattaagatcttattgcatttaagtatatttaggcttttgtttagtatattctacttgctttaatatcttaatatagagtagtatcggagtattagccgatacatgctagatctatctgatcagctatgctatgaacatatatagtcttgttgttaatatatatttcgatctaagtgatttatactgtctcggcatggtaactgatctatcccaatcacttgatttaagtatatatcgacataagaattatatattgttaacatctatagccgatcgaatagatttagttctttcttatttatccatgattgccgattaattcacatatgacatcgtctcaaaaataaatgatatgtcatcggcaactagccgatcggctatcgtttatggatttaaccgcggtttctttgtctttatttcttgttgattgcaggatcaaatcaactggcacactcacacacctaaaggcaagcttttgggcctgcattggagttaagcagatctcctaggcctcgtgtttttacatcaacaggctatagcgtcacaatgccgaagtgggaggagatggaggccagcttgattgagaggggtatcaaaccggccaccgctaaatggccggatcgatcgaagttctaatactatgctcacggtggaacgcttaaccccgttgatggctccctggtgttcagcgatcagatacgcgaggctgccagtcgactaacggacgcagtggaagcctcttctcagggcacgttccgacccgacagagagaaggacgagctgtcactcgccttgaagactcccgagcattcgggaagaacacgaggaaaaggcatggttccttggaagattggattcaaggaggacatccacacgtacaggagtcggatgaggagcaagagagatactgaggtgaagattgcagatcttgagtacagggtatcgagctacgagctcagcatgaaagaggaggtggaaaggaagatggatgaacacatggccgcacatcggtgccaggatccccagtcgtacattcctcctataatggtcagcccctcagggcaatcgtagcaactacgcctcaacggggcaggtaggatcacagagcatggatgccatgcaaactcaggatgaaaccacctgccccgttgatgaaatcatgcagcggacaccatgtgagctgcatattcccttcaagaacttatcaatcaaggtatgcccgtagtattatgttttttggacttgtacattccgcaagtttctgcctaggttgattactaatagataacctctcatcacgtgaaggttgcatcaggaatggccatcccaacggacccttcagggacttaccactgcaggccgattcctgcaggatacttgagggtcgaaattgagctggtggaagccacgtacgaggacctcgagttggagtaccctagaggagacggtgagacgtatctacgcgacacaagccacgccattatactatggcgcaagcgctacatcatcctccctaggcgacaagcggcgtttcgtgcaccatcccctctggctccaccgtctcctcctcaggctcctccaccgtctcctcctcaggctcctgcactgtctcctcatgattaggctcctgcaccgactcctcctcaggctcctgcaccgacttctcctcaggctcccgcgccgtgtcctccagcaccttccaagtcaagaactcaccaagctccaccacctgcccgcacaagggcaacgaagaaggcgaaagttgatgccgccgagaacaaggagccaccttacgactgcacgcaagaggagcttgacgcttacgtggcagcagaagtgaagaggcaattgaagcctcggagtctagaaaagaagattcctatacacccgagtgccaagaagttcttcaggggtatgtcggcaccagtcaaggaggccataaagctaacggactacaagcgaacactaaagaaagcatattatgggaagtccaaaaaagtccctcagcttggagagcaaccaagccaggaggtcgagccgttggtgacctggcaagaaattggaataaaagaattcatttctgacactgggctaactagggctcagttgcttaaaggcgaaccaatcccaaaggcggaagtgagacaccagtacgaactcggtaaaccgcttgtaaagcctgagcagctgcagtccctaccaacacagatgtacaaattccatcaacggtacatggagatgagcgccagcggtagggagattatcggagcgaggatcaagaacactgacttcttacaaggggaagatgttctctggatcaatttcaaggatatctacaaactataccagctggacgccctcgacgtctctattctgagcgcatggattttctaggtatcgttgagttatatttcttacattcctttaattagctccttgtatatatgtacacctcatataacaattcctttatatcgttgtagaatggagattcaaagggcccgacggcggggggtttttgatactagattcatcgaccctcggaaaataaacgtcgaaatggtcaccaagtatccgcaagccacagaggacaatcttgaccatctcctcaaggagtagcatttcaagacgttcatactactgtcgtacagcacaacgttagtttttactgtctaccgaacaaatttcgttcctgtacaaatagatgtacagtgtttcatatatcacctcacacaaattgcagattccactaggtccttttactctttgacttggaggaatgcagagtcaatgtctatgactcaatgaataaagatgagtctacttttgaccaagtttttgaacttatagacaggtaatgtcatatattccagtgttattattacgaattttgctattgctagtacgaatcatatctttaaactccatgtagggcttggtatcggttccgtcatttggtctgcgacacttggaaagaaaatttttcgccggaggttcaaatttgcattgagtacatgatctaaatttatattcaatctataattcaaatataagtgtatattaattaaatctctcgtcgtttgtgatgtatgtagtgtgcaaagcaggaagagggaactaacttgtgcggatactatgaatgctagtattgccactgccttacaacccaaatcattgccacaagagagctcgatgtacgtaaaaataaatcattcaaaatttcattgcgtacgtattgatttcttttatcctaattaatttcatacattcataggttattcgcatgagggataacctcacacacaaggaatttatcgcggcggttcaagaacaactcatgggattcatcaacgaacgagtccttgatcccgagggtaaattctactacgatgaaaatacaattcataagtcgttagcttctgagataacgactactacgtcgaagtcgaagctagctaggacataatgaattgtaattaatacatgtctatttttacatatgtacacatttactttaatgtaaatatatattttggttatatatgcacataaaatattaagtgctttaatatatacatatatatatatatatataaccatgcagcaacaagcccatgcaaataaaaaaaaggtagctcgatatttagtcccagttggtaataccaaccgggactaaagacgactcagccagccacatggctaacccatctttagtagtcccggttatttcacccaggactaaaaataacgatctttagtcccggattcgtagtcccggttggacaaccgggactaaagggtggttacgaaccgggaggaaaaagggtttctccaccagtggatgttccacaaagtatatcggaattgtttcactaagtatatcgaaaatgtttcaatcgtttaaatcgggcgttgtttcaccatatataaacacaatgtttcagcaaatagcgaaagaatgtttccattcactccaacatttgatccatacatagtgaaacattataagtgcactagttgaaacatttgtggtggaaaaaaaaagaaacgaattcccttaatagtgggtttccaaaatatgtgggtgatttgttaaaaaaaatgtttcagttcactgtaatatttgatccatatatagtaaaacattacaagtacactaggtgaaacatttttggtggaacaaaaaataaaacgaattcccttaatagaaggttttcaaaatatgtgggtgatttgttgtaaaagaatattttaatccactgcaacattagatctatataatgtttcaacattgtaagtacattaggtgaaacatttttttggaacaaagggagggacaggtgggtgcacccagcggggtgcgcgtgttgggggagggggagcgaccgatttcccccctcacccggtcgaccgatcctaagaattttcgtgcaaacgtgtcacagtttttctgttgttactaattaaatgctaccatcatgtgtattactactccctccgggttgataatacttgttgttgtggacaagggcacagtctccaaaaaacaattttgaccactatttttcatcataatatatataaaattgttagcaaatatatgatcttattaaagtattttttaagactaatctatacatgtagtcatcatatttggaagacaaatatttttaaaatgattcataatcaaagattctagagtttaacttcactcttgtccaaaacgacaagtattatcagcccgaacggagtaattattacaagcagcaaatctttattttacctctcatatgatcgtttgattatgtttttacaggtgacttgaacaatatacgtcagagaggagtgcctgaaatccatcttgcaaacatctcttgacactccttgggtttatactctgcagcagtatgcccagcgccctgcattggtatacacatatgtcaagattataaatattatatatccaaatcacgactaattgtatcgcttgttttagtatattgatatttttgcatgaactaaaaaaatactctgtatatatatactctaataacatgcatatatgaaaatgcaccttcacagttgcgtatgtcaggttattactcgcaaagcttcgtgtgaatctacaaaacaaagtaaccaagttagggtatgatacaagcaaaacatatcagcatatgtcccaaacagctagaacataataaataagtatgtttattttggacaaataagcagataacaatatccaactgtatcatcatatataggaatagaaaacacatcttccacccatgatccactataccagcaggccttcattgatgagttagaattctgataaaatataatagttaagcatgacaatatatcttcacattaacagatttgacacacctttgaatgtctctaatgaagtactgtgaagtaatattatctctagttgaaatacacattttacctcttggtagctatactcaccaaagaaattgaggcatttccataagaccataagggctaattgtaaaaggtctaattcgtgacatcacgttctattccagtggtaccaacagacaccaaattaatactagaagtgtaactgattgtatgatacattcttaggctgagttattttcttcactttcctaacttatctcttttgtttttcgtgcacacgcttttcaaactgttaaacggtgtgttttataaaaaaaatctatacataagtcgttttaaaaaaaatcatattaaaccattttcaaaaaaaaaagctaatactaattattcttacatcgttttatgtgtaggaggaggggttcccaacacctcccaaatatagccttagtatgataatggtggtgcgataattttttaatggcatgtttagcacaacttcagctctcagccaaacagtttcagctccacctaaaatgggagcggagctgggtggagctctatcataaaatgaactagagagttggaactgggtttaggctgctccacaactctagtgcagacccaactcctgaagctagatttgttccctaagttaatttatgatacctcttggtacatcatctctacggtaaaataggtcatgctacaaagtgcagtgcgtagctcacactagaaagcatagtatatcaagtataattttaacaatgagtgttaacggaaacacttacccggcaacttgtccatcaacgtaccacggtcgccaatcatcagcaatagaaaggttaagtaatctaatccatgcttgtgtgctaatggagggaactctagaatcatgatcaccgctgcatcgttaattacatgaaaacattaatccacgtatctgggttaacctgtttactatcgacgagaagagttattttgatctcaaccacaaggttgcattggaatatagtattatatagaaacatggggatttatagatatatatagcttagtttgtgactgcaaaaatcttgtataagaatttaaatttctactgtagtagttaactccatgtatgtacacctgaatatatattatatgattaagagaaatcagtccaacaaatcagtaccgaaagacgaattacctgtatatgattgctcggtatccctttctcattagcgtcaaatgatattccactgtactacggacatcgctattgtaatctatatcgcgattgcatcgtttccactctccaactgttccctgtattgcatagcagttcttttctgaaattacactgatcatatttgcacaactatcatggaattaatgcagatttcaccctttctcttaggccttgtgcaaatataggtagtaccatagtacaaataccttttgcacaccaagactctcccttactgtttcatcatttgcccatatttttaataacacgtgggaagctttctgcaataaattaaccaaaattaaaagtttttagctcgagaactatccaaagaaactgaggggaaaaaaaagaattcaatgggattgtatgatgttgtaataatatttatgcacgcaactctacactcaaatataataatgtcatcatcggcagcagcaggacgagactccagcatgagcctactcattacatctctcgctgcagtgttatggatggggctctggagttcttcacataatggctcaagaatgtgtcccctgttgatgtcctttgtgcactaaatggttggtgaaatgtcagcgaatttgtaaactataatattaatacaacagaacagacagctatatacagtaattttgaataaattattgatgtttctatacacacagcggcgtaatagagatcatttttattgggggtacttacatcgtttattgcttggacggaatgcgcacattgagcattgctcggagcactgtatttttctccgcaggtctcctttgcatgctgataggaaatttgtttgagtggtgattatatataaaatgaaagaactattacagttagtgtctaatgatccgttcgtgtgtcatactgtcatgaatggataaagatggcacattacccaagctactaaatgttgctgttttgtaaaaagttatatatttatatataagtttagtcgaatattttttttaaaaaaactattcaagtcgttttttttaaaaaaaaactattcaacattgtaatacctaattgagtattttcagaaaagcagataatccatcatctattcatccgttgagctgaaaagaactactgtgccatggtggtcaggcatatatggttaccacttcagaaatgcacatagaagacgacactagctatagatgtcgactatgctaaaactagcacctatagatcttttctcacttttctgtgctgaaaaaaaagcacatttaaacgattgtaggcattggtattttgaaaaaaaaccgacaccattaatttattgtaggtgcaagttaattaaaaaaccggcatcaataatgattattggtgccggttttttaaaaaataggcaagcgtaaaaaaccgagccaagctgatcgttaaccttatcctcgggagcagattaatctgctcctgcggctctcgcgcctctctcttccttcccagcggtggcagcgcccttccctccaccagatcaggcggaaggggaggcggcaagctccccacctgacggtgacggtgtcggtggtgccctcctctccacctgatccggcggaaggtgaggcgcgggctccccaagcagagacggcggtgctctcccctccaacagatccaatgggaggggaggtggcggacttcccaagcagcagtggcggcggctatgacgccctcctcgacatcgggccattcttgtgctcttagtgttattggatgttcttgtattcttagatatttttggatgccgattaaaattttcattctgatcgggttgaaggggagctgctcgatgattcgagctgatacatcgagccctttttttcatttctagaacctcaaaggtgccggtttgaaagtccggcacctatggccggttcttttctatagtattggcccttgatctgtttttttttggcaatgcctacaaagatatgcagtatgtactatatggaaacatataaagttatactagagaatggattacttcgtaaagttcatcagatataagtcccatgccatgcagaaatggaattctaccatcttcatcaatcttgtaatctgtcactggatttccagcaatgtatccctgtgttatgtacagaaggtaaataaattagttgaaggaaagttaattacaggacagattgtgcccattaagaaacaaattatttaaggaatgcaagatagactattgaggcaattaagatgtcaaatataaaatttcatgattgacataatctgataagatcagaccttgagattaaaaaatggtttttcttctgaaccattgcctgaaaaatatagacacatattcactagttaatagttgtgtacatgcgcagttagtcgatacaagaaaatgaacaccatatttgtcccaactcgtaaacatgaaaactacaatttttgtgcttgtatatatctagattctagacaacaagaatagcatttggttagtaacaaaaaaatattataattattgtgatactaatctatattcacagacagccgttacccgatatgagattaggaatttactaaaatatatttcccaaactgctaataattcaatcttaaggccctctaaatgtatgtggtaagtctaaggaaattatacattcataatgaaagaatcttactttcgtcaattgcaagtgtaagtgtaggtacaatcattccactatatgagtcacctccaatatagagtggattcagtgagaaccggggatggtcatgaagccactgtataaagcaacacttttagcacgcatccacggaatatctgttatacatgtaggggcaatgtagatcaatgggttatggtctcataacactatgtttttattatcgtggcaccatatttcaaatggaaactaatcctcatcacagtattgtttttcataattacattgtgcatgcaatcaatacatttttgaaacgtcttcattgttcaatgatcatagtgttagttttattaatgaccaattgaaaagtaaaggcagtgcatgcatttatttaactggataggagtaagaatggtaataatgaaaaaagagtgaaaaaaaatcttaagaatataatatcatttaattaacatgagagaagtaaaaaaggtaataatgtgataattcatacggccccttaagaagcccgcatgtgataatacgaccattatatccccaaacaagcttaagctgcaaccatttgaacttgaagtttctctctccaaaacaaagcaacaaatagggggaagtttccaacttgaaatctttgcttcaaattggtatagtaggttacatacttgcttacctccttcaattgcagccattttttaaaaaaattcattggtgaaatgcagcgaattttgcagttaataagggtacttttatgagcatttttttttgcaaattttagctacaataaagaatttttaggtgagcaaattgttattgtaagcacaggttcatagtgattcaatgtagtgttgcataattttgtggacatacatgaattttcatgttttgtggggaacaccttcaccctaattttattcgtactgccatgttttatagattgatttaggcctggatgtaagacatgcgacaacctcatctggcatttatgaagaaagcatataactttgttcaccatgctaaggcacatgctttaaggaaaaataggaaagacatatattttgttcgttctttgattgcaagaatcagaaattgttgagagaccccagtacaatattggtgtactcaatggagcatgaatttaaggaggattgcagggtatggctatcacggggaaatcaccgttcctgaaggtgacagtaacatggaatgtgacgagacttgttttccccttgatggggcagaagattttacaattgatgacatggcccttgaaagaatggatgaagatggttcgactagtagtgacgattttgaggcagaattcagtctagaagatatgatgcaccacgctaaaccagaggttcttatgggtacagcacggggattagacaactaagaggcattatagaaaccaacggaggatcttctttatgaagaatccaagggatatgagaaggattatacgtgttgcgtttggtgcttgaactctttatattgaaggctaggtatgaatggtccaatagcagcttcaatgatttgatgggtttcttgagagttttacttcctaagcctaacttattgccatccaacaaatatcaagcgaataaacttatatggccattatctctaggtgttcaaaagattcatgcatgtgtaatgcagacaattgtcccacctgtgagaaaattaaagtcgttacaaaatgggtagtgggtcctctgacagtgaggttgttgaaccagattcatcaggcatacaaagaaaaagattttggccatggtgatgtggaacctgcactgaaagatcgcatgagcatttgttctcaaagcctaacgacgctaagttgatgagatgacgtcaagataaccggaaagtagctggtatgattcgatacccaacggatgctcactagtggaagtttttgattcactacatccaaaatttcctatggatccaagaaatgtaaggtttgcattgagcacaaacagaatgaattcatttggtgacatatacatctcacacaacacctggccagttctgctcaccatgtgcaaccttcctacatagattgtcataagggaaagtatattttgttgactatacttatacaaggtccaaaacaacttggcatcaccatagatgaatttcctgaacctttgatggagggtatggaagatctatgtcaagaagggttacgaatgtgggatgtataccaactggagtactttactctatgtgctatcatattcgtgatcatcattgacctgcttgcaaatattttcctctttggccagattaaaaggtaaactgcatatcttatctatcttgacaagatgtcatacaaatatgtgacatcctcaagcaagatagcttacatacgccatcaacggttcttactccagaaacaagtattgtacgatggccaaatgttttgacaatacaatagagaacgagtctgccaccgcaaaacgaagtggtagtgttgtcttcgatatgacaaagaatattaagatcgcgtttgagaagggaaagaagtagtcaagaggaagaaagcagtggaggaaaatatatgccttacaggaagcactctatcttcttcaaatacatgctgtactgggaggacctggagattcatcatgccattgatatcatgcacctcgagaagaatatgctcgatagcaccattgacaccttaatagacatctagagtaagatgaagcacaggctggattcatgtaacgacttggtaactttagacataaggaacaaccttcacccaaaagatttggcgaatgggaaacaagattctcctgcttgctactccatgacaccaaaaaagaaaaacggatttttgtaaatacttgaattgggtgaatgccaattggtttctcatcgaacatcaggaagctagtctcaatgaaagatatgaccatctcagaatgctcatgattgtcataatgctaacggtctttctccctattgctataaggacaatcaagctagttcgaaggtagtgataacaaagatgtgttactttttcaatcaaatttcctagaaaatatttgatcctatggaattaggaccaatccagaacttcacaatcgagacagcgtgccaacttgagatgtattttcctccatcttattttgatatgatggagcatctgattgttcatattgtccttcagattacgaacttggtctgctatacttgcatcaaatgtgggtgtatgagtggtacatatcgattctaaaagggtatgtccgcaatcatgcttacttagagggatcgatgacataggggtacacaactggttgagtgcgttctagattacataaaggatgtcaattccaccaggaaacccatggctagatacgagggaaggttaactgggaagggggccgtaggcaaaagatgcttatttgataatgattacaaagcagtagcggaggcagacaacaacgtactgcaacaactcgccatcattgagccctatattgagcaacacatgaatgaggttagtgcctgcaatgctttcctcaatggttgttggatcaaagcctgctattggtgaatccatgaaggaaaataactttagaaagactggcatctggcctgtcaagtctagtgacctcatggcaatggtatgtcattaacggatatgaaaataaaggacaagaaaagctcagcacagaatagtggagttcgtgttgaggcattcaacacaacggacgagaagaaattgcactagggatcatacaagaaattgcagtaaacatccagatccctatcatcgatgctaatgggtgaaagacacaataggcatttctctggataactacaacctgacgattgtggaaggtagtagagtaggcttagaatattctacgaattgcagtttcaccggcagtttggtttgtagaacccaaaattcaagtgcttaatcactcatttgcaatcgagttgccatctaccttgttcttgcttgtcttcttcgatttgcatgtagggattagccttctctgcatggtcaatcatgttttggcacggttgataactagagaatatgtgatgttatgatttcagggttcagattatattgatcggaagccagatcatgtatgtcgaatttccgccaaatcgagggttattaatacatatcaaaatataggggccgagttccttatctgaagcgatgaggcatcatgcgatggaccaaagactgacacgcttatgttggcaccgacaaagccaaagccaatgcccataggagatgagcccagcggcaagatggcagacgtgccgcacggtatgaaggaagcagcgacggatggtagtggcacaaccagaaggggccagtaaaggaaatgttgtatgtgaatttacagcacccgagcggagcagcgatggatgtatggtacgaggcttacgaatgtgagattgattcggttgtgatagactatattttggaaaggacaaaaatgcccactgaacgatgatatgggaagtactatcgtaccctcacaaattgacggtgtagatcatttataccggtagtataatactaccagtagagagcatcgtaaaggtaatccaatcaaatagcatgcaaagtgtgaggatattcttgtccaaagcctttaagggaaacgaaagaaaagaaaaccaattccgtacaagacaaatagagtaaaaagttgttcttctaggaattggtcaggacagagttacctttctaaggaaaattagaagttgtttcacagcattggtatcactagacttggaaccctcctctgtggctgcatatgagaaccctgcccctacaggagaatccacaaagattatattgcttacctacaaaatcacacaattcatccattaaaatatgcaattgggcttatccccttttcattttcagagaaagagagagatacacatccactaaaaattgaacatggaacttatttgctaatacatggtatttggcatatgcaggcgacaaccttagtccatgtctctggtcggtagataattatgggcaatcctccactatagtatcgttttgcagcgaattgaaatggccctacaagagcatacatgcacatcaacaatccgttaaagtagaataagcattgcaacataacctatatgcacaatgcaccatatgttggttatccatagaaactcactagaaccttttaataatttgtgaaaaaataatacgataattattactccctccatctacttttgatagtcatatttctaaatctgaaaattttatttttgatagacatatttcaatccaacaacctatcatcttaatgactctctcggatttaatgcgtgactctccattctcccatacaagattggctacatggacatcgagaaatataaatattaatgaatcacttgttcatgaggaataactagtagcatgtttaaatggatgataagtagaatcacttatccttggtttgtgtgccaagatgaaatatgactatcaaaagtagatggacggagtattacctatctcatgggctaggccagagatgctagagcagccaggcccacctgttagccagagcaaaagtgggtctagatcaggattcttctctgaccggacaaagtagtagaagagctgcacgccagtgctctcgttcacttccacgtacctgcagcggtcataagtgtgcacatgatgtatccatggcttgcattatatgtttgtcatttcttggaccagtggtagaccggcgttcttttttttttttttgactgcgttcattggagaaatatacggacccataccttttcttcaaaaacaaatttttggtagtgccatttttatattttcagcggtatggttaaatagaaatgaaattgtttgcattagaaattcatctaaccctatcaatgtggtattgttgagttctttctatggcttttgaattttattccaacaggaggactattatttggattggggcaagtcatagattggagaatatcactctctttagaggtgtttatctcacatgagtagcaatagggatctatccaaactaaagtttgatgttttattatttcatttagaacttgttggtatgtctatttttctaaggggtatcaggtctaatacttaggtatctgatttgatatgatgatatctatgagtaccatgtgtgatacctcgatgctatgtatcttaattaggtgcatagtttcccatcatcgctgcccaatcactagtattgttttacatgctaaatgacacaatctcctgcatgattaccttttggatcatctttaaaccattcttttccatatggatcggtaattttgccaattttagcttggaccatcccaaactacttctccggtgcaccggtgaatatagcgcttggtgaatgaacaatatcatgcttatcgatacatatcgatacttaatataatcctttattattaaaaaaaaatattgagactgcaagatgtactcacgctttgcattcagtatatatacatacccggtttcgagggagaatggcaatgggccgtcgaacccgggcaggctcgacacggcgacacaggccgccgccgtccacgacgacgaggccacccaagaaacgaagcagcagcaggcgagccaccaccacgtcaagcaacggcggctggtggtgcttctcgtcgccaccatcgtgcgcgcttcctctcgcatcgtcgatcgaatggtttgtttcccgtttcgtctaaccaattatgactgaattatcagccctggggttatgtgaaaacagatagaaacaagagataaaaattggcaaaggaacatgcaaaacaggccagtccaactaactcttatctcgtctctgacagattcatggatgcgtatcagaaattcagactatatttatgtgtatatatatcagattattgacatacctgcgcacagatcttaggatcacttactcttcggaatgatccacttattttactttcttcacttgatcgatcggaaaaacagcactcctaatatacgcaagagtagaactcggtgtcctctagtttcggcagctagagctcagcgctatgtatatcttttatatagttatacaaacccatatagtgggaacctatcccatgcatacaagtgttgcatgcttactttgtaccaactagcaaatatcatcgaaaaatctaaaaaaattgtgcatacaatttcgtcagtattatacctactttttaaatcttaatctcaaatttattatattttagagatgcattaaaaaattttatcttttttttatctttttttagtcagaattttatctttttttctctatataatgaatttgaatatgaaactttctacatagatatgtacaacttgttaagaaatttccatgtgtacatgctgtgcatcatcggttagtgtacacggtgtatacatgggaaggcttgtgtatgtaggctattagttagttggtacatagaagactacttgtctatgcattagttaacatgtaagtatatgggcatcagaaatcatatataacatgtatatataaaaattattagtaaatgattaaatataattatactacatcatctacaaattatagcattatgaagcatgctgatcatacgtttctataatattgtgccgtacaatgcgggtcatcgtattgaattgcatttaagtacaggtctatgttgatatccgagttgattacatgggtcgatcacgtaggtacagtatactgcatttaaggtataggatatgtgttgttgtcatctcaattacgacgtacagctatgatctggcataatcaatgacggacgttggacatggcacccgtgcgtcggtcatacgagtcacgacactttacgacgatctttcctgatttctagatttccactgtgatgatagcagagaaattggcactctatacattcgttccagcctgaccaacactattcattactacaaaatccaccgtaggtatcggctcatggaacgttttcccatcttcatgtgttgaaaaaggctcttttaaacactctagatactggttataaaggaagcaccaatactataggtacttttttataataatcgcacaaaaaaccggcacaaataaaaactaagcgagccgaacccccatcgaaccgatcgagcgcccaccccataaaccccccgtccccgtcgctcgcatcttgtcctctccccagtccccacccctctatttctcgcaccttcctcccccttctctagttcacccctcccgtccttgatccctcgagttccccctctccttccctccattcgcctgccctcctcctcctctccgtatgcgtgcacctcctctcctctcgagaagttcgccattgatatttcttaatgacattgctaaaaatataatttccagtaatggtgctcgaaatattacttggtgttctttactgttacagatataatccgcaagtacacggatatactattgtagcatttcacccagaagtattacaaggtatcatatttatttaatcccaaggaaagatatgataggagagtactatgctagtaatttatactccctctgtcccaaaatataacaacttttagccctcaagttttttcctaaaatataacaacttcttcaccaacattctctttctaaccaatcacaatcctccaccattctttttcccacctgcctccactactcaaccaatcacaaccatccatcattcacttctatctactttcttattaaccgtgtccaactctaaaaatgcttatattctgagacggaggtagtatcacttatgtagatcattttaggggtaaggatagatagacacacagaaggatactctcactaaaatgataatctaggctaagtgcgaaaagaataagaaaagaatcatttatgtacttatagtatatagttatttagtctacacttgctattatacaattatgaagccaataccccctaacaatgccctcctagtatatcgagaaaccacctctgattgtcgagtttcttacgacaatccgtcatggtcatccaaccggtaatagatatggaggagtacccacaccaggagaaactcttagccctatttacacacgtggatgaatacccgtattgagctgtcaccatcaacggcctacctctacagatccatagcatatagcaccatttaatggtatgtaataatctaagcatcgcgcttatattagtaaatattactctatatctctgaagatgacatagagcaatcatgtaaatgaacaccaagccaataccattacatatctccactaagctagctacataattattatgagtcaagtatgaactaaagtcggcactcgaataattatataagtaaagtaaatgaccaaaactatattaaaaaataatatttcattacagaataaagtcttacaagcgatagaagagctactagagctatacccgaaatctccggaagacttgaagaactaagaaactattctaattctactccattagcactagaacaaagtaaataactagagagcttcttgcttgatccaccttagtgtgtgttaaaatggagagagagatagcctccatatgatggttgtaacggctgaaatatcctaaacaccccgcaaccgtcattgaggagtaatccaggacatccacgtggaaggccaggatgaacggagctggtgacggttcggccgaaccctgggctggtccatttggcccatcctttctcctgtaatccatttgatggatcctaagctcagtggtatggtggttgggccaaattgtaggtgttcaaatgggtttgtgggcccattcgtccataagtgtgccacacgtcgagctctgattgatcgaacgattattttcatcctttctccatcatttatacgaagatctcctgtacaccaatactttgcaagtacaagtgaaaatatattatttttaaacaaatatgcatgcaagcattgctagttcttctttattttcggatgtattgacggtcgaaattggtctataacgaccgtcaccactcgcggatgatagtggtcaccgtggctgggagtaggcgggtggctgtagtgcccaccactctaccagatccagcggaaggggaggcggtaggcgacggcacccgaggaggggtggcaggaggcaggggtgccctcccctctaccagatccaacgggtggagaggcagcaggctccccacagggaggcggtggtaggggtgcagcatcctcccctccccgccggcggtgtcacattctttgttgtcaatgacctccgcagtgtgagaaccgatgcccatgtgcgatgaagatggtggactggtaggtggtggcgtagaaccagaaggtggcggcaaagaagtcctgttgccagtggcaggcacctagcggcccagtgggtcacataggtgctggttttgtgtttacagttgacacctattaagccacaaaggtgtcgattcgaagtgtatgacaagcacctataatactgtagtaaaaaaatggtattgcagggcaaacaccaaatactcacaaaaatcccacatcaattcaaagaatatatccatattcatatcacccacatgccaaattaatctccaaacatacacatatatccatattcagtaatcaatctccatgagtcacatcacccacatcccaaattaatctccaaacatacacatatatacatattcagtatctatctccaagagtcactcacttcatttcacaatggtgttgctgccgaaacactctgcaatcaaatctagtaactcctgaaatagagttcctctgtacctgcatacactgtcgtcttcggttttaaaatcctttcttgcaaaggtcaactttttctgcaaatcccaagcaaatagtttgtcattgcaaataggggatgtgctgaatcattgcacaatgataattagcactatatgatggtaatatctcagtttttctgcttcaatgtttttatccagacaagaatagaacgccatattgtcatccttgttgagtctgacaatgttgacaaaatcatgcagtgcactcactgtccaggtcattttaatcaataatctgcgtatgctgtaaaacgaggattaaatgtagccagtacatttttatttgtttccattatcctggaattatctagaggaatgggtatttgaagcaaaatagagcatgccaccatgaattaaaaggacaccaacatgccacagtactagaattagacaaagagaatgttaaaacagtaccaagttattctctgccattagttcgtcaatactttgttgatccaggtcatttggttcaaattcttcagaaccatcagtgtgtacattctgcaatataaagagagagtgacaacagatcacattagtcaacaaggattaagatgcactttcccagtcagctgatatcaagactacttctaatttcctcactgttttattacagctaattaacctgaagtgcatgaaacataaacaggtacctcatgttcgattccattgagctgatcttgagaagggaataacgtcgtttgggttcacgacctgtaaggaatacaacagtgaagtatatgatataaggagccaggaggcatatacatcagtaaaattaagattagtggttgaggtaactttccaacattcttctgaccaaacctccgtggggttaagcactaaggtagtagtccaaaatgaaaaacaaaatttgtggttcttagatggaatgtgcttcaaatactactgaacacttggttggttgatcccacatgtacatttttcaggccatctacagttaaccccagcaccaagaacagataagtgttcaagaaagcaaatagataaccagattaaatccatcacattgaattcatgttcaggacaataaaaaaacgacatcaatccaaataactaatctacaagatacttagaaaacagagtttggacttagttactaaaaataataagtttggacttactgacaaatagagtttcgatactttaattttaattctgagcatcacatttattcaatcatggaaaaagtataattaggctacatattttacaattactatttttgaatttagagctgttaatcgaaccaattgttcagtataaacaatataccatgggctctttaggttctagttttttttctcaagacctattactttctaaatccagaattaaaaatattgaagttgattttgttaatttcattttgaaataaggagtagcaattgatgtagaccctctattaatgcaaattgccataacttataaaacggccaatatattattagaattttagtatttatgacgatgataaataacccccgtgaaacactcgggttggcgactagtaactcctaagtcatcattctcgcaatgtgcatacgtgcatgtacacgtcacggcttgcaaaggagatcggtattcggtaacgcatacagcatggggatgcatggcgggatgatgttccgtagcattcacgaagggaataatctacggaaaacaaagctaccttgcaacaagatccattatcattctcaagtctcaaaacctagagttagcagaatgaaaaaagaatacgcaaagttgcaatgtggataataataatgatgatgatgatgatgatgtcaagataataattttcagaaaacacgaagtacactgactgaggacagggctaacaaggatgagcagaggaaggtcaagtttagctggacctatcataggtgaaaacttttcacgctgtctcacttctcttatgggctcgatttgttcactgttcactgagacgatatatggagatttgctgttaatttattttgcatgataagagtttatttttccttttttttcccagtccagatcagactgccttgaatagtttgtggtcccaaattaaattttatctattattttctttaaatccatatgaacttcaagttcaaggacgagtgacctggttgggttgttttgaaagtctatttttatagtttccaccactattgcaccgggtctgcgatcttcagattatgagtgcttttaatcgctatcacaagacacgcaggttcagctatatattaagggagataagaataggattactgagtgagctctgataaaaaagggcattgtgtgattttggatcatggatgaagatgcctattctagttatgtagttctccttccaggaagcatctaacacctggaagcaggccaaaatatcatgtgtacttctcaaaaaaaataaggcaatctattttcaagttaaactaaatcagcctactaaagtagcggcggaagaataaaatgtttttcatcttcttgctgcccacatggccacatctcgtacatgatgagctgatagcattgatcctatgatgaaggttttgtgctgttggaaatgctctcctcataagcctccaagcaaaaggtttgcaccctgcgaggaagaaatttgtgtttccaggtgtttctgattatgaatactatctatgtacctaagtttgtcgtgaatggaagaatatcactttgtacgcacgttctgtgttacattctcctatttgttcctgcatgatagcttgtaacagcatcattaatagagagattttttcttcatctcagtttttatttagttcacaaagatcattttctgggggcgagtctgggggaacacttctcgaccttggaaagttgaagtgagttgtgaatgaactgcaacataagtttactatattcttaacgttcagctatccatttgcgtatttgacaactgaacatgatttcagagattcatcttgaaacgtcaggtttcttgttcttaaaataacatcagccaccaggactgttaaatgcaccttttacatagataccggttaccaataaaccccacctaacagtaattcgaacagctcgtaaacacttgcaaagcctcgatgggcacatcccagtacttttggcacaagacaagcataatttttttggcccgtattgatgaacatactaggatacagtggaggtggagcttcagcttgttttgacttttgacccactaagctagtaaaagtggccatcaccttttttctgattttagggtgatgtatcataagaaagcctgccatgactttgcaattactgtattatctgcaaaacatgtagtctgttgaatcagtgcaatccatgggaaaacaagcattagatatggtgcaaatccatcggttaataaaataaaaaatgcttctaggtattataactgaaggaaaagtgaaaaaaacaaaaaaaaatgaataagaccaataaaattgcacaaattgtagtgtcatgaatgaaaaatcccaataaaaggagtaatagataataagaaagcaaattcactagcacacgcatcacaactaatatgatactccctccatttcacaatgtaagtcattctaacatttcccacattcatattgatgttaatgaatctaaacatatatatctatctagattcattaacattaatatgaatgtgggaaataccataatgacttacattgtgaaacggagggagtagaagtgaacatgctgaccattcacatgtaatacattttgggaagtcattattaagtacttgctcaagcaaaagaacatttttgtcatgatatgttcactgataagttaattaggaaagaacgatattatattgttcaatgtctgtggatctgaaaaataatgctcactacatgatgaaaatggatacttgcacaataaaaacaaaagatagtttgtaatactacaatatacaaatgagcaaactggaaattctgatagatagcggtggaatgatagatacttgcatagctgaaggatggttgttgcctgatggttcctgttgagtgctcacctcatccactcttttgggaactctacccaatgttcgaaaccagtgactgtgagcagcacctcaaatcagcagctggtgtcctctcactgcatacacaatgattcctacaaaatcaacaagcccatgttttgaaatataagagctgccagttcaaaaatatagcatgtaatcaatatttccttgattattgggcaattgatggacaagatttgcaaatggaatccacatagacaaaaaaaatctgtaatgaaaaaatgaagtacgttgtgttcaaattctcacaacagacaccatttttttttcgtgactcgtgagttgggacagcaaaagagcaaattgcagcagtgagaatttgttgtctagttctagagaaaagaacatggacggagcgaagcaaaagttacattgtatactggctaaattgcctagaaaatcaggaatgatagagagtaaattggcgcatccaaacgagatggggggaaatcattaaacagaaaatttcaattcaagtgcatccagccaaccaaaaaaatctgaaatttgttcctaggcatccttgcagcgctttaggacaaaaaaaaacaaggatttattcatccttgctcttgccgtaagtgcatgcacatgaaccaattttcagaaaaaaaaaatggacaatactttcttaggaaaaaaatgggcaagattcatgtacacataccacctttttattaaaaaagaagttcagtaagatgaactgctgagcctggggcttcagatccccaatgtagtagaacctgaaaaaaattgaagaaatcgaagcacacagtaacttgtactaattgctacgaccaaaaggaagaacaaacgaggcaaaaaagggaggacaaaaatcttcaaatgtaagtactactttgcatgattacatctccagaaaagaagcatgagttccaacatccaaacatatcaggaggcagcgcttgatgtaaaaaaggtaaaagtgtaggtcgggagtgcatacctctcattggtgcgtggggtggtcgcgcgcccgaagagaaaactccgtgaacgagaggacggtggatgccatgtcctctactcaagcgaaggttgtcggcggctacgcaaacgcaccgcgggcgactgcagttgcggaaggaagtgggcgcggtggttcgggggaggtagactcgagccagtccgacaccggtgcgagcgcgtccgcggtccgctccttccaggacggaggtgcgcggcggcgcctcccattgctcatgggctcacaagcccggggtgtctccgagaaaggggatcttggcggcatgcgtgttcaggccccagcggggcgccacatgcacctgtacagaagtatgttctggtatcactagtgaacatagtttggtttcttttaacatttaaaccgcaaaaattgatgttaaaatacagaattcagttgtgcctgcacactgacattagtatatataaaactgacatgaaccgttttttatagagggaattgcacagttgtcagcatcgtatccagttgataaacggatgcagcagattacaaaattcccttgtctaatcatctaatgtacaaggagcatactagttaatagaaaatgcagaacatgaggggcttttcttttctggctaatttgttaaaccgcttcgctagaacattggagacgagcaaaaatgcagttaatgtagttgggataacgtaccactgcctgggtgtacttggtgttcaggaatgtcaagatcaactgaactgcaccctgctggagtcttcccaactcctttatggcgcctttgatctaggaaatttggcgaaaatgttttctggtatcatttgtgaagatttcttttttaacatttcagccacaataatcgatgttcaaatacagaattcagttgtgcctgctgattgatattagcatataaaattaacatgaagcgtatggttatttctatgccagaagcccagcaacagttgataaagggatgcagcaaaacacaaaatttccttgtctgattcatctaatgtccttggctaatcacctatgtaccagaagtattgttaatagaaaatccagcacatgagacaaccaaaaaatgcagttaatgtaattgggataacgtaccactgcctgcgcgtacttgttgttcgggaacatcgagctcaactgaactgcaccctggagtcttcccaactccatggagcgccatctttctcctcatgcgttcagcctgctcccatctctccgatgaggccatgatatttgacagcagtatgtactctgcatcgttggttgacacacgacaggagtgcaattggtgaatctcacttgatacgagttcagacatctctgcatcgccatgcaccctgcaagctccgagtaaggagcaccagatcacctcgtttggttgaacaagcatgttcttgacaatctcataagcttctctcaatcttccagcacaggccaggaggtcaaccaggcaaccagaatgctccactgcagcagcaaccccgtaaacatcgaacttgttgaagattcttagtccttcatctacaaatcctccatgcgtgcaagctccaagcacagcgagaagtgtgatcgcattaggcttctggtccgaacactccatcttggagaacaatttaatagcctctatgctctatccatgggtggaaagtgcagagatcatcaagttccagcattcggtattcctccattgcatgttgtcgaagatctttcgtgcgaaagcgaggtcatcgcacttggcgaacatgtcaaccaggccattcagaacgaagtggttcttccggatacggtgctggatgatgaaactatgtacctttcttgcttgctctagcgaaccgagctgtgcgcaggcagagagcacccctgccatggtgaactcgtccggcttgatcctgtcatccagcatcgagtgaaatgcttccagtgccttcccggagcatcctattttggcataccccgctatcagcggaagagcgctacggctcggacgtccggcatcacaccaaaaatcggacgtctaaacgagcgcatgtgggaacgaaccatgtcactgtaatgtatgtgcctagctgtttcttttcattctttcatcctctttttaaatattttttcctcttaaattacttatccgatctacgatccgatcacaccgttgtattcgttgcaattaaatctttacaataagatatcacatgattatattatgtcaaaaaaaaacatatgtttcaaaccgttagaataaaatatttcatacgtgataatgatatgtttcaatatgtgtcttcggtgtgtttcacaaaattcctgaaactatctgctactactctctctccacctcatgcatgcaacatgtatgtattttagcaagctttaaaatgaattttcttttaaattacttatttaatctatgatccgatcacaccgttgtattcattgtaattaaatctctacaacaagatatcgcatgattatattttaataaaagaaacacatatgtttcaatccgtcaatacttgttgtttcatatgtgacagtgacatgtttcaacgtgtatcttcaccatgtgtcataaaaatatttaaatgtttcagttgttgtattctttgtttcaccatatataacttaatgtttcatttgttggtcaatgctctctcccgcactcccgtgctgcgttgcttgcctgccctgcatgtattgcttgcgctgctgcttgcatactctctctctctccctcctattacacgtgcctaattttttcctcacattgtaaatatttttctccaaaattatatatctgatctaaatttcaattataccattagatttttgcacaaatacttcattatgttgaaatatttttaaatctgacgctacaaatcttacgttcaatattttttcaaatatcgaatgctactcctcgtagggacgtgttcgagaagcgatgttgtcacatgcatgcatgtaggagtagagctggttgccaaggtggcctgaggcaccattactttctctctcttaatcaaactttaaacaaatttttattctaaaatatatatccaatctataatttataacaagatctcacatgaatatattttgataaaaatatatatgctttctagaagaaaacaaacttatgttgaactatttaaaaataattctttcatcacttgtggagatgtttcaacccacttcacaaattattccaaagaagtacaatatataaaaaagttttgacgacaacaataatcattattacatgaaacattaagtcccgactagtgaaacattttttatatttagatcgaaacatcgaattataattattgttgaaacataaaaaatatatttgctaaaacatataaaaaaagatagcatgaaacattgctaatgaattagtgaaacatcaacaaatgcttgttggaacatttcagtaacaatgtgtgcaacatttaaaaagaaaaattaaaagtcgtcggaatgtagtcatgtgatatcttgttataaagatttaattataacgaatctaatgatataattaatttgaaatttggataaatagtttaagagtaaaaatcatttaaattttgaaacatgtttgtatacatgctccgttgcttgtcagtacacctgaccaaccgttgcaccatgcacctacactgttgttcttttagattaagacgtccgattttttatttctggccggactgccgatggtaagcatttccgctatcagcgtgttccaattcaccaagtttcgcacgggtattctgttgaacaccgcgtgcgcttcgttggcattgccagccttgaagtacccagtgaccatcgatgaccacacgaacgcgttccacgtaggcatcttgtcgaacagctccctcgcggtctccatgtcccccgtggccatgtaaccctgcacagccacggtccacgtgacgacgttccgcatgcccggcggcgcggcctcgaaccaccgccgcgcatccaccatgtcgcgctcctccgcgaacccccggatcagcgtcgcccacgtgacgggcgtccgtgagcccatgccggcaaacaccgcctcagcgttggccatgtcgcccgccgccgtatacccggtgagcatggcattacacgtcacggtgttccggtccggcattctgtccaataccccgcgtgcgttggccaggaggccgcacttgcagtacaccggacaccagcgtggtgcccacgaggcggtcatgggcgttggcggatttcacagcctccgcgtggagcgccctgccgaccgaggatgggatccacgcgggaggcggtggccttgaggaggacgatgaggagaggcaggcagcgcgtacgatggggcagttgctttgagtagatgatggcggcttcccagaggaaggagttggaggcgtagtccttgctgaggttggcccacttgtcagggtcacaacatcctctcgtcaggtaaaggccgtggagctaagggtgtaagtgggtcagccgcgaacccacttaaacctgcttattttgacctataagtgggtttcgcgggttaaccacttacatccctatgtggagctgtctcgctcgactggccgccatggcgagcgttcatccgcccgtgcagctgtggcggcggctgctacctggggcttataacgtcattgggtcaaacaaaaagttcctggaaatctagcattcaaaagctcacgattaaggatgaaggagataaacagtgttgctctgttgcaaatgggtaatacgactaaattgacaggtaacaaatcccacaaatcacaagcaacaaaagtggcaggattgattacaaattagccattccaagcagggcttagccagaaattttttgttgggtagtcctatttcaaaagttcacatcacacatgaaaatttttcaaacaccgcaaacaccatgcatagtacaaatttggttaaaaggcgatgcaaatatagtaacaatatcttatgatattaataatcgactaatttaacaagcaagctcaaaatgtgcaattattacagtaggctaataccaatcctcactcttcatattttacccaataaaagaataccaatcctgcaataacagaagcaatctattcgcattcaatcattcacaaatcagcatcctatgctatgagctaatcaattagccatgagtatgatcaatgagggaagctaatcagtaatcataaattgcatattcacaggttcgctaatcacaaattgacaatataacattatgatagtactctagtagcaatcacaggttgcattgcttgtaaagttggcctgccccagaagactgccctcattggctttcaatataagccgggtccttgtgacctttttctctaaaaaatcacagattgcattatgaagctaagagcaagaggagtagagctctagagcccagaagtagaggaacctcaccagcaatgtggcaccggcacgggcgcatggcagtgagtgccagcaagccagccagccacgggatcttggtctcgccatctcggctctcagctggcatctcgagttcccacgccgaagccgatggcagcgtcacgacattgagcgagagtggatttgtgtggcgtaggccacaggctagaacggctgtgaccagcaatccggcgaggagaggtggagcggcgaacaaccggacaggcagagaggagccggccaacgacctagcattgcttggctctatggctcaccgctgatcgtcgaagcaatgaagaaatagcgtcccgcgtcgcggcggcgcggcgcggacccacgggcaagggcaggcttaggattttcaacttaggtatttgaaactagaagagaaaaaaattttcaacccaaagtctaatagttgtataatataaaacggtatagtgttcatagaatcgaccataaattgaatgcgttaagcatatttaagtacagtactaaactattaattgacaaaacatatcaaatttatagagcatagaaaatggcaaaatgataagaaatcttacaattcagaaaggaactttcggcttcttgatattttgaaaacatgtacactgataaatactacaatatggtattccaatttaagtactaacattgctaacactgctaaatatgtgcactgataaatactaactctgctacaaagcttcacaaatcagtgaatcacaagtttcgaagttcaattgttcaaccatgaaccatccctggatggctggattcaaatcctaaaataaaaatgttcaaccatgaaccattccagattactggattcaaataaactaaatcctaaatcctaaatcaaatgaaccatcctagattcaactgtgaacaactcctaatccaaaatgtttctaaccaaagtaaccatctctggatttaggcagtacagagctatgggcaggggaagaattaccttcgtctggagctccgggcggcgtcgcggcccggggaggcgccgaggcggtgcggcgcaactcggctaccgcgcgacgggcaacagccgacggtgcgatgggcgagggcgatgcgctgccgccgacgacggtcgaccgtcgatggcgagttgacagcggcgcatcggcggtcggccggtcgctctcctgtcctggctgtgtcagctggatagggttaattagattttgggctgttcttttgttattgggccaatgggcctgaaataatgaggagagaaggatggtgagggagaggggctgctgggctgggccaacggggagagattgaaggagatgggccggattcggcccaaaggtaagagagggattttaattaactttttaatttaaataattgctgaaacgatctttcatctatatctatatctatctacacgtggcatttgaaactcacgaagataaagattaatttagagcacgtaaaaagattaattaagttttaattattacaaacttgacaaatggatatatttgatattttaaaacttctatatagaaagttttcgcatgtaacataccgtttagtagtttgaaaaccgtgctaatagagaccgaggtaaaatctataatttcatcagaaaataatagggcgtatatctatatctatatcatcatgatcatgatcatgagaaaagaaatgtaccagtttcatccatactgattatttttaacacttagatcttttcatccaacgactgatatcgcgagttgatccgtccatacaattattgatctcccactccgcataaacagcggttacagaaattagcgatcaatcaaatcttcgctcccatcgccaacccactgccgccgccttctcccacgctcgccctaccccaccgccactgctcgtaggcggcggggttgctttcatcgtcagtcgcctccatctccacggctaggtgagaggacagagagccaggatcgccatcgccattgatcctccttccgggacgttctctcttcgccatgctctcatatcacccctccgcctcgccaccagcgtccctgtcattgtcgtcgggattatcttcaccaataccttcccacgacgatccatggcccaggcgccatccgtgcacccaaagcccgatgacctcgcattgcgcccaaagcccaaagatcgagaaaagggactaaatagcctataaacgtcatttagaagcggtaatttcattcataaattatccaagggaagccggtgcaatcacaagacacggatgtgagaaccatttgctcctcctcgccgtcgccccattcggaaatcaagaactctgactctggtttgctaagacataaaacacgcgaatattagagaagaacctaatatcaaataattagaaggggtgtgggcgtgaggcttcgaatccagttcgtttagcccaccaccttgtggagttagccggaagaccctgggtgtttcccttgtttgctaagacatgaagatcaaagagactcttttgtctttgctaaatgatgttcaggctattaagtaatatatttaaatctctccctcccaatctttaaaatttaggcaattttctcttcgaagagtacagaaagcacatattcgatttcgattcacattgagatttgtcagacgatgagtaccacattcaacaacaatggcatcatcatcatcatcctcggtagcctacctcgtacggctgtccggtgctgacgcctcggacggacaagtacaccacccacccggaccacctgccccaccaccaccgccgccgcctcgcttcgccggcagaagctgtccaccgtgcacatcaccaccccgtcgaacatctccgcgccggcgtccgcgtgcccctcgacgcgctgtgcgcgcgtcccgaaccggccgtccatgatccgccttgccatctcctcccgccgcaccgcccaatccgcaccttgccacccgaggtggtagctcacatggacgggcggcagcggcggcgttgtgctgcgtctctcgccgggctgtccctcggcgttgtgagcttgtcgcgccaccgcacgagcgggcggttggtgatatgccagccgtcggcctcctcgacggctgtagtggtctgtacgcacatggtcacgttaatattccaaaagttttgacaaaattacaccgaaagataaacaatgtattcatgagtaatgtgaaatagaaatcttacatgtttgaatttttatcaattatatttgatttgcgtgtggttaagttcaaccctttcattgtcgatggatgacctaaagatccaagaaataaaacaagaaaactactacaaccatcccaagggcgatgacagcggaagcctaagcggcagtggccataggacgccctctctgatgccatgttaaatattataaggagagatagatatactgtagatattggacacattgtattgtgcctcggagggctagtatatttagattacatggcttggatatcaagcaatgtcacatatatagtactagtgagtagaaactaatcctatcttaccataacaacacaatacattatgatcatatccatatactctcattatgttaggcaaagaagatgagccgagctagacttgtgtgggcatcgtctaagctatttcctgtactaccggtgaatattgatttcgaaaatccaaaaagtccaacgagtctccctgcctcaaaacgtgttattctgtttcggcccactcctggattggtatccctcttcgctaaaactggtatggcgcggcgcaagggtagggtgacgagtactccgttatcgacttgcccttttcgctcatacgcccttgttgctcgtttggcgatggagcgaaatcatcgtcaaggttttgcaacgggtgacaacgnagnttatgcgccacgcgggtttcatccgggatttggtgttggaaatcaacatggtggtgctccgggtgnaagagggcgtggtcgcggaagaggagggtcggccggtcgccctgggtttcgccatgatctctctcacggtggtagatggaataattttggtggaggtcatgggtggaggggtggctttggtctcaatgctggtccgagtgaaggtggatttaatggcgctgggttccagccttcttttggatctgctgttcgggcagatggaggtggagttggtgctggtaacctggtttttggtgcggtaccagggatgtctgctccagttttcccggctgctggcggaggtgtgttgccggctggcgctttgctgactggtggtgcgccggggggtggattgcagatggctggtggtggtgtgcagactggggttttgccggctggcgctgtgtcgactagtggtgcgccgggtggtagattgcagacggctgctggtggtttgcagtccggcgctttgctgaccggtggtgtgccaggtggtgggttgcaggctggcttcccgacgaatggtgctactcctggtgccgggtcagctggggcaggtgatcttttgctaactggtggtgtgttggctgctacatcggctgttgcatcggagactgtttcgttaatgaaaattgctgattcaagaaaaggaaactcccaacaggataggttaaaggtggatggaggtgggattcagactagaggttcgggggcaatggtctccaatatttctagtggtcctactgctggtggtcctgctgggggttctatacctagtggaggagcttttggtgcttttgctcttgctccttccgcttcggtatatggaggtggtaaggattcttaggttcatggtgagccggttcaacatgagatggcagcttgtgtggttgatgttgacaaaggcaagtcaaaggtagaaagtaaaggatcaggtaaaccttattgctttagatgtcttacaaaggggcatacgatgcaggattgttcttctaagttttactgtgaaatttgtgaaagtgtggatcatattgctatccgttgcccaacttttagatctacagttaaacctactgctcagttatgtggttatgctactgatggtctgggtttttttcatattcctctctcagctggtcataaaattaaacatgagcctagggcagctttgattaaggtatcaaagggtaagctttctgtaaatgatg

SEQ ID NO: 57628 - DNA, 569 bp, Oryza sativa
caatgagagcgccattaagatagccaacaaccccgttcaacactcccgaaccaaacatatcgatattcgccaccatttcttgagagatcattccacaagaggcgacatagacatccaacatgtgagaaccgacaaacaatggtagatatctttaccaagcctctagatgaagctaggttttgtgagttgaggagtgaactaaatattttggattctcggaatgtggcttgatctattgcatgcatgtttgcttggtagaatatgtttgcataccactttgtgacaaaatgatcattcaattcatggatggacactagtcacttttgtggagaacttgaatctatgtgtatggggatctcatttttcaatgaattttggtcctagcacaatttgcaatagattcgcacattccctccttcgagggtgaatcatcttgtctcatggtaattcactctcttttgatctttggatcatccatttgtcttgtggctattgttttgtgtggttgattgcgtgctagccataagctcaaatggggcctaaatgttcgaccattcttttcactcctt

SEQ ID NO: 57629 - DNA, 1466 bp, Oryza sativa
catccatccaagtcgctcaatattcattaacctatagataccttggctacatgcatgcatgcgtgctagcagcttttaattcaggtgagaataattaacgtatatatctatatgatccggatatgtgcttggctgtttttttttttcaaacgtataaaatgattgcatgtcagtatatattagaagaaagcaaagtttcgattatgtaacacaaatggctagaaggctattgccggatgacaagatcttgtaagaaactacttaaagaaaataaaaactcatataacgagagagtgcaggtgaagccccattaaacaccaacaagctagcacccccaaaaaaaacaaataaaaacattgctatagtgctttcttgcttggctgttcgaatttaattactctctccgttctaaaatataacaacctggttgctactattagacataactttaatattacaaatatgaacagactttgctatactagattattatattttaggaagaggagtatataaattctattcgtgcaacgcacgtggcctatgacgcacacacatggatacagcatcatacgtacattatcaagtgaggatatgcgcgtatgtactcttatatacacattcaagggacggaaactaaagataaattcaatttctgagcttatattaactactaattttgtactgaaaattcactcgtgtgtggataactattggcacaaaaattaatgaaaagaacttataatcatgatcactagatacagtctgcgctgacaactctaccatcacaaccttaataattagcgattggaacttaatttttttaatttcaaacaaatgttagttccgatcattatctaaacatttaaaaaacattcctttttaaataaggaattaagagagagatgatgattacatacggataaaaacattaattagtttcgacagacgatcgagtgcgacgtacgtgcgcccccgtcatgtattctttaggcatcaatgcagcaagaataattcagcgtataattgaaatattatttttgctaattaattgacgcagaccgaattgaaatgtatgcatatgcataatatgatatgaatggtatacgtacgcacatactatacgtacgtacatttacaacgtatagtacgtatatatatacacagtgcaatgtggtccagtagacagggcgacgtgcaggggatcgtgagaaagcaaggaataattaatgattagtcgatgtgacaccttatccaagaactaaatgcatgtgtacattatacacagctatatataatattgtaccgatattttgttgttgtaatataatttgtcattaatttggctgcagatatatgcaacaagagtctctgtgatggatgtgtatgtgtatagctaggcatactagctagccggtcaacatatctctctgtatgtaacatgcactcgatcgcacgagtagatg

SEQ ID NO: 57630 - DNA, 746 bp, Oryza sativa
  unsure (1)..(746): unsure at all n locations
agggggccgtaatacttctcaatgccagtcgngtttaaagcggcttggcaatcccactcaacgcagttcgcttgtaaaggcaacaactccatccacgtcgtcgtcgtacgattctggtaaatggtggggattgtagcctcttcccgcacgccgttaattaatagtttcgcgaaagatcgatggaacgcctgcgatgtgggaagcgggaacattcagctcgacgctccctgtgtcggtcaggaggcgagtgaacgaattgctcgtcgtgatccctgctcctacgactggttccggcgccgacgacgctgaggctcggttggtgataaactgcatggttcatcgatggattagaagagccattcagccaaggctttgatggactcatgtcagacaggccattagaataggcatccaagaagggaaattgtctttcccttgtcccctggaaagcactcatgtcataggcccttaagtatccctcgtcgtaatatggctcagtcaaattaaaccgcccaggactgttagcagaagccatttcctgatctgccaaattgcctcttaacaaaaacggcaacgaaagaccaaatgtatggtaatcatgaccaatggactctggcatactgccattgctctgttcctcctcaagcaaatcgtttatgatgtcaaggtgcggaaattcttctgccactgnnnnnnnnnnnnnnnnnnnnnnnnnnnnnnnnnnnaggcgagtcgcattcaaggcg

SEQ ID NO: 57631 - DNA, 1275 bp, Oryza sativa
  unsure (1)..(1275): unsure at all n locations
agcgctttgattgccctgacgaccacnnnnnnnnnnnnnnnnnnnnnnnnnnnnnnnatttattttactcctattatagtgtagaattattctctcaatcccctctccaatctctttctcggattaaccgaacaaggcctcagagggagaggccgccggactcgtcgtcgtcgtcgagcgtggaggtgtagacggtgtagagcgaccagatgaggccgaacacgccgaggaggatccaccccagcaggttgttgctcagccccaggctcagcccggtcccctccgtcgacatccgctcgtccaccagcgccatcgccgccggcgccgacgacgacgacgccgtcaccgccgccgcgagcatcgacgtcgcgcctttcacggcggcggcgggcgtcgcctccttgccgtccctggaggagtagccgcacctcaccctctcacccctcctcgctctcagctgagccacccctgcacgcaatgggcaatggcagcttccatcagtgaactgaatgatctccgattcttttaccaaaattcttactcgctccgtcgctaaacatttgacgccgttgacttttaaaacatatttgaccgttcgtcttattaaaaaaaattaaataattattaattcttttctaatcatccgattcattgttaaatatacctttatgtatacatataggtttatatatttcacaaaagtttttgaataagataaaatggtaaacatgtgctaaaaaatcaactccgtcaaattttatgggcacaggaaggtttctattgcactgtggaaaggtttgtgaacttacctgacgggcggtcaactacggttgttccgtccggngcggcagcgcggataggcgcccaaggttcggctttttccttggtattttgggaggggggcacaggcccctccacttttgggggttttatggagaagcccccggggccaccggggaggggttccggcaaacgggttagattttctggggctgtgatacacaggcgggggggggggtgcggggctttacccctgtggaacatggggcgccgcccctctgacgcgcggagtttcttcttaaaaaaaaggggctgttttacgcggggaagacacccccgccctctatttataaataaaaaaaacnggggggggtaggtccggcaccccattcaactttctgtaaacacccccccgtgtgggttccccacgagttataagatgtgttttatatgtttgcgcggggtggggggtcgcaccaccatatatatttatca

SEQ ID NO: 57632 - DNA, 571 bp, Oryza sativa
ccattttatgcacttacaacagtatatatatatatatatagagagagaggggtctagatcatttctaggcagaaatctataggaacatcagcgcttatcataccttcacatcctatattaattaatttgatcggaccgaaaagagagttcatatcagcttataagaaaaatcggacctaaaatcattccaccttcacaattaatttaagaaaaataaaaaaactacaatagaacctgttagagttctctgttagatcacctagatttagatctagtcgggttgtctctattgggttgatgaacgacattgtagatgaaagggagagggtttagataccgaccgattgatgtgttcgtggaggaaagggcgccggacatcgtcgttgtcgttgtggctcgacgtggacagcggcgacggtgtgcttggtgccgatggcggtgatgcagcggcggtcgcaggcagtgacgcggttgcggcagcaatggtgtcgacgacgaggcgtggcgcggcggtggacttcccgtcactggctacgcccccctcgagatcggtttagggtttgtggggtgg

SEQ ID NO: 57633 - DNA, 599 bp, Oryza sativa
tcctgcagccctcttagttccaagggtctcacatacacgaattatcaatagattgtatgatgaccaacttatatctggtgcctacttactaaattgcgtgcataaaggtgcactctagcttggcaaatagcaccgataccgcctataacagagagaaaaaaacacttacctgctacaatgagttattacatgtgactgaggtgccagcagcatctccattgggccacttgcgcattctggccttgagggcgccgcattcgaaggtgcgaaacaaatggggcgtcttgcgttcctcacggattgctccttctactagtccgacgtcgccgttggcggacatcgccgaaatgtttgtctggaccggacctgccccatcctaccctactgcttgtctacattttatgaaacagcatgctactcctcttgcaatggcatgcatgggggggcccatgaggaccgcttccatgtcacgccgtgaagacgaagcatggcgcgcacgtgtcgtatgtgctggggtacatgacgggacaagggcttggggggcggatacttcatcatatacggtacaccaccattgatcgggtctcaggtgactaccc

SEQ ID NO: 57634 - DNA, 3958 bp, Oryza sativa
caaggagcttaggtgagtcgacatgaatacacatactacgactacatgtattcatttcagaattcagattgcgtgtaccgatggagagtgcatttcttacatcaccacactgcatacatcatccagaggtatggagctagccagtgagatgaacaagaaacaaaaataacaggctgtgggatgcatgaacacgttctgaatttctcttcctgtcatgtcaacgggagagcaagattcagcacgcactttgttcagagactgtgtcgagttcagttcaaacgaattgatcggttagggctatgtttagttcacactgaagtatagaagtttagttgaaattagtacgatgtgatagaaaaattatgtgtgtatgaaaggtttgatgtgatggaaagttggaagtttggaaaaaaaaaaactttggaactaaacagggcctagatagctagctggaatatcgaattagtggataacatttgggaatattttggggctggcatctcgtggctatcttggttgtttaatccatggacagtagtacacactacacacagtatagttagctgcagtaagacagttttgtagtccaactgaacctagctgatgggtctagataatgtgttaatgatggtgttagatgcgtgtattgtactacttgtacatcgaagatgcgtgtattgtactacttgtacatcgtgcgtatgaaagtataattatttatgtatgtacgtataaatatacaggatgttcgtggggacgtggaacgtgggaggaagagcaccggatcaagggctggacatctcaagctggctcctggaccagcaacctgcatcctcccctgctcacatctatgttcttgggtatgcactcatctagttgctgtagtattatcatcagtgatttgcatttgcatctttatatcttatcttcaatcctactaattcactgcatgtaattaagtttgtttaattacctcggattctaggatggaacacactgctttcagaaactggtaggacaaactggtaggatggagtagtattgacttgtgaagatgggcagcaaaaatagtgggctgcccatattcagaagtgaacctcaaaaaattctactgatgattcagatcatgaaacagtgtgctagcaggttaattaaactgctatggatttcagtgtaaacccatactccgtactgaccagaattatggcattctgttacttcttttaacataggaacggtcacctgaagctgtaggttagcatagctgcagagctatggccatgggtttcagtgttttggatttcaggacctaatcatgattattccatcacctggagtattcaccaggagatgtaattatactaacggtgctactagtaattaatttgcttccttccattcctgacatatgccttgatcaacataaacaagacggcattgttccatgaaacagtgacacaatgatgcatttccatttgaccaacagctatgactccagagggattttactaattaatcatttaatctgtctgtgtatcggtaagcctaaagtttgattatcctaagtaagtgttctttactatcatgccacaggttccaggaaatagtgccgttgaatgcgggaaatgtccttggggctgaggataaggggcccacatacaagtggctcgatctcattcgccgagctctaaacccttcctcctctgaaagaagccatagttttcctagcaattacccatatgccactgaagcaagtcctgagcgacccaaaaacgatagggtcagcttctcggacttgctagcgatggaggacagactcagcatggtatcagagctagacgacgacagcgagccgtcgacctcgaacccagaatcgagcagcgaggaggaaacgacggatgtcgcgacgcgatacctgaggtcggcggggcaagggtaccggctagctgccagcaagcagatggtggggatcttcctctgcgtgtgggtcctggctgacctgatgccatgtatcacaagtctcagggtgtcttgtgttggcaggggcatcatgggttacatgggtaataaggtaattaaactgtgaacttattacttgccgatcaatttcatcaattcataagatgatgatcaaattgtggcgtaattaatttgtttttaatttggaattggtttgtgatgatgaaggggtcgatatcgataagcctgacggtgcaagggagcacgacgatgtgcttcgtgtgcacgcacctggcgtccggcgagaaggacggcgacgaggtgcgtaggaacagcgacgtcgtcgagatcctcaagaggacgcgcttcacgcggcggcgccggctgtccgcgccggcggcggcggtgccgtcgccggagaccatcttggagcatgagtaagacactgaacaattccatctgtcgtccctgaccctgatcgacttgatcttgtatggatgtatgtctgaatgatttttgaactgcatgattatatttgcagcaagatcatatggctcggtgatctgaattaccggctgacgggcagcggcagcggcgacacgcaggagctgctcgacaagaacgactggcaagcattgctgcagaaggatcaggtgcgaatcaatgacagtaaatctgaagctcagaactgaagcagtacaaattcagagatgaataatcgtgcatgcatgtaagctaaaaatttgatggctgcgtgaatctgctgcagttgcgagtggagcagagagccgggcgggtgttcgggggatgggaggaagggcagataagcttcccgccgacgtacaaatacctcgccgactccgacacctacgccgccgccgccgccttcacctcctccgccagcaagaagcgcaccccggcatggtatgtaaatgtaattaaatttctcctaccattactgtcacaaacaaaattactcttgttatgttcagacaaattaactaacattaataacccctgcaatagggatcagataggatttagctagagatcacatgcatggttcacgatcgatccaaaaaaaagaatgcatgagaataatgatgcagtagctagggcgggctgaatgcaatgaatcattaagtcagtcattcatgtgactacgtgaggtagctgctacgcaggcacatgcatactgattcctgcatatattcctccttaatagctagatcgtgcacagttttgacttaatccatccgcaatactctccatcaccattgcatgttgatatgcatgatatatgatgatatgcatgtttccgtcaccattgcaacaattaagaatgagattctacaaatcgtgaccaatcaatcgagttactgtcgagtactacagaattgggaatattcagagcaacagaaggttatatatatatatatatatatatatatatatatgccctccatccaactgaatttgattagcacgtatactagctatacacacagaatgttagcactagcttaattatattccagtatacaattgatcagacctggggtagagtagagtagactccatggtgtgcagtccttgtcacgctctgctaattaatctgcctctaaatattgctatactcctaattagtattaaaatgtatggtataaaatataatattttttagtactatgagtctagaagtaacacgaagaatttggcttaactgaccctaaaaatgcaggtgtgaccgcatcctgtggcgcggttcggggatggagcaggtgcggtacgcgcgcggggagtcgcggttctccgaccaccgccccgtcaactccctcttctccgtgcagctcgccgccggcggtaacaacgccaagtccgaccacctccacctcctgctcctccgcccacgggccgccggacctgaagcagcagctggcatcggcctccgctcatccagattctgacacacacacgtagatgagcatgtagtatgcct

SEQ ID NO: 57635 - DNA, 20034 bp, Oryza sativa
ttttctccaccaccgacctcacccgcgccacctcctctcccttaacgacctcgcccgcgtcacctcctctcccccgccaacaccgcctgcgtcggcttttgctgcgtcatcaccaagaactccttcctccactggatcctcaccatcaaaccacccgcccccactgctcagcttccttgacattggcagcggctctgtccccatggagccgccccacccctgtgctcccctcgcgggttcatcgccaccactgccctcaatatcgtcgatttcacctaccctttcctcccatcatccgtggatctctcgtgccaccatgacatcctcgacagtcgcgcccttgatggatatggattcattgatgttttagtaggtgaaattcgatgtttcatatgttacaccaaaatgtttcagtagtagttcaaatgtgtttcatcatttcaagagattgaaacattttcgatctagccctgttcttttctccaacaaaagttggataaacttttggatacttgtggcacgcttttcaaactgttaaacggtgtgtttcgtgcgaaaactttctatatgaaagttgttctaaaatatcagattaatcaattattcaagtttgtaataattaaaactcaattaatcacatgttattaccacctcgttttacgtgaaacgcttaattttatcttcatatttatcttcacgatattcaaacaccacccaggataaagatgaaacatttttttcccgattagtgaaacaacacccgatttttgaaaaacaatgaaaaacaaatagggcgtctgatttgtagttgcttcgcgcctttatatacctacatgtcacagatacacccgtatatacatacaatatgtagtcttgtagagccagaacgattgggcatacttcatatatatctacacacaactatttaacaccctagaggggatgtccctcccctagcttgtttgtccaccaaccatccaaataattataaatttttttaaaagaatttgacaacattcatacatcatatacattcatacccgaatttattcttttattttctcaatatgtaggtcgaaattgaaattgatttttgtggagtgacagatgtcactatattccacattatcaatgtttttcatttttttaatattgtacttgattatatttgaaaaaaaaggtacacgaggggacattctctcgagagattagaatccattcacatgaaaatagcaacgacggacattttcactagttgaaaaacattttggacaattttctgctacctgatagttgtgcacataaggtagcttcttatgcactttgttttattccgtaaggccttgttcggtttggagaggattgaagaggataagaggggattgagggagaataattccacaccacaataggtgtggaataaatcccctctaatctcttcctcatggagattaaccgaacaaggcctaaaggaagagttaagcttaatctttcctttccctggaaaaacgaggggagaaagtaaaacagctttctacttaaaaaaccagacatgcacacagcacaacactttcaagttgaaccaacgaaagtaatttttcatcgaacaaaatatgctctggattattcatactggacaatcatttttttatgactaaagatagctagcaactgcatgaccattttggatcaaaagcggccgtaatagttactataaagcacagagctcgtcaaacagtcgcagaacaaaaaaaaaaaaacaaaaacaaatagtggattaaccaaaatattctgtagagagctatggagtacaatattcttttagtttgaagaagcaaagtaagtatcatcgaacaaaatatgttttacatgatttacatcattaattattcatacctgaaatttatagttaaagaagtgtactgtttgtgacaactctaagatcaaaacaaacccttatcactaaacatgcataaaaaactagttcagttctaggcatcatgaacgctgtccaaactgatattcaagtaccagctgcagtgaactgagctagctagactgtcgatctgatcaatccgttcatgatgcctagaactaaactactacctccgttctaaaatatagtaatttttagctatgaatctggacacacagttatccagattcataactaaaaatatttatattttaaaacggagggagggagtagttttcaatctgttcatgatgcccagaaatgaaggcatgccttcattttaatcgcgcgctagctctagctttcgtgatgatcaacctgcatatatatggcaatcagaatctcccgtacgtgttaaggaataaatatgacatcaaatgtataatcgttggatcgggacctagctagatgcaccacgatgatgtataaaacaatactatatattaatctcgtcagaattacctctagcttttggatattgttttcatttattccagtttcatggctaacacagaagtcttagtgcactgttttgcaggtcgaagatcactttctcctctctctatatatatacatatgcacacattaatctcaaaaaaacatatgcacacatttacgtgagaaatcagcaataaatttatttaaaatattgttaaataagaaactgatcttactgttcaaagctaaaaaatctaataaaaaggggtaccctactaagtttagtgcatctaaaagcaagcgcacatacttgtttattctaattcttgatactgccaaaataggaccgccacacgccacacggtgggttgctattgtcgcaaaaatcaattgaaaattatgttgcccgacctgtttttaaccggtgtagtatatgtggatattggtataaaattcaaaatatttcaaatataggcaaccatagaattgcacaggtatttcctccatcccaaaatacaatcatttcttggttcttttgcaaaaactaagttaaaggaaaaatatccactttagtcactttagtggtctacttttaaatttttaaaattgcttagattatttttccaaagtatctcactacaaattttatgcgttggaatcagtagcatataaatgcttatattgtggtataaattctaaatcctagaaatgtttatactaccaataaaccctattgggacggtatcagaggtgctggtacataaaaaatgcacctatgaggctttcctcatacaaataaaaacggacacctatatataaccaatcattggtgcctgtccattaaaaagccaacaccaatagtcatagatgtcggttcttataataaaacgatatctataaacattacatgggtgccagttcttataataaaccggcacctatgagtgcaacgcaatatatatcggtatatatctgtgtatgtgttttgtaccgaactttttcatatgaactcagataaatgaacattataacaaatctacagagcttgatgagatttacaacctagtagatcactttttgattcgaggtcgtttggatgtatgaaaatgtgttataagttctcagatctatttagatctatttaaaatttctcaacaacaataaattaaaatcatagtacaggtattccatgttttcttctttcacacacacactacacatgaaatggctgttacattctgcatgcttatggaaaatggcaattacattttttaacctggaaaatgacagtaacattttttttaccaggaaaatggctgttacattttttgacttggaaaaccactggaggagatgatgatattaaaagggaagtactgctatatattacatccaaaatggtccgatataaagttcacacatacagtagagaatacagcataaagctaaaatgcccaaacaacacatctattgtatttagagtatggcataaagctaatattcacaaataaaatcataattcatatattgcccaaatttgactgaatagctaccgtcgacatgtagctatcatttgcaaagtatgcacacactctccagaagctcgattagcagacttgggtataaacttttaagctgatcatactctggggttccaatcaccatttccattgtgttcgatcggagtggcaaggaaagagaagcaagccttgtttgagcatgttgcacttgtgctgatcagctagaagtaatataactatcacgctcttcacatcaagtatccaggcaaagcttcatctcgcagatggccttcagcctttccagtccacactcactagaacggataccctcatctcaatcgggcggtaagccccatctcaatctggcacagcgtccgtcacaggctagaagtcgctgatgtgaagagttatctcaatcgggcaaacggccgtcacgaatgaatatatctcaatcgggtcctaagtaaagcccgtcacagatagctttgacccagacgaccagtcaaactatagcccgtcacagatgacctatctctatcaggccacaactagcgcccgtcacagatgactactaacctttatcgggcctaaactagagcccgtcacagatgatacacatctcaatcgggcctaaacttactactgacctcaatcgggcctaaactagagcccgtcacagatgactactgatctcaatcgggcctaaactagagcccgtcacagatgaactcatctcaattgggcatttatttatggcccgttacagatgactataatacacaaaaaaataaattttgttttttggctagcctcaggcctttgctagccatgcccgctgcaaaaatgacagaaacaaacacagatatccaatatccccagctccccagcatcacccattcatatacatatggattcacatacacagacatcaacatatttcacacaaccacacattcacagccatctcatatttcacatccattcacataattaacatccattcaaatatttatcatgtttcacctacaaaaccgagttaattggatcaaatatttatttagcaagtcttaacataaacatatgaaatatatacataaatataaacatcacagttacatcctcatagttgcataataagtgttcatcattgcctaaacataaaggctcaacattgttcatcattttagtttaagcctaaacattcctttggggttaattatttcgcagaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcaaccaaagtcttcaccttttctctatacagaaggcgcatgttgtggcacacatggaatccgcactggtcacctatttgttgcttcaccgggaagtctttttttgtggatgagggtgtcatgtcctgtcttcctgaggcctcctctttgcacgtattgggcccacgcttcatctatcgctagttgaattggggtccaatcatatgcgttcttatcaattctggagttcaggtagtgacatgtactccacttaggtgttatgaccagaaggatccaatgggcactacggcattaatatagtgaaagttaattaagtactcaaggaatgctgttgtgtatatttagataacacacttactattgattataggcgcacataatgtactcgatccttgtctcggcgggaccacaaggtgtcgtagatgtagttgaccattccttgacggtcattctggagatttgtgacagtgaccacttgtggatcaaggaaggcaacttccggtgcatgcttctgacaccattgccaacttaacctacacataggataaacgatcttgtaagcaagttaaaccgattgttattactagattgagttgggcgacaatacttacaaggagtagcacttaaggaggcttgtgtccaccgctcggagactatagaggtcgaaaagatccttgaagttgactacgatataatttgttgaaccaaggaatggctttccatcgtgctctccaaggatatcggtagctttacttggcttcctgacgttagatttctccatgtagtataagtgaaggtccttgcaagcggtgcccattgcggcaagcacgtcatctccaaccaatggcatgcctagttggaactcctgtggaacgacgtatttcttcttgacctttttgcccttagtctcttcctggcccttacccagatctagcttccttggagctagaagcgaggcttgcacctttcctccccttcctctccccattgcttcgggtttatcgagagtaattctctaaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcaggaggggctgaaggagcagaggcgagtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgaatcgacttgaacttttgcacagtcggccctgagttgcgctccatgcactcttgtctctggggtcggcttgtacacaagtccctcggctgctgaaaccgtgaaggtcggtatcaccctaactgtgagggtgcagctcgttggttcctgcgatagttttaatattcttttagaatattatatatcatatggattcgttaagtctttcatgtattgagtaagttcacagttaccgttatgtggtcgacggcactgtcgaccgatgttggattttccaccaactcagttgatgcgcaactgctttgttttcgggtgggacttcctaactcttcgtgcgcagcagcaacggcggcctgggggttctgttgctcttctcgaatctcttgcctaatcttggccctcatcgactcgagctttttgtcgaattcagatgtcagctcagctcttatcgacgcccggatcttggctttcaaggcgtgcatctttctccgccttgttggaagtccgcttcttgtactgccacgcgaagtctggaaatccatacttccagggaacagaagacccaacgccccgtgtccgtccacggtattccttgttgcccaacgctttcgtgaggaggtcgtcctcgtgtctttgagagcaggcctcttgcgaggcttgttgctcggcaaccaacttcttctgcattacaatttagtgggtttaaataaactgcacgatgggaaacaatgcgaacatctagtttgactagacacttacaatagcttcgtatactcggtgatcttctgcatttggcatgaagattgtgccatcataattcttctggtacctggccctggcccagttcctagcccgagggtgtgggatatcgccaaacacgagcggtgtgcacgattcctccgcttcttcatcctcacgctgccattccttttccttaccggcatatccggtggtgccaagccggtgcggatgctggttcctggtttggagcaagcgatatgcctcgcttctagctctggactcgggggtcgacttcttcgcatggaattcctcccagacctgttccgtgatccaaggaaatttctctcttggatctggattcgccgagttgtatacgaactcgccgactagcttagtcttgaagttcttccaagcattgcccataaccttgaaagcagcctgcctgagacggtactcatgcaccgcaggataatcaaagctctccttgaacgttagccaagcaatgtccttctctgcggccggcacgagcttgatgtcatcttgcagaatactgaatttctgcctccctatgaccccgcagatagacctaaatcggctcaatattttccttggagatgtcggcaaccctacggtgtccaccgctgttatgcggaaccgttccttagggattttgttccctgtcctaggagtacgtgcccttgaggacccactagttgtcatcgatattggttcgccttgctgaaacatcgtatactttttttttctaaataacaaaaatacacaattgagtgctacaatctattacaatgaatttaatgtcccttagaaaaataaatgaaacatataaataaactaaattgcgcatctcacagtaataaaacgaaccacatttcatctatttactaaattcattaatgcaccatgtataaataaacgaaattgcagaatactgaattgtgcatctcacagtaataaaacgaaccacatttcatctatttactaaattcattaatgcaccatgtataaataaacaaaattgcagaatactgaattgcgcatctcacaataataaaacgaaccacatttcatctatttactaaattcattaatgcaccatgtataaataaacgaaattgcagaatactgaattgcgcatctcacaataataaaacgaaccacatttcatctatttactaaattcattaatgcaccatgtataaataaacgaaattgcagaatactgaattgcgcatctcacaataataaaacgaaccacatttcatctatttactaaattcattaatgcaccatgtataaataaacgaaattgcacatctcacagtaataaaattaaccacatttcatcaatcactacaatcatctatcacaaaattcataaatgcaccacatttcatcccaacatcgacatgtctcactcacagttcaatcacatatcatccacatccacatttcaatgacatgtcattcacagttagcatagggcggcgcgatggagtactcacctgaggacggtcggtggggctcggtggcggcggcgccgggctcggtggagggcgttgccagttggtgaaggcggcgttgggctcggtggaggcagcggtctcggtggcggcggcggcgggctcggcaaaggaggagtttgcagcggcggtgtcgggctcggtagagggcggcgccggtcggtggagatgccggtctggtaggtcggcgccgtgcgggcggcgtcgggctcggtgggggtcggcgacgtgcgtcggtgaggacgcgggcagcgacgacgaggaaggccgacaccggtccggtcggtgtaggggctcgagggaggacgacggcggtggcggcgggctcggtggcggcggcgcctggctcggtggagggcgtcgccggtcgggggaggcggcgccgggctcggtggaggcggcgagctcggtggtggcggcggcaggctcggtggcgacggcggcgaagtaggagttggcggcggcgctagggttctaaggaggcaggaaactgtagcgggacttagaaaaattttcgatccgatctgagaaaccctagatatagtagagtgatgagtcatctcaatcgggctttgccgtagggcccgtcacagatgactcattggtgacgggctccatactaatgcccgattgagatgacattcaggcccgtcccggatgactcatctgtgacgggcccaaagataatgcccgatagagatagattaatctctatcgggcttgaactaaggcccgtcaccgatgactatttttccatttttccaaataagtctttatatctgtgagtacaaaatatatagctgttgtataataattcattttattagtcataatacattttcggatagtaaatgatttcaaatggaaatatggtcaacaacaaagttgatcctctcatcaggatctacaacttttattttggtcatttgtctatataactttgtttccaacagcttgaaattgattttgacaatatgacaaatctaaatagcatttgtaaatactaaatgatttcaaatggaaatatggtcaaaaacaaagttgatcctcccatcaggatctacaacttttattttggtcacagaactcaatagcctcctcggtcgtgtaaccttcaatgatgctcccctcgggtttagctctgttacgaacgtacaacttcagaactcccatgtacctttcaaacagccacatttcccttcgaaaagccgggccacatagttttgtttgcttcaccagatgaacagggagatgaaccagtatatcaaagaaagacagtgggaaaaacatctccaggtgacagagggtattcacaatatccgtctgcagcccatctatatcttctggatctataaccttatgtccaattgcattgaagaaggcgcacagacgttggatcgtgtgacgcactttcggtggtaggatgcctctgatagcaactggcaagatttgtgtgattagcacgtggcaatcttgagacttcatttcaacaagttttagatcgtccaatttaacatacttatcctcgctgaatagcccgatggaactttaatatccttcaagcatgataacattgcgatcttctcatccttcgacagtgtgtggcaggctggagggaggtacactttacctgtctctgcatctcgtataggctggagttcactgcgaatattcatgtcctgtagacaaaggcgcgtgttcaacccgtcctttgtcttcccgggaatattcagcatcaggccaaccaaactctcacacacattattttctacatgcatgagatcaatgcaatgacggacatcaagatctttccagtaaggtagccgccaaaatatggattttttcttccacatacccttctcctttgtcttgctacgttttcttttcttcccaagctcattgcttatgttcttgaccatattgtggacctcatctccgaacaaatctttaggagcaggctgaagttctctcttaccgttaaaatttttcttctttcttctaaatgcgtgacgtagcaggagccacctccggtgacccatgtataccatctttcgtgatttcttcagccaccggcttcgtgtatgttccttgcaatcggagtatgccttctttccttttatagtttgtccagaaatattaccgagtgcagggtagttattaatggtgcagaacaatagaactcttagcttgaagttctcctgaccatatgcatcccaagtttctacaccttctttctaagaatctccagatcgtcgataataggctccaggaatacatccatatcattgccgggttgctttggaccttggattaacaagcacaacataatatatttccgtttaaagcataaccatggtgggaggttatagttcgcaataagaactggccaagtgttgtgagtactactcatgtcaccaaaaggattcatgccatccgtacacagacatatcctcatgtgtctagggtcggcagcaaagtctttgtgttttcgatcgatattccttcattcaatcgaatccgctgggtgtctaagcatactgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttaggacaagcgtgaattctacggacctctaactccagtggacacagaacctgctttgcttcgtatgtcgtctcgggcaatgtgttctcaataggaagcataaccttcaaaattccaaaaagatctgtgaaactcttgtctgtccatccactacttgccttcagcttcattaggtccaaggtaactgacaacttagtgtgttttgctttccatccagtatacagaggcgtctcgaaatcacttaccaacctgctgaacttcattccatctctctcattctgggctaggtcctcaatgtcacgtaacatgtcttgcagcagatcgtgatccacatcaaccatttcaccgcccaatggagaaggtataaacatgtcatgctcatcttcatcttcttgattatgtgcaccacttctgtctgctgctgctccacttcctgattcttgctctccatgcttcacccaacatgtatagccctccataaatcctcgttgtatcagatgaccgtgtacgtcctctccgctatcaaacatattctcattcttgcaatctgcacatggacaacacatgtaatcactgttttttcttattcgatcctcctccgcggtgttcataaaatttattacgccctttctgtactccgtagaatgacgtttcaaatttttcgcatacatccaacttcgatcaattgctacaaaataaaaaaaaacaaattagaggcacatattataagatcattattgcaaaagtaagacgtgatgaaattgctcaattaatgattaatattactcacttgattgatccattttgatcacctacaggaatttaatttctgttttccttggaaaaagggcaaaaaatcgccccctacagcctcccaccaaaatagtgagcagtgggatacaattacactaggtagtggggggtatttatactgtgcaacaaatatctataacggccctaaaacaatcaaccgtgacgggcatacaagtaatctctatcgggccttaataaaaggccgtcaaaaaaaagtgttatctgtgacgggcactacacttatctcaatcgggcctctagttggagcccgtcacagataaccctcatctgtgacgggcttattttagggcccgattgagatatggaaccctcatctcaatcgggcctcaactatagcccgtcacagataagtgtcatccgtgacgggttttatttttatgccgatataccatgcctgtgcgaccatatctcaatcgggcgaaacttcggcccgattgaaattacttccttgtgacggcccacaaattccagtcttgttatgggccgtcacagatggaaggatctgtactagtgactgtacctgtcagcaacacgaagctagttataatgagttgtgttatccaacaacatcagtgggttggggtttcgtccacgaatccatcaatgctaatatgctgtgcatatagtgcacgaaacaggtacatcaaggaaaagctagcaggtacttagttttaagatcaaagtttctcgaaatgaaaataattaaactatatattggatgccatgaaggtgtacaagcatatatatgtactcaacattatttgacttgtatataggcatgctatcactggagttttctataatataggaaatcttgacttaccagagttggtagagagaaagtagctagagttgatcaagctgctcctgttgttgggactgatggggagggtgcctttatataaatcctgaaagtgtgtattccggaagcataacattagcatggctggagccaattgtagaccatattggataacgatcagatgcaaagtgtgtaagtgtacagaaaattaaatcccaagcttatccatgcaagtaatcatctgtttcattgttttgcaatctgagtactagctaggactaggaaatcatatggcgattatcatagtatagtaggtaaaactggccatgcctttatcctacataaagtgaaactgccattcattgtacttctccctatatatgtgatgcttatatatataccatgtgaattccaagaatgtttaccttgctcacatgaagagaaattctgttctaatatcttttgacgggagggagagatttcttgttatgttaacacatgcactagcagtagaatacaactatagctataagtatattacaactcacatgatgcagagggctacttttgcattgtgcattggtactattcctaccttttttttccaaaggaacacacaattaattttagtaggaaaattttgggcatccgtaatacattaaaaattaaaatcaaacaagaaacttgaaccggctccaaacggatgcctatctatgaggtttgacttggtcagttgacatagataacaccttagccctagattctcatttactgcactacttgagatgggaaggctcccatgtctcagaaacacacggtaacaatgttaccgagttccagtacacggtaacagacacacggcggcttcaattcatctgttatcgtgcgcatttcccgggtgttttacgattttgcgtacagtatggccaaaaccataccgtgtgtgcctaaacacacggtaatgttcccgggtgtacgtgaactcccggtaacatacgtattaacggaatcaaatggaacagtgatttaccgtgtgttcccagaacacccggtaacatttggtattattcggtagtattttttcccttggtaattaccacatgttactattagcatttccatcataaccataataccatcgagcaggagatatgttcatatccaatagctggtagccgggaacttgcaagacctagggaaagcctagaagcggtaccgctaccggttgtatactgttttggagttgctttcagacctctaatgttactacaacaaaacctcatgtataggcacttttgtagaggcattttacaaattgcctctaaaattaggagttttatagtgtagacactttagaggcactttaaaaactgagtagaaaacttttactctagagacctttagagacattttcagaatattttattaaattttatcttatataggcattttttgtgcactttaaaatgtgtctgatatgtaaaggcatattcttgaagcattttaaactctgtagagacacttcttagaatgataagtatactaagggactaaatataattaacacaaggcacaaacatataagtaatgacatgatgttgggtcggttagtgcattaaagataaaaaaaagtttgcccaagagatcttgagtagcattggttgatatggttgtggtacaatttaaatcctctagaaaatgcgtctaccctcttgtagacattttatgaaatgcctctgttgtagagacaattcaccgtaaggcacttattaggaatttttaaaaatgactctaccatattgtaaaggcattcggaaagtatctctgtagtattagaaagatgtctctatttcttgtagtctgtatagattaaggtggtatgacaaaaggcctcgttttgtatgcccctcagaccggtcactaagccaactacagaccttcatacttgcatatagtgggacaatgtaccaaagttggatcaagcaccaactatccaggggttaacctttatatttgggaatgttacatggggaattccctttgcgcatcgtaggaaggcgggaacgcgatgagcgccgattgtgcggaagaagtggcatcactgttgttgtcttttcttgcgataatatagtttttatgccttcaaattagttcaagtagtttttatcctttccaatgtaatggtctatataaggcccaaggttaatggagaataaagcaagcaagattgatctacacaaaatcctatccctctcttcctttgtcgatcgcagtcacggctccgggaaggtgagggtgtcagcttcgccctcccatcgagaacacgaacaaccttcggagatgtggtgtcaacttggtatcaacaccttagtattatcagcttccatcgaggaggtgttggtgtattttctgctcccaaatatatagaagagaggggaagaaacccaaagtaaagaaatcacctccaagagacgtgaagacaccaggaggtgacccatccaagctctacactgactgcatcttgaagtaagtaccgatgcaatgaaatacttttgtaatcttcatctttatttttttcatttgcaaatcttcatcttcatattttctttgttttgtggctagattcaatgaagttggtaaagaactactcttttcttgggattgcagtgggtctctttttagtaatggtaaataattttgtgtagtgtagggtacagattgttgatatatagtatgcacatgcagtttcatatgcatagaattaacagtactttgataagtttttctcatggcacatgtctatttttttctagtttgttagtgcaaaaataatcatgtcaatggaagttgaagatcatagttggatgtatagtggatggaatgatagtgatggttgtcattgtgaagagtcggtgcgcaacacaaatggttttgttgagcgtgttttcagtggagtacctaatgcagaaagatttggagtaatgtgtccttgttcaagttgtcgcaatagaatttgaagaaagaaagatgtaatgagtatgcaactctgtcaaagaggattcatgcctgattacactagatggatcaaacacggagagtctcctgttaggttatttacagcagtggaaacttataatgttactgaccccttagatgacatgctatgcaatttgagtgatgcaatggatacatattttcaagaggatgagccaacagcagatgccaaggcattctatgccatgctatctgcttcacaagaacaactccatagtttcactcaagtgtcacgatttacagcagtcacacggcttatgggaattaaatcacagcataatattgttaggtttaagggtttgcctaggtgcggatctagaggtagacaacagttgtgaagttggggtcttgggtagaaacaagcgatattttagtaagtaaattaatgcctcagatagcgagcgaatcgtcacggaactggtaaatcaaacaatgtaggcacacgttggcacagttctgtaaataatagatgtctcatccggttgagctgaactcatggcaatattagtgatgaccttagagaataaacgggagagagggagagagagacgtgagagacataccttcgcccttagaggtcgatgcggccatagcaaaggtgtggctgggtttgtgggtgcttccggggtcagcggagtgcacgatggcgatgacgacgacaaggccgactggcagcgtagatggtgagcacgatggcgatggactttccctcacttcagcgcaaatcctggggttctagggtttgtggggagcgtgtgtgcacggcaacgaacgttggttcgcgtgcactggcagctccccctttttattgtgcactgtgtgagaggggcccacagccatcgaacggctggcgcccccgatcagggtgcgtagaggaggagtggggatcggtttcccgatcccccggagatcgcaactaacaaatatatcttcagaatgcatgaataatttacttagcctcattggtgatatattgccaacaggtcacaaaatgctatccaacctgtatatgagtgcaagagtcttctaggtggtttaaaaatgccatatgtcaaaatagatgtttgcataaataactgcatgatatactacaaagaggattcagagaaagaaaaatatgatatttgtaacgaaagttgttacgtagccgtggaagagggatatcaagggacaaaatgaaagctagtgccacacaaagttatacgttatttaccatttataccatgaatgcagcagatgtacatggagccagtaacggccaagcacatgcggtttcacaaggagagtgcttgtgataatcctgatattgtggtccacccattttatggcgaagcatggaaacacactttccaggttttgcactagatgcaagaaatgttcgtcttgcaatagctgaaacggagggattaattaatttaacgagatcagtactattcataaataattaaagcatgaaatagtaatagtatgatctgttggtgtttgataaactggaaggagtaggtcatgacttgccttgcaatcaaggtcttaatttgctgacattagcatagccttcatggtccacctagctcttgccgctctgatcgatggttctgtcattgtgatctaacatatatacacacaaaaacagcaatgaataaacatacaagaaaatgctacaaatgaagagcaaaagaaaatgacgaaaacaatataatattggagcgacaatagagaaattctggagaaccgaaggacagaacgagttcaaaggttaaaagattattttaggattattaggttctatggtgtacatagggacagggtgaggatcaagactagagtgggtgtgtaatatgactgatcaggtggtgttattttcttctgaagataaagataaagattaagttatttacgcaaaatgaggtggtattaacatatgattgattgagtttaaattattataaacttgaaaaatagattaatatgatattttagagcaattttcatatagaaagtttttcgtacgaaatgcaccgtttagcagtttgaaaagtgtatacacgaaaatcttaatcttcatcctactcttgtcggagaaaagaagctgaagtggcttaaaatttgagtgaaccgggagcgaagccacacatatacaagagccggccggtttggctcgagctcagcctaaccgtgatactgttcatcgggctcgagccacatggctcggctcggctcgatcaagtagctagggatcgaagtcgacgtcccgcagatcgctcgtcggcaagaatcagcggcggccggccggagcgggagacgtcggagcgacgggagacgcacgccagcgacgagctgagagagctcaggtggagctaggggcttgctacggcggcgaagagggaagggagagtaggggggaacctttaccgagtcgtcgaggcggcgccgcgccggcggcgagagcgaggagacgggttgcggcgcgcggatgcatggtggaatttgggggatcgagaagctccaggttttcacggtggctggccgggctgagagcgcagatcgacggcggtgacgagctccggctttgcatcgagatgcgtgctgggcgaccgcttagggtttcggtagaacgggcgcttgcggcggcggcggcggctctgcaggctgggatgggccgagtgggccgagcgtctggattctcattacgtgaaaaataccaagctgatttgtttcataaaatgtagctgcaggaactcatgtgttgtaaaatccccccaattaattgtataattcattttatttttatctagctacgcccaacgcaattacatatatgcacactcatgtatataatatctcactgagtgaaaatgtgtagattaccttggattgggaataagctaatgtcccataattgcttatattgtgatataatttttttagatcctagaaatgtttatatttttggtacggatatggagtatttaccaggttcattaattacattattcattaacaaattcccaatttgattaaccagaatattaataatacaattgaaacatcatgggaacacatgtaccgcagtaaaaaagaagtcatatgcccaagcacgccggaaaacatattttgttcaatcaatatccgtttatttttagaaaataagctagagtgtttgcttaattaatacatactccctccgtcccaaaatataaacatttttagctatgaatctggatagtgtatccatattcatagctaaaagttgttatacactggtggagaagtggtttttactcccggttcgtaacccccctttagtcccggtttttcaaccgggactacgaatccgggactacagatggtcctcttttttcttttttattttctcccgaattaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagttctacaaaattcatcgcaaatacatcacaagttcacatcacacacaaatcaaatacatcacaggatcatgcaataaatcacaaattcttaaaaaaaaacc

SEQ ID NO: 57636 - DNA, 885 bp, Oryza sativa
cccgaaaaaattagtggtcgaattacagaccttttcttctttttttttaaataaacctcaaaaagaggatgagggggaccatattaaaaagaaaaaaaaatctgacaattgcacgattagttaaaaggaaaccggcaaaacctacatggttaattatagactcacacagtggtgttttaattactgatttttttatgcaaaattaaacccgattactaatcctataatcggtatttttgtgaataaaataggactgctagccacttggtcagttgctgaatatatgatcagttgctgacagctaatataattggtgcctaaatatcatgcatgtgaggtcactgatcagctcgatcgataatatcactgattgatcaaagtcagacaagcgctgatcagctaagctagctctttgtgctatcttgtaggagcatcaagttagtagtgcggcagtagtaggctactatagcacgacgtgcttggcactaataccgtatatgttttagcttagtacaattactcagtttattaagatgatcattagatcagatgaaactgacattaccgatatattaaccgctcagacggccgtctctcgccgtatatcagtaaagtaatttacacctatcttaaatagtaggaaagagtagacatgaacatgttagagtgcgtagctcggcccatcaactatgggccacctaggtcatattgggtctgctctggcttcaagcccaaccggagccacaactttaggtcctaggtctacataacccaaaagactagtctgatagagattgttccgggttccaaaccttgggctctgataccacttgttataaaaccggctccgaaatcacatcggaaaccaaacgcagaagaaacgcc

SEQ ID NO: 57637 - DNA, 1698 bp, Oryza sativa
attaagatataagtggtatctgtcatattaattatttcgtgaggccctaagaaatggtttcacaaaaaagaggttaacgaagaaaataattaaattaaagtatattagctagaggtgcagaaatgaaaaaaaaaaagagaaaaaaaaacaaagcttgcacaagctgccacgtacaggtacatctctctggcgaacatggggcgcacaaactaactctggattctctcttgagtttaatactgtgatttgtttttggagcctgtacgtgcttagaggattaggaactacagtaattaacatacatatctaggactaacaacatctaccactaagtttagcaatagtcgtactaattatactatacaaacagtatattactaatatactactttcatattttaatgtatgacaccgttaaatttttgtctaacgacgtttgacattcgtcttattcaaaaatatttatgtaattatcatttattttattgtgacttgattcatcatttaatattttttaagtatgacataatttttttatatttataacaaaaaaaatgaacaatcaaatattaattaaaagatcaacggcattgtacattaaaatacgatgggagtattaattaagagtataacataaccgcgtgtctaacaacaagcatgcatctacctgtaaccaatagcaaggcttagcacttagcaggagtaatagttaattaattaattaatcgattaattagaggaggatttgtattagtaaaaaataataaattattaatagaaaagtagagggggtggggccgggcatgcggcgcccgacgcggttgtcgtattgagagcatgcacatgggggccatgtgtggcgcccccgccgtcagctcccattggcccacgtgtcgcacgcaggtgcacgtgcggcgcgctacgcgacaaagctttgccctgcgcatcgcaacgtgtcacagtcgccgccgctgcaccgccccgactgacagatcacccacgacgccctatccacacagccttaaatattttcagtgatattaatattgtaaagttgaaaaataaaattatttgattatttaagaaactatttttttaaaaaacacacctttatcagtatgagaagcgtgttaacgaaaaacatgaaagttgaaatttggagttagagtacaggagtatagaacgcggcctgaatatagaagattgagaatacggcaacgaggtaagttattagtgcgtaattaattaaatattaattattttaagcttgaaaaaaatattaatactacatctgtttcaggttataagactttctagcattgcccatattcatatagatgttaatgaatctaggtaaatgctagaaagtcttataatataaaacggatgagtatgattttaaagtaacttttatatataaatttttttttcaaaaaaatgcatcatgtatcatttcgggagatgttcgcacggaaaacaatgttacagatacaaccagacaacctacacgtactctctccgttccctgacacaccttgaacaatcttgtctaacaacatggtaaaaatcaggaaattagaaaaatatcttcatatgtgtctttcatatgtatgtccggttctcacgtatcacttgtattttgcagaaagagcagtgactaaagttcatgcatgaatagtttttagtgacaagtaaaat

SEQ ID NO: 57638 - DNA, 549 bp, Oryza sativa
cagcaggttgttgctcagccccaggctcagcccggtcccctccgtcgacatccgctcgtccaccagcgccatcgccgccggcgccgacgacgacgacgccgtcaccgccgccgcgagcatcgacgtcgcgcctttcacggcggcggggggcgtcgcctccttgccgtccctggaggagtagccgcacctcaccctctcacccctcctcgctctcagctgagccacccctgcacgcaatgggcaatggcagcttccatcagtgaactgaatgatctccgattcttttaccaaaattcttactcgctccgtcgctaaacatttgacgccgttgacttttaaaacatatttgaccgttcgtcttattaaaaaaaattaaataattattaattcttttctaatcatccgattcattgttaaatatacctttatgtatacatatagttttatatatttcacaaaagtttttgaataagataaatagttaaacatgtgctaaaaaatcaactacgtcaaatatttagggacacaggaagtatactatagcactgg

SEQ ID NO: 57639 - DNA, 4736 bp, Oryza sativa
atgagcaggctaaatgcgaagaaccggcaaccactgcttcagctagctctcgatcgttaattaaacaaatgcttcatgcatacacttttctgccacgtaaccacacttccattcactaccattagtactccaatatataacggcatgctaaatatatgttttgccactaaattaaataagaaaagttgctagctgatcgatgtccgatcgatcgatcaacacctgtacacgacagccataacgcatttctttattgtttatttctttgggggaaaaatggcatagtgctttaatgatgctttcgccttctggctgggctaccctctctctcccgtggcagctggtttcagggctggtggccgagcaccagggcctgcttaacttagcatctccacgctggctcgaccccctggtgttgttggtttcttggcagttgtggaaggaacggaacgctagggttttcgactctgcgctctcttctatctcagtggttctggagtccatccactcggagggccgtcctgtggtctttagctggcgttgccgcttttggagacttgttgggagtgtagcgtgactctgcccattcccactgtttgaagtcttgtttctctagccgcagtagttttctaagtttcagccttttattttgccttttctcccttcccctggcataagccggtctggctgattgcgttatataactataacttttttcttctaatatattgacgtgcaatccttttgcgttttcgtgaaaaattaatcattaattttagtacggagagagagaggggggggtaatgattgaccagccagctatctgtgttttcgttgcgaaacacatacacttatcctaatataattaatatccatttcctaattaatatccgaaagggattcggcatcggggcttctagccaccagagaagatgttaattaagaggagaagaagcacctcatctagacttcaccatgatagctagcagttgtggattatatcttacactagaaaagagttattagtcaagtcaaggagaattctttgcatgcatatggagtgagctcgatctttgttttgaaaatgatcgatgttgagacattcaatgcatttagttgctcaaactcaaagcaatatccttaattaattaaataccgtgccgatcagttagacttagatcgttacttgatcgaccacatgtataagttttactccacaaaataaagtgtatgggaattattatacgactatgtcgaactatgaattgaacaacttccatctctcttgtttcttttgggtggaatcttcctagtcactgacacgtgggccgtctatgtatttaaccagtctctctcactctgccaatactctgaacctccattaattctctctaccgtaaagcttttctgtttgaaagtttctcaatgaaaattttccagtctatattttgaattttttttgcaacaaatgttttctataaagttttaaaataaactttttctcatattcttttagattttagttgtatgtcaagttttcctataaacagttttcaatttaatttttcagtttctacttaaaggttttcttatagaaaataagtctatattttaaaatctaataattaagctgatgtgataaataatttgacggtatagacaagaggccagggtggggacctcgagagatgccaacacagcggcagtgctctagcatggtgacaacaacactgtctttattatctatcagatgggtttaatttttcttttcttttgtttcttggcgctagaattgtaaccgtttagagaaggcgttatgtaatgtgataagctagatttgaacttttcaagatcctttgtcactgtttagacgggactaaaacttttaagtccctatcacatcagatgtttggacactaattataaatattaagcgtagactcactactacagaatctctaaacggtgccggttgggaaccccccttcggtaccagttttcccaaccggcatccaggaggcggcactgttaacccaaccggcactgtttgccggttttggaaccggcacctttgaggtgcccatgagccaaaaaaaaatcggctcaatgcatcgagccgagtgcattgagctgtcaagccgatcccatctacacccaaatcccaaaatttcctcaaattcatcaatcaaacacatcaacatcacattcatcaagaacacattcatcaagaacacacattcatcaagaataaattggagaggagaaggaggaggaggagccggatggagaggacgaggcgccaccaccaccaccattgtcgatgaagccaccgtcgccacctcccgccgccgagccgccgtcgccgccacctcccctctcgccagatctggcggaggggagggcgccgccaccgggccgtcggaccgccgccgccaactcttccgccgtggggccaccgatgcggcgacaccacctccccccctgccagatctggcggaggggagggcgccgcccgccgctgtcgcctctcctcttggcgccgcctgctgcagccgctacctcccgccgccgcctccccctcctgccgccggcaggggatcaggctcaacccgcggatgcaccccttgctcctacagtgggcctcccctcccgccggatctggcggaggggagggctcccctccagctgccaagtcgtcgcctccgcctccacggcagcgcgcaggagaggagggagagagagagagagagaagatagcgaggtgagagagaagggagagagagagagagaggagaggagaggctgagcgagatgaccttatccgatggttgtggggcccgccggtcggctcagccggctcggctcgatccgtaaaggtgttggttttttttacccaaaaccggtacctttaatttattataggtgtcggtttttaaaaaaccggcacctttgtcttaaaaccgacacctatgtgcagggcccaccaacagcagtgtgggaggtagaagattaaaggtgctggttttgggtctagaaccggcacctttctctgacacaagttttaggtaccgtttttttttaaaaaaaccggcacctatttggacataaaggtaccggtttttgaatatgtggcgtgtggaggtgggtgtatgggcggggaaggcattattggtgccgggttttggtgtgccggcacctatagtggcgacacctatttacctttttgtagtagtgatattaataaaacccatccataatcttggactaattcgcgagacgaatctattgaacctaattaatccatggttaacctatgtgatgctacagtaaacattctctaattatggattaattaggcttaaaaaaattgtctcgcaaattagctttcatttatgtaaatagttttgtaagtagtctatatttaatactctaaattagtgtctaaatacagagactaaagttaagtccctagatccaaataccagatgacggttaggatcatctatagagggtgtttgtctgtggtagtttgggtcgcaatcaactcactctttttattatcaggaaaaagaaaagaaaaacatatatcgccaactaccggtccacagatcaatttccttatggtcgatggtgtagctaacattgtgtactatcttccatgagaacgccactatttgagtgaagaaatatattgcaagacatgaaaagatcgagagggcccaatgcaaggtgtgtgcatatatatatgcatgatgaatgcatgtcacaaccaaaagacagtgatacgaaaaagaaaggatgtttgtctccttttagcttcttgtagcgccgttcatagtctaatttgttttatatagtgcttctgaatcttgatagatcacaattttattgaagattttgtcaaaaccgtgttcaaatcagtcatatatggccaagctgggtatatatagagttagcttcgtaggctaattaggatgcgagacttttggtcttatacacatcatgctccaattaaagaagctagatcccaatggatgtgcaagttgtggatgcatgcttgcattgtgttccttgtggcctagaccagaggccatgcaggtctccatccaagataggaaaaatgaaactcaattctttgcaatacacatgtccctaatcaacatatatacatggatgcatgcatgcataaatgtactaattactacactagctaccatgcatgatccctagagcattttttactgactattgttgtgaaaactaagataaataaaccgcaaatgtaactcaataagtacaacaacataaaaataagagcattgggataaactttcctgccataaaaccatggtggtttattgactatacactcccaccgcttcatattataagttgtcttaccttttttatagtcatattttttcctagtttatagaaacattagccaaaatctatgacattaaatgagtttcaataaatctaacattgaatatgttatgataatatgtttgttttgtcttaaaaatactagtaatatatttttctataaacttgatcaatcttaaataagtttaagtagaaaaagtcaaaatgtcttataacatgtatatgaatatgatcgttaactggcgaccggacccattgtaaaagaagatatataaaccattgccgtggtggatctagctagattaagattgagtgttagcttttataatgaattatgtgttaaacactag

SEQ ID NO: 57640 - DNA, 583 bp, Oryza sativa
tatccagcagatcatattattcagcgaactgctgagtaaacgaactttatcgagtagccctgtaaaaatcccgatggtttttctttttgtagaatgggtgaatagtcattttacattgtttgcagcgttgtatccatttttggttgctcggttcagacagttttctgtcttacaattctctgtagggtgaaccagtgtgagcaaccccatttttgtacatgtaaattttggcatttggctatgttttgagtatacggatgcaaccatcacatagaggttatgctgagactattcgccgttaattggtcaaagattttatgtaaaatccacttgcgtgtacgctgccttgatagcggactgatgggaacattgggaagttgggaacaccaactgatgcttatctttgtttcagaaattctagacgcaaaactagcaccttgtaagaaacaagagggattacactttaaagatgagatgacagataagataatcacctaccaaaaacagtaaattgtgttgaacgcaaagacggcatcagatcaaacgcagcatgtcgaattaacttgaaccgtatggaagttag

SEQ ID NO: 57641 - DNA, 3118 bp, Oryza sativa
agggtttcgaaatggggacgccgggggaggcggatccggcgaggtgggggttggcactcacagtcgccgagcgtgtccgggtggccgacggcggccttgacgcacacctccacgcccatggcggcgacgacgacctggcgcttctcacgtacgggaagagaagattttgggtttcgacggcggcgagctattggcggcgagatgaccggagaaatgggggaggcgggatttatagggagggggagctcgccggagacggagggtgtgagaatgacatgtggggcccaggaggcggtccccccgtgttctggaggcttcggtattcgggacggggagggtagcgtgattgtcatgcggacgtggcggcccatgggccaagacaaaatgagtgaggtggttgcgcctagtccttttctgtttcgaaaggaggaaagcatgaagcatcgcaagattcgagttgcttttttttttcacaaacaatttaggcccgttcccaaattttttttccgtaaaacatcaaatctttatatatatgtatggagtattaaatgtatattaaagtaaaaactaattgcacagttaaggaagaaatcgcgagacgaaacttttgagcctaattagtctatgattagccataagtgctacagcaacccacatgtactaatagcggattaattaggctcaaaagattcgtctcgcggtttccaagcgacttatgaaattagttttttcatttgtgtccgaaaatcccttccgatatccggtcaaacgtccgatgtgacatcaaaaaattttcatttcgcgatctaaacatacccttcctatgaaaaaaaattgaatagtatccattccattgacgagttttttttttgttacatgcaattgtggtagtactactattgaagtgtgattatggctccgtttgagatagctgtaatcggtggattgacgagtaatctgatttctcttatagttgtctaaaagtgtaaacttgatgaataatatggaattattaaaaagttgaaagtttgctctaaaatagtacctaagaaaactttatataactttcttttcctgaaatgtgaaacgcaccgttgagaaacttagagagcatgtaaacaatgtacgattagatactcaaaggggcagacaaatgggttttttcccacttatctcgcttatatttcttttttttccttataaatttataccatcatatataaaatgaactagcaagctgtttttatataggaagtgttgcccacctgcaatcctatctgctatgatcaatgttttggcagcaaaatctacggtgagctttagcgctattccctccgtcccaaaatataagaagttttggttggataagacactttctgatgtctcgtagtactgggatgtatcttatttcagctaaacttcttatattttaagatgaagaaagtagaagtagtgtaaaggagagaatgtagacggtgaaagtgaaacagggctaatcatccgatgagaggagggggagagggtcaccatcaaacacaaaacacgtgttgcatctaatactcctcccacttaaaaaaccaaaaaaaaacaaaagaggtagggcttgtttggtttgaatccaatttttgccctaccaaaatcttggtagtgccaaaatcttggcaagttttggcactaccaaattaggtagtattgaatttaaactattgtgacaaaaaattgatagcaaaccaaacatgtatttgctactattgaattagctaagaaattggtaggacaataagttggtagcaaaccaaacagacccataatatcatccatggtcaggaccatagttaggaccggaggtgtgcgttttgtggcacgttgtgatgttttgtggttgttgatggacctgcagggcacatcctgacgccgacacaatgagatcagggagtaccagcaccaccgtccaccgatcacaattatggagtagcatggcattgtagttgcttctctcttgtccggttctgtgagcacgatgggatgcggtgcctcgccattgacacctcccttccccgcaaagaaaatatctaacgccattgatacgcagaatctgtgtcacttacgcaagagaacagcatgattaaactctaaatatgtaaagttgtaccatagtagatgtatgtgaaaggtcttacacattctgaatctttctagctaggttaacaattcatacaaccccgatgatcgtatcgatttttttatctgattcattgctttattttctttgacaaaaatgacctgtaaaataacaaagtaagacaattttacccctttaaattttataccaccaatagtcttatgatctatttaaatggaaaattaaaccgatgcataccgttagatcatttataccgtgaatatatgctatactaatatgtcatactataaaagttctcaatcataaccataggaaaccaaattcaaaacttgacgacaatagcatggtttcaattttatacgtatttggatacaattagacagaaatagtaatggcattttttaaaacaacacctttataacgtagaattaagggttaattagatctataccactgcaattaaccctatctgatatccgtaggccttctatttgttcctaggccctggcccctgggtgctcgggccgcgtgaggcagagagaggcgggccgcatgggcttttgcacggcccccgtcggctccgaagcgttccgcatctcacgccgccgccgcctccgcaacgccatggccgatctgcaggaggacaattccaaatcctacaaggtcgccgctttcattgtccgattcgattaatcccgcgctatctctctctctttatgcattatctggttgatgatggtgcacgtgtgtatgcattaatcaaaaactaatcacacatggcgtccgacgactcttctcctccagacgccaagaggctacgccgctcgccgccgacctccacctctcccgaccacctcctcgtcgacgagatcctcacgcgcctccccatcgccgccgccgtccgcctccgcgccgtctcccgcgactggaacgccgccctcacctccgaccacttcatcctcgcccaccgcgcca

SEQ ID NO: 57642 - DNA, 3481 bp, Oryza sativa
ggatcagctccgccatcacccactcaagtgtcgtagccgatgtttcgctgccggcactgaagatgtcctgcatatggtacatttttgcgcgtaggtgtgtgaaatgattagcacgagacaaaaaaaatccgaccaaaataatttatggtaaaactttttttatccacattatttagtggtaaaaggtcaacattgtaaaacaggtgaaataacttaaaaggaaaatgtatgaattacccgctgaactatcgtagttgaccgaattatccctctgaacccaaaaatcagacattgcttatcctaaactttcaaactggacgaattaccccgtcgatccaatccaaagtggttttgtcctacgtggcgtatgcgcggcaatccagtcagctctatatttatatagaaaaatgtgggacccacctgtcataccgcctctatctctttctctcgggcacaagggcacatggcggcgcagggatgggcagtgggcggcggcgcgctggggtgcgtcatcggtcggcatgcacagcaacgcgcgaaggcgggcgggcggtgcgcacatacagtggcgcgcgcgggatgtggaggggagagggggattgcaggtggatgggaaagaggagaagatggagttgccagggggaggtcggcgcgctcgccggtgcccatgccgggcaagactgaagcgtgccgaacacccgcacggcgagcgaaggcgtcatcaaggcggggtcatggcaaagaggcatgtgacggccaaaggcgtaggcgcagcaggggcccccttgtcttccccttagatctccctcccattctccttcctccctcgtcttcccatctccatctcctcccccttttgtggcgctggcagccgccgtccgcgacggcgcatcttgtgcttgagagagagaggacaggtgggtctctttttttttataaataaaatgcttaggttgagcaatacctggtttttaggtgcaggggataattcggtcgactgcgatagttccggggagtaattcgtactattttctaacttaaaatataaactctgttttaacatttgtattttgagaaaaaaatattttactctcctgaactatttcaccagagcacatgaaggcctacattttttttagctcattttatagcccggattctggaaacggttcactttcttatccctatgtttttctctctctataagtgtcatattttcaagtgaaatttttggtatgatggatacattaaaatttactgtacgtcccaatatgttttttatttttttttcacttttcacatagttaggttgaaaacacttcaaactaatgatgtcaattattatcaagtttgatagaatatatccaatccaataatttatagtacggagggaatagccaaattaaagccatatgcaagcggcaatgcaaagatcggatcgggttttttttattacttctggaagccgaaggtacgactcccgttctcaaaaaaaaattaaagaaggtacgactcttattcccttattggtaaccaatcatgcatgcatgttcctaattaaactttgcactgtgtagcagctgatgtgcacgatgctatttttagaaaccagtcgtccagggtatacactaatacatcactaaatgtatgaaaagtgtcaagtcaaaaaaaatgaaaagtgcacattatataaatagatctagaagtagagaggagaatcgtacgcttgaagaagagaatgaaggagaaaggttgcccccccacatatgttgtatctatatttcttttctttgtaaacattatataacccttctgacctatacatgtagcaaagtaattgtataatactaatatctagttatttgtacttgcttgtacggttagaggtgttatttgtccagataactcgaaggcacctctattaggacatcataaattcataatccaaaaaaaatcttaactattaaactaaaggggcattaattttgcaatcttcaatatcaaaaccagttcaaacatctctccaagataaatcatccaggttttatttgtagtctcatgcttttgatattctaacaacacgatttttactaacattgcaaatgcttttaatttttgatataccattttttctaactgggttctgtacttctgtgcaagtatataaaaattgtgaactaaaaaataacagttttcaaaaatgattgggttgccttggagtgatatttgaccgtttcttaggttagtatattctaaccagttttagtagttcaaggtaaaaaatgtgtccacgttgatcagttattagtatattactgatagttggtggacgatttgccgttgataaagattccatttgaaaatgagttccatgatgtaccatatctcctatatgtagaattttgttccctttttattatccgcacttgctatttgtcctcgcaaacaataaaatattgtccgcattgctattttttctataatgccgaaaatacttccaaacgtgtctttgtttgctccaggatagctctattaacatttatattaacatttagtaatattacgacatttgtgcccctgttttctctccatgtctgtccgactacaactagttgttgagttctctaagctctaagtgaaaaaaaaaagtctcaggagaacgggtcgctttatgaaagtaaaatgacactctatagttcttaatactagctccatccaaaattctaagtactatttcttttttcaccaagactaagaagtcattaactcattcaccatgtgacaaaaccaatgaatatgcaaccaattaataagtactaaaatagcttcttggattctcatcaataatttaatttagcacataatgactacaaataagacttagattttttggaaaacccaaagaatgaaaatagaatgaaaataggtcttaaacttttggaaggagggagtatataacattgttgactttttagaatatatttaccgttcgtcttaattatttagaaatttacgtaattatcatttattttactgtgatttaatttatcattaaagatttttaaacatactaacttataattttttgtgtttccaaattactgtgaataatacgaatgatatcaactttaaatatatcaaattttgaataagaggctatagatgaatattactgctgatagtacttacaaagatgacttgtttgatggcgagcatgtcgaccggaaactccagcccgccctccttctgtatcctcagcagcacgtccagaaggtcctcgccgtcgccgtcgtcgtcaccggtgccgcagctgccgctactcgtcctctccatgtgctcctggatgatgccgtcgaggatgccgtacacggtgtcgtggcactcctcggcctcccgcacggcgccgccgaggcggcccgcgaggcgcgacgacagccacaggtccgccgggttgaacccggccgacagctcgatggtgcgc

SEQ ID NO: 57643 - DNA, 4047 bp, Oryza sativa
gagacgacggcgagatacggcggcgtcggcgcggggatttgccctaggcagtggcggcgaaggagagaggccgagagagatcgatcggccgaaaacgtctaagtgttggtgaagaagacgagggcgcactgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtgacagttgttccatcgtgtcccatggcatcgacacgaacatcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccagatcgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctttgccttgctaagagtgtagctggctggactcaagtaatggcttcctttctcctttggttccgggtgaaggtcgtcacgttgttccatatgcttcaatcattacgtgcttccagtgtatctttcgactttccgtatacacctaggaagccaagaaggtttacgcaaaggttcttagtgaggtgcatcacgtcgattgcgtagcatacgtccaagaattcccaatatggtaactcccaaaatatagagttctttttccacatcgccgcgtgaccatcttcgctctctatatgctggcttccaggcccctttccgaacactacattaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcatcatgtttgtcctcgtcccacacggggacaccttccttcttccacaactgtttaagatcttcgaccagtggtcttaggtacacgtcgatgtcgttaacaggttgcttggggccttgaataataatcggcatcattatgtacttcctcttcatgcatagccagggggggaggttgtagatacacatagtaacgggccaagtgctatggccgctgctcatctctccaaaaggattcatgccatccgtactcaaaccaaaccgtatgtttcgtgcgtcctttccaaattctttaaattttctgtcaatgtttcgccactgcgaaccatcggcggggtgtctcagcatcccgtcctgttgacgctcttcagcgtgccatcgcaacattctagcattccccttgttcctgaacaaacgcctagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcttcttcttccatttcaacaccttgctctccgtgggatgtccaataattatagcttggaatgaaccccgactcaaacaagtggaaatgaatagtcctggatgcagaatactccttctgattcttacacttattgcatggacaacaaataaaacccctttgcctactagcttcggccactttcaaaaaatagtgcacgccgtcaataaactctttggaccgccggtcagcgtacatccattgccgatccatctacatgagttaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatgtataggggtgtgactttagtcccggttggtagcactaaccggggctaaagatcaccgggatctttagtcccggttggtgctaccaaccgggactaaagtcacaatctttagcctctgtcggcgtcccccaccggcagcccgagcacgcgtcaaaatttcctcagggaagaggggaggtcatgccacaatagctatcaatttatcttggggattacatacaaatcagaggtgcgaacaagctttgcaacttcatc

SEQ ID NO: 57644 - DNA, 26440 bp, Oryza sativa
tacaaatctgtagccagctgcagtgcggattccaagacacaatgtgtgtatgacaggtgggaccatatatattaatagtatagtaagcaaatattgtatgaattggctataaatgaattggagctagtagtgggctatgactgtacaaaagcattcattcagtaataagctcataattacgtattattttggaccctcttatacatgtgcgatcttagtattgagtgtatttatttatacactttaaatgattttagtggtggtgtctgagcctgctagaaattctacaatctaacatgtgggactataaggtgctcagagcctgctagaaattccacaatctaacatgtgggactataaggtgctcagacgtaatgtttttgctttatacattactagaaaagatgcatgtgcgttgtaacgggtgaatactattttaattttattattgttatacggtttaactaaggtgaaattcattgtgggaatttccttggatatttttttttaaaaaaatcatgagctgcaattagtcgacattcatctcaagttagcatgtgagtttttttaaagagattccttacacgatttccaaaagaaaacgaatttaaaatccgactcaaacacggaaccgtattttcaacagcgaacgaacttaaaatccgtctctaacatggattagtatttctaaaagcgaacaaacttagaaccgattctactatttttataatagtagagatagagaagagatatgcctattcaactaactatgttaagttagctataaacctgtagtaaagttgttatttttgcatttatctgttataaatatctgttgcaatgcatgtgccttcagctagtttgagtaaactttaaggggctgtttggatggaggctaactttgccacaactccatttgccatggtaagctacgcaaagtgcggccaataatttgttagccacaactatagcaaactttgactagaaaacgagagtatgacgcgtggaccaatatgctaacaaagtgtagcttgactcaaatgtagcactctaccaaacgctagctaagaacttgtggcacgcctaagatttggtttggcagactgctgccaccgaccaaacagtccctaaattactgaggacttcttttcaggaggatgcggggcgtgcgcggtggtggtgtccaagtacgacgccgccgccgacgaggtgacgtcgttctcggcgagctcgtgcctgacgctgctgggcagcctccaccactgcgcggtgaccaccagcgagggcatcggcaactccagggatggcttccaccccgtgcagcgccgcctcgccggcttccacgcctcccagtgcggcttctgcaccccgggcatgtgcgtctccatcttctccgccctcgccaacgccgacagggcggcctccgccgcgccgccgccgccgccgacgccgccggggttctccaggctcaccgccgccgacgccgagcgggccgtctccggcaacctctgccgctgcaccggctaccggcccatcctcgacgcctgcaagagcttcgccgccgacgtcgacctcgaggatctgggtctcaactccttctggaagaaaggcgagcgcgctgacatcaccaagcttccggcctactcctgtactgccgatgttgccaccttcccggagttcctcaagtccgagattaggtcatccggtggtgctccggcggtggcggtcaccggcgacggctgctggttccatcccaggagcatcgaggagttccacaggttgtttgaatgcaacctgttcgacgaaatgtccgtgaagattgtggcgtcgaacaccggctccggggtgtacaaggatcaggacctccatgacaagtacatcaacatctcgcagattcctgagctctcggccatcaacagaagcagcaatggcatcgagatcggagcagccgtgtctatctccaaagccatcgagatactacggtcagatggtggagacgcggtggtgtttcgaaagattgcttatcacctgggcaaggtggcctcaccgttcgtccggaacacggccaccataggaggcaacatcatcatggcgcagaggatgtcgttcccgtcagacatcgcaactgttcttctcgctgcaggatcaactgtcaccatccagcaggtggcttccaagaggatgtgcctcactctggaggaattcttgaagcagcctccatgtgattccaggacattgctaatcagcatctccatcccagattggtgttcatatgatggcatcacttttgagacatttcgtgcggctcctcgtccatttggcaatgctgtctcatatgtgaattctgcattcttggcaaggagttcgttggatgcagcatcaggaagccatcttattgaggatgttcgcttggcattcggcgcttttgggtctgaacatgccatcagagctagtaaggttgaggagttcttgaagggaaaattggttagtgcatctgtgatacttgaagcagtccggctgcttaaaggagttgtttcaccagcagaaggcaccacacatcctgaatacagagtcagtctagccgtcagttacctgttcaggttcctgtcttcccttgctaatggcttggatgataagcctgaaaatgctaataatgttcccaatggttcatgtactactaatggaaccaccaacggtagcgctgagtcgacggttgacagctttgatttgccaataaaatcaagacaagagatggttttctctgatgaatacaaaccagtcggaaaaccaatcaagaaagtcggggcagagctccaagcttctggtacatatatactttcctgttcctttatgtgcacaatcttttttagtttataagttttgctttaacttttcttttgaaataaagaaatttgctttaactaatttctttgaactactgtactctaaaatcttgcaacgtacctactatgtgttgagctccttggactttgatagcctgaacttctaaacttgttactcaggggaggcagtgtatgttgatgacatccctgctccaaaggattgcctctatggagcatttatctacagcacacaccctcacgctcacataaaaggtgtaaactttagatcatctttggcttcacagaaggttatcacagttatcactgcaaaggacattccgaccggtggagaaaatgttggatcctgcttcccaatgttaggagatgaagcactttttgctgatccagttgctgaattcgctggtcaaaatatcggcgttgtggtacttacgaccaaaccacctgaactttctttcgatgagacaaaactagctagtaatatgtcaaatattcagattttttttataatgcgtttgagcttaccatgtcctgatccatttctatcattcagattgcggaaacacaaaaatacgcctatatggcagcaaggcaagctgtgattgaatataatactgaaaatcttcagccaccaattctaacagtagaagacgctgtccagcataacagctacttccaagttcccccatttttacaacctaagccaattggtgacttcaaccaagccatgtctgaagccgatcacaagatcatagatggggaggtacggacatttcgttttctcttaacacgctaaagctttaattttgctattctatatattaattagaagaacaattttgattcacactggaatctactgagcaacagagttgctctgaatgaaacgaaatatatagcctcagttcatgacaattctaggagaaataccttcaccttatttgttttttgggcacatacaggtgaaacttggatcccagtactatttctacatggagacacaaacggctttagctttccctgatgaagataactgtataaccgtctactgctcagcgcaaatgcctgaggttactcaagatattgttgcaaggtgcctcggcgttccatttcataatgtccgtattatcacgagaagagttggaggaggtttcggtggaaaggcaatgaaagcaacacatgtaagaacctgactgaccatagctttgcatttgcaggaaaattatattattgaactagtggaattaatttcccgtacgtctagctagttccgttgctatagatatactgcagtgcatatgcttttgtttgaaaataaaactatatatatatatttgtaataccacaaaatgacaaacgtttgtgattgaacatgtatgtagcagtctttcacctttcaatagaaatatactagtatttcaccactaaaattcagcaattcagatctctgttttgatagcaaaacagagaatttttttccgatcttgattttgatttatatctgagtatttgaaatgaaaaacttctagatgtaagtatgaccagaagtattatgatttgacaggttgcaactgcttgcgctgtggcagcattcaagctgcggcgcccagttcgaatgtacctcgatcgcaagacggacatgataatggcgggagggcggcatccgatgaaggccaagtactccgtcgggttcaagtccgacggcaagatcacggccctgcacctcgatctcaagatcaacgccgggatatcaccggaattcagcccggcgatcccgtacgccattgtcggggccctgaagaagtacagctggggcgctctcgcgttcgacatcaaggtctgcaagacgaacgtctcgtccaagtcggccatgcgtgctccgggcgacgcgcagggctcgttcatcgccgaggccatcgtcgagcacgttgcgtccacgctctccgtggccacgaacaccatcaggaggaagaacctccatgacttggagagcctcaaggtgttcttcggggacagcgccgccggcgaggcctcgacgtcgtcgtacagcctcgtcatcatcttcgacaggctggcctcgacgccggagtaccagcggagggccgccatggtggagcaattcaacggcagcagcaggtggaagaagcgtggcatttcttgcgtgccgatcacctactcggtgacgctccggccgtctccggggaaggtctccatcttgaacgacggctccatcgccgtcgaggtcggcggcgtcgagatcgggcagggcctgtggaccaaggtgaagcagatgaccgccttcgcgctgggccagctgtgcgatgacggcggcgagggcctcctcgacaatgtccgtgtcatccaggctgacaccctgagcatgatccagggaggatggaccgccgggagcacgacctccgagaccagctgcgaggctgttcggaagtcgtgcgccgcgctcgtcgagcggctcaagcccatcaaggagaaggctggcaccctaccatggaaatcctttattgcgcaggtgaggaagaaaaaaacatccaaattttcgactccctccgttttgaagttttgagattacaagtcattttgactttggttaaaggcaaagtcaaattgctttaagtttgtagaaaaaaaagtagtaatgtagaaatcctagattgtgcaggtgaggaaagaaaaaaatttcaaaattttttagtaaactgaaagcatcagtagctaggcagatcatgttttttgaaagatcactgttgtcagtctgaagacagcattgtaaatttgttttcactttcaggcaagcatgggtagtgtaaaactgacggagcacgcgtactggacccctgacccgacgttcactagctacatgaactatgaagctgccactagtgaggtatacacactacacgaaccctgatccaaattacatcagcaggcagctctgaaaatgcaattttaatcggaaatctgcatatatatgatatgaacactgttctccaggtggaagtcgatgtgctgacaggggcaaccaccatcctgaggagcgacctcgtgtatgactgtgggcagagcctgaatcctgctgtcgacttaggccaggtcagtcagtcactcaatctttttttttagattttgttttatttagatagatgattacatcctggcctctgcatctgtgatacatacagccataaagtttgaattaaaaaaaaaacagtgctcctgctactaattggagtaccttcaaaacatcaattaattactttctccgttccaaagcataatttttttaaagaaaaatgtttctgggtaattttggaatggaggtagtgatcagatctctgcatgatgttgcaaatcattaatcaattgcaagaccaatgaaatccatgtgtaaatatatatgtataatctgaatgcaagattgttagctgaatattgttgattttggcggtctccatcgataatcaggtggaaggcgcgttcgtgcaaggtgtgggcttcttcacgaacgaggagtacgcgaccaacgccgatgggctggtcatccacgacggcacatggacgtacaagatccccaccgtagacaccatccccaagcagttcaacgtcgagctcatcaacaccgctcgccatcacagccgcgtcctctcctcaaaaggtgacaatataaatgcatcttctgctaacctcttcttcctcctcaatctttttttcgccggaacggcggaaggaagccgatcgattttattagatttaggagaaaataaaagtatatcgtagtacagggtgccactaacaacaagtgattgcaatttccaaacgaaatttcggcaatttcgcacccccacaggcaagcacatttctggcccagaattttcggttttttttttcaattttttgtgaatttggtcaaattttatttaaattcattcaaaattcgtcaaattttccaaaaaatttcggcaaaaaagtaccgaaatttcggccacccccggcaaaaaaaacaatttcgagattgctaacctgtgaacaacaaaccctatacaagctatacattcacaactttaacactgaaaaatctgaagctgttttggcgtatgtcatggcagcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctagtgctgggagaaagccgaaatggcttcgcatcttggctggaagaaaattatgcaggacctcagtccttcgcccacccagaaagacttctcatcttgagtgacacgtgtccgcacgaatcttgatgtagtcatcttctacctgagctcaagtcaagtgcagagtgccaaactttccctttctctctcctctccactctccacctcccttcctcctcctcggccagggagggaaggttccacttgctagaggcggcgagctcgccaaactttttcatcgtggcgttgtctctcctctccactccactctcatctcaccacctccttcctctctttcttcctagccaatttttggccggatgaacagcaacagcggcgagttcgtccaatcgatggtcacagactagcaaccttaccagcctcccaagctaagagcacaagtactgggtgccgagttgccgactagacatgctacattgctgctcttgcatcatgttgcatcccgtgccggagattgggcctctggctgtgcagaaaggagccaggggaggtagggactgggaagtggaaagggagaggagagagggattggggaatttttcggcactttggtctgaggtagaagatgactgttctctgctctaagattcgtgcgaacaagtgtcactcaagatgagaagtctttccaaatgggcgaaggacccaggtcctgtataaacaccaacaataatggggctgctgacttgtatgttgatgagttttttttttatgtatgttgattactggaaatgatgtttaactatttattttattttaaaatatcatgcagttatatttattttgctgtaacttatatttttatatctttactaaatttttaataaaatgtatggtcaaatgttatatcaaaagttaaggcgttagatattttaagttgaagagagtatgtttagaagagaaaaggtttttacttttgcaaggtaaacctgtatatgtatggagatgagcaattctacagttcttaaggaagtaccatgagatactaaaaatttaatgtaaaatttggtacctcatggtaccttatagtatctaggtaccaagaggtaccaaatttataatagaaaaaatggtatctcatggtacctcctcaagtaccataaaattgctcgtatggagataatatatggacagtaatgttcttatggctcgtgcaaaaaagagcgaaaaatatgccattatttctctacatgggattgggcgattggccggacttgaaccggaccgaaccagactgagctctgggtcatctgtggccgatgcttgccatacggttggtttactggtcaaggcaccacatgtaattgtatactaaagtactctctctaatcaagatagaactctagacccatactctctaaaccatagatgtctagtttaatgcacacaacgagcgaccaaatgatcgatccaagaaatattcctaaataaagattgatagtaaagcataaagatataaaaggatatatatatatataaatattggaaatataaagcatatatattaaccaaaatatccgactcagaaaagatataaaagtttttaccaaacttccagaggcactcctctgaacttttgtcggttctcgtacttgacttgactcccgatcaaactcctactcctctacgaagtagagttggctattcctaatactctagcaactacagtgaacaaagtggagcttctactctgagttagagtagtggtgtgctcggccttgaagtgattgggggagggaaagtttggtctgccggccagtgacctccgctgggtcggttggcctttccaatatctgagatcatgtcctaaagtcggtgttacaacttgtattccccactaacatcggttggaccaacggtcgtggaaggggccaactaaccggcctaagagagtggtatgtcagatgtgtactaaatcaaaaggagtgtgtaacctagaaattacccctctgaattatcgtggtcgactgaattacccctctgaacccgaaaaccatacgtcgcttaccctaaacttttaataccggacgattcactcccctcaacccaatccaaatcagttttgtcccacatggcatacgcgtggcaatccagtcagcattttatttttaaaaatggtgggacccacgtgtcataacccctcttcctctcatcctctcttccacattgtcagtgggcggcagcgtgcatagcgcgacgtggggaaggacaatgggcagtagtgcgcgggacgggctggccatcggcgcgcatggcagcgtgcatggaggtggaggggatgggggagggcaagcggaggtggatggggaaggcagtgggcacgcggtggcgctcgtggacgggcaggaggtcgtgcgcggtaaggtggagaggatgggggagggcggaggtcgatggggaaggggaggagatggaggtggaaggggaggggcggtgggcggcagtgcccgtggataggtgggcgggcgacgcggacggcggcacgccgggatgtggaggggatgggggagggagagggggagtggaggtggatggagaagggaagagatggaagtggaaggggatgtcggcgcacggcggcggccgtggcgggcgaggcaggggcatggccgcctgtccccgcgctgaccgcccccgtgcgctgctgcctgtccattgctcgttctagcgttgccgtgcacgccttttgcccaactgcccgagagagagatagagagagagagagaggggagggggagggaggaagaggggaagaggaggtacaggaccatgctgacgcccggtcggcctccatctccgttgccgaccgcccgatccgcctccaccgccggccaccaagctcctctccccatctctctcatccttctctcctcacggtgtggagaggccctcccttcgccggcggcaaggtgctggacgccgccgcctccagcatcctcctcagcgccgtcccgcgatgacgccggccgcccgagttctctccgcctccgcctccaccacccgccacctgagttctctctgcccccaccgttggtcgcccgagctctgcttccgctgccagccacccgagcgagcgagaaagagagagagagagagcagagggattgggtaggggagaggaatgacaggtgtgtccaagagtttttttaattctttttgttgactgaattgccacgttggtgccacgtgtgcaagctcaagtcgaaaacagctcaaaacagtgcttaggagggttatttgcccgatttgtacagtttgggggggggtggtgaaggatgcctggttttacggtttaaggtgggtaattcaatcgaccgtgatagttcggagggtaattcgtactttttctgtggaacctaggtgtgagctagagagaggcaagaggagtgggacccacttgttagagagagcatcacatcgaacctattctacattgtagagagaatacagctaacagttaatttacattttctttaaagtgaaaatcacctgatataaaatgttttggaccttcggcatcacatagagttgtacattgatctactggagattacatgcagcaaagagccggggcctttcttcaccgccacaccagtgacagcatggtgaggccatcttggccatcttggccgcgtgagtgttctgtgcgcgatctggttccaattttccttttttgggtcagtttagtgcatctgtccttttttcctgttttgggtgattcttggtggggtcacaattaacattcttgccccatgtgcatatgatacattattgagccaaggttgccaatttttggtccatgagacgtgtgatttgtttttctgttctgacaaaatcagtctaatttttcatgggcttggcccaattatcatacgggcctcacatccaacacatattgttttgtgttttgttttccttaattttattttaattcgtttcaaatgtatagaaaaaatttatatgtataaagtttctagtttatacatataaagtttatatgtataaattttcatgcatttaaagttctatgtatttttttcccaggttaatatgttaaatttatttcaatttatgcaacacgttaaattcgttccaaattgatacgtagaaagtttccatagttgttaaaaaaagggggcttgatggatcaggtcgaatcgagccgctccccatcacccttatacctccatcgatccatacaacaacaacatataatcaagattttcacgcaacaaaaatcacaaaaatgtcaaccggatatccatcaacattttcacatcatagaatcaagcattcatgaaaaaccaacttccctcatcccttctttatgaagttttggcaatctgttgctggcatctctggagtaggcgaaatgacttgatctttaatggtattcaagcaaactttggcaaatggaaggctgattttaaggatgagtttactctgcatacgcatagagtaaaggagacatacacatagagtaaaggagacaggaaaaccattgtagcaatcatggatttttttttgcggggcaatcatggattaataacatatactccctctgttttacaatataagtcattctagcattttccatattcatagtgatgttaatgaatctagacatatacatctatctagattcattaatatcaatatgaatgtggaaaatgttagaatgacttacattgtgaaacggaggaagtattaactagcttgcctttcagtcagtcttttcttctttctttcccttctattatattccccctgtacagtttcccttgtatattgcccttttattttaatatatttgtgtagtaggagcctctcctgctgttttaacagttaaaaaggatgtgtagtcgctcactgcagaggagaacttcgcttgctgccatcgctcactgggacatggaggttgcctctgctactgccccatgcgcgagagccatcgctgtcgtgggatccaccgccaccggatccacccgatccacccgtaggggtcgctgttggtgcattaggtggatccaagcgcgggagccactgccatggcatcctgtggatccgcccatagccactaccaacagattcacctgtgggagccaccatcgtcgcagccggcaaagctgcctataggagctgccaccgtcgaggaggaggattccatgatgccgtagcggcggagaggggttacgttggtggtggtggagagagagagaggagatggagggggtgggagagaggagagagggcaatgaagataaggatgagtggagagagaatataaacgttgcacacgtgggacgagggagatgctcgagctcagaggtttatttcttccaccccgcttagctcagctctatcttctcgacatgtgtcggtttaataaaaaccggcaccatgtaggtgctggtcaaattgagaaaacatgcaccagaaatatatgtgctactatttttttaataaattgacacttataaagtgttatatatgtggttttttaatttcggagtctctaaagggttaggaggatggggaaaagctcatttgtgccggttttagattaatcaacacctataggtgttctctattacgttttctatagtagtgttaatatgtctttaataaatatgtaaaacaatcgtcttttgatgtagtagtgttaatatgtatttaataaatatgtaaagcaaccgtctttgcaggacgaagagaaaataaatagggcatataaacagcgaagacagaccaaggcaaaagaaagtggggcctatccagccgcctatacctacctttaagagagaggaacgggttgaggaagaaacatatgataacattgaagtcactactaattacttatatatacaaaaatatatagaataaatacagctagcacttgatttatatatttttttttaaaaaaaggagaatcacttgatatacagcgtatgaaacctgtctcgctgcacagttgtacactctcctggagaatgcatgcagcagcaagatagctagggtcgctttccctatcttcagagatggatttttggacatcctctttgtttattagtacccgtctgaaaaaaaaaaaatccaatcctacgtactaacctagaaatatttgtgtgtccagatttattgctaagattaaattttttttacagagtagtacgtcccacctaaataatcaacaaaatattattttaaaaaattaagaaaaatagattaatataaaaatatcacatcacgaatataaaaatttaaattcgacataaaaacaacgaatgtaaatgtgaattgagattttagtttaatttattctttttgctatggtttataggagttgtatttgcccctgcatgtttgtaaagtaatcactactggtgaaacccttatctctccctttatatatttatcttatattagtctatcttatctttttataaattttctaataactattaatgtgatatggaagaaattaatggtgtccaaaaatgcatctctgaagataggggatacagctaggacaggtgtacactctcctggagaaagcaagcagaaagggtcgatcgctttcacaccacgcggctataaatatcactctatctgcagactgcagcaggcaacaacaaagcatcatcactgtcgctgtcatcaatcattgtcacttactacttttgtcttcgtctccaccaaagtctcctccctttcctcccccctctcgatttcttcctctcccaaatcgatttccaagccctagcactacactcactcacctaccccgagacatggctgagttgccgccggtgcagatcgtcgcagccaaggacgacgtcccgccgccgtacctgaccgacaacgtcgtccacaacctgctgctctgcctggcgccggagccggcatacctcgccgtggcgacggccgtgtccaccaagtggcggagcgtcgtccacagcgaggcctgcttcggccgccgcttccgcctggactacgacgggccgacgccgctgctcggcttcttctccaacaacgccgcggggccgttcttcaccgccaccggcgccggcgtggtgggcctggcgccgccggaggaggccgtctcggccggcgacggcagcgtgcagcacatctacgacgcgcgccacggccgcgtcctgatggacggccgggaggacaaggagctcctcgtctgggaccctctgtcccgccgcaaggacttcatccccatgccgcccggctacttcgtcggagagggctacggcggcggcgcgttgatctgcgaagccgaccacggcgccggcgacgactgccatgccgcgccgtaccgcgtcgtattcgtgtactgcggctcggatcggccccccaccaccatggctagcgtgtacagctccaggaccaacacctggggccccgtggccaccatggatgctcgcgtcactttcgagctcaagcaacccgctgtgctcgactataccgtctactggttggtaaatgggaggacccaaatcattgagttcgagttcgataccaacagcctagcactattcagaacaccggtggatctcccggacatcgtcgtcttccccatggaagacgggcggctaggctacactggtatgatgggcccaatcgtcagggttttcgccatcgaagatatctatgaagacggtgatgccacctggacaaaagttactactcttcatctagatgctatgcggccaagccagtcatatcagcaagttcttgattcggacacagactctgactccgatgatgaggaggaggttgtattattgttggcacatcagtttggtcccaaggcgaagaaggatagcaaaatcattccctcgcacccgccaactattaagagtgataacgacgaatataaccatgtcgtgatcaggccaagagttatcgggttcatagaggatcctaactcaatcttagttcgaaatgagctaggtgtattcatggttgatattgaatcaaacgaatacgagcagttatctcagaggatctacttcaccactgtctacccttacgagagcttctacaccacaggtataaatctgtcatatctattttctttaacaaaacaacaatattttagttttgcctaccgtttaattaaattacttataaacacatttaggaaaaaaagtccttcttattagaaaaaatcagtgttagtatacagatttatcttccacactgcggtttcttagcatttgggtttgctgtaaacttagtgcaacaataatatagctagctagctaggggcaaacattttgaaaaaaaagtttaagtctctatattatagggttagactcctaaaaatgtttcttttggataaagtaaatgcaaaatagtgtttttgctcgggcagcaagtgcaaatttatagagtgtattgcattattatactaaaaaatggctacccatctaattattttccatagaattctgttcatgagtattgccctcttcatgttgcccatattcttcatatgatgattagactatctcattaagtgtatagtgctccgtttattttgttttgttgaataaatttgcttgttctaattatttgaggtatggtgcagcatatgatatattattgatctgatctgtgttcaccaaattttgcatagtctttctgcatatatagttgctacagtaggacttcacaaactgcatatgtgtttcaatgcaaaggtacattagattttcctaaatataatacataattatttaaacaatttgttagctagtcatcaattccattttcctctgtgcattttatggttggccacatcagattatacatacaattaagttcatcaactaatgtatatttctattacaacgtcttaagttgagctgataagcaagacggaatataccttcgaactgaactgccaagtgcatcttgaaaattattcaaacacaaatttagtttattcaatagctttgttactcaagtgataactacgatagaatttgtgctctaatagtattctgaattcaacaaactgcagataattgatctgagttaattattattcaattctagaatagtatatattacaattgtatgagtaattaaagattgtgcatatatagttgtaacttgcaatatgcatgataaattagctgttcttttatacccttttgcatcttctaattatcatatatatttaaaatatgttgacatggaattttgttcatttacgatcatgtgcttatctacatctgaatatgatattgacaatgtatacatttcctgtactgagatatgttcatatcagaatcacatctaatgaccggcattttcctaaaaaacagttgcatttttcacagcccaacatatctttcttgtcaattgcatagatcttatatattcgatgttgttacgtacatacagttggcaaagcaaatttcaatgatccggtgctgattgatcatgagaacaacgatgaacaaggtttacaacagcttgaacccctcaatgatacaatacttccagatcaggagaacattggtaaagaagtttacgacttaaatccattataatttataagtaaacagtaagcttatatggcttaaacagtaaagttttgcctgttcttgttttcccacaggtggagggattagtgcttcaggtgatggagacgagcagtaaacaggtctttctgttacctcatcagttcaagtggtatgaattattgtttgctcacctgctatatagacattattctcttttttgatccaaattaagttttcatttatagatagctagttagcagtttttttttagataatggattatatcaaacccggcctctacaccttgtgagggtgtacacagccaaaaagctacaccttgtgagggcgtacacagccaaaaagctatagttagcagtttaaaaagaccgtatgttcttatgtatagtttctgaaactttgctatgtcatttatatatctacacatttgttctttgtagacgtactagcatacaactccattttctgaggatcttgcagttgtgctagcaagatttctacacattttcttatgttcattttactagagcgagagtagcaaaaaaaatatggatatatgcagacataatagttagcgctaggttcaaatgttacaaatcttgcaagagctggcagatagacttgaatttagtctgacgatgctttttttatgttgacctgctcattcttatattcttcaattcttttactttatttaattagttaccagttccccaattgaagatagacttaagaagtttctggcaaagaaatgacgttttcattagcgacaaaatatcatttcgctatgtcatatttttgtaaaaatatttacatcaagttatagattgagaaattatttttctggaacaacagtaaatgtgtggactttgggatcagtttatataattgataattgatgacaattatatatcttattaattattatacacaggcatcaagattgggcgtacattgaagatttcttggtcggcagctagctactataataatcaggctatcgcacattcagtcagattctcagatgtgctgtaaacttgttaatttaattaataaacccatgtcatgtgtttgttgtttacctgcattaattttcgtatgtgtacttgcccctgcaacaactggtgctgcgccgttcaaatcttcagctagtataagtttagacgacagcagggatatatgtgaaatcaatgttttgattcatgtttttgcgatgaaaaataattggcatgatcagttgattgtactggttttaatgatttgatgatttatccgcgaaatgtaaatttgctatctggatgggtctggaccggccgtggttggtcacaccggacaatatttgactgtgaatagggttatcgatttggatcaatccggtcagaccggacaatatttgtgtgttggggtattttgtctcttgacgaggccacattggagaaccatctttggtcggtcgaccaaattccacaatagtcctggttccattaaaaaccggaactaaaaacgatttttagtcctggttaaaaaatttgaaccaacccgggactaaagatgatttttagtcccggttcatcccctgtcagatgtatgtcagggggccgagaatctttagtcccggttaatactaccaaccaggactaaagattaccactttagtaaagatcaatttgatctttagtcccggttggtaagtattaaccaggactaaagattaccactttagtaaagatcaatttgatctttagttcaccaaccgggactaaagatggatctttagttccggttagagttatcaaccgagagtaaatatttctctcccacatctgatcggttaagtcccagacagatatttagataagattggatcatcccctctcttcctcttctcagatccaatccccttcctcctccccttcctcttctcctcctcccctctcgtccctcccatcagccggcccttcctcctcctcccctctactccctcttccattagccggccggcggcgggcggcggcggcgcggccgtgcggggtaggatggcggtggcggcacggccgcgcgcggggaggcggcggcggggaggcgggcggcgggcggctcggctgcgcgcgtggaggcgggcaggcgggcgggcaggcggccggcgggtggcggcggcgagcagcggccggctcgtgtcatgccccgaattagtaccgaccggaactagcccgcgacgcttcaaattaacctgttgatcgataccagtcccaggaaacagtgctggtatcacagggagacagaatatcacagcaacagccgtctctttattatagagtaggagtacagtcatgttgggctgcggacagatcccgagctcacaactgcattacaaaagggaaacagaagcaggacttggaccaaacaacacaggcgtgacttgggaactaggccgaaaccctaaaactcatcgtagccggcttgctcctagaagaactcctcatcagcaggatccgcttcatcttcttcagcaactgggggggggggattatttatatagagcaagggtgagtacgggagtactcagcaagccatgggaaataagtgtttaatgcaggcttcaaggaaaggctgttgtttttgcaattgattttagttgaactcttttctaaaaacaactaagtgagtgcttctcaaacgacacggatgagacagtacgtctcgtccggtcggagtatgtgcaatgtatcagtctttaaaatttaaaacaaggttggcacccggtcaacagcttttcaaacggccacccgggcctacaactttcaaacggccacccgggcctagctgatcccatcagctgcagatttttcaaacattgaacccctttccacaacagcaatttcacaagcagtagtcaaacaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgatacaggtttaccatatgccgacaagaggggtcccagaccaggttaggtcccagaccatactgtgccaggaagcccaggggtcctccccgacaccaccccggcgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccgtacacccggtacgttccccggtccgcggttttggaaattcatttagttcgcaagcgccgactcaggtgtcgggttttccaagtcttttgtaaaactccagttttacccaagttgttactcagattttaagtttgaaggtgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcaatgcataatattttgcaagcaacataattaaatttcaaatataggctcaagatgttcaaaggtggcttgccttgctcgagatctagagcttgatcctcgaaatcctcgcactgcgggtcttcgggctctgaaactacacgcgaaacggggcaactcaacaaacggcgaaaataaagccctattaatgacctctaagcgtgccattagatagatctcgagatttgaggaattttggaagttgaacggagtcaaacggatttatggttgggaagatattgaatttctaagattattggatttttggtctaaaggaaaaggatttaattaaatcctttttggaaaagaaaagaaaagaaaagaaaagaaaagagggatggaaattagacttttcctcgggcggctagggcgcggcccgagagagatggggcggtccggccgagctaaatgggccggccggcccaagacagcccaagcgcgcgcgcgggggaggggaggagagagtgggccggtggaccgggctcactgtgcgcggtcccgggtgggacccgcttgtcagcggctcagctcaccgtgcggagggagcacgcggcgcacgcgcgcgggcgggggagggacgcggtgcacgcgcgcggtctgcggaggaacggatgcggcgggcccacgcgcagcctcacggctcgcggtggaacgcgcgcatgggaggggctgaccggggtcggcccgtcccgacctcggctgagctggcgccgacgtggcgcctacgtggctgccacgtgggctggcgggaggtagacgacgacgccggccagaacggacggcggacaacagcggcgagcggcggagcggaccacggcgataccggcgaaaacgagcacaccgggtggttgcacgagacgaggggagacgagccaactgctcggattcgccggaggaagcttgacggcggcgaatcgcggcggcggcaaccggcggggagggaagagggaaatggcgacgaggtcacgaggggccgattcccggcggtgagagcacctacgcggccacgggaatccgatgctagcgtcggattgtgcggagctacgccgagcgaggctggcgacgagcgggtgctacggagctcgagcggcgacggcggcgagcacacggcgggcgacggcaacggtcggggcggcgccggctagctacggggaggctactcgtgctaccaccgaaaactaagggggggagatggagcgaggaggaagaacggagggaggcatcaccgaggtgaggaggggcgctgtgacgagaggccgacgatgcgggagtaatctctccggcctcgggccggggaagaggaatgagagggcgcggccgaagtccccttccgcgtccttgctcgtgccggctcctccgacacgcgcaacgacgaacggcgacggcgaaacagaggggcggcaatggcgcggaggtgaatgggagaggaaaggaaaaaggggggggggagctcgggtttataggatggcaatgtcggtttgggaaccgacttagggcggtcaaaggagagggctagcgctcggcggtcgtggccaaagcggcgacagggaggagggaggaggatgacgccggcgggagggaaaaaggggaaaagagggagagaaaagggggcttgtccccttgcctcttcgggaaaaggaggagggagcgggggcgtctcggcagagggaggagggaggctctgcctccgtcccttggaggctagcgcgggagtggcggggccgaggcgatgacgacggcgatgacggcggggcggtttggagcggcgcgacgtcacgggcgacaggcgcgggctggcgcggcagagggtgacggcggcggcgaccaggcggtcggccactcggcacgcgcgcgcgggaaacaacgggcggcgcggctgggcacgcgcgctggctcgcggggccgagcggctgcaggcgcggcagagcagcggggccgggcgacgcggacggcgcagacgacgcggctcgggcggggaaccacgcgggcgcgcgcgcgaacgacggcgtgcgggggccgtcttcgcgagcggggagctcgccagggagaggagaaggagagcgaggggaaggggcgctcggcgcggtgcttgcgcacgcgcgggcagagcgaggggaaagggagggggcgctcggcgcggcgctcgcgcacacgcgcgcgcggcgcgcgggcggggcggagcggagcggagggagagggggagagggagcgcgccgggggaggggagggggctagagagagagagagagagagagagggagagcgggagcgcgccgggggagaggagagggccgggggagaggggaagatgggccgagagaaattcggcccatcgaccccgggggaggcaaaatagacttttgcggaggaattgatttgggaagggtttggattcgggattgaactcgacgatagatcggggatttgagatctgagatggcacggacactagacaacaagcaaataaacaaatttcgcaattagggtttttagagataattttcccgctaggcgccacgacggaacgggcgctacagctcgtttgcttttttttttataatttgtgtttcactggatgtatattttttttagattttgtgattcattgcatcgcatggatttgagatgtataatcttgagatgtataatcttgtataatctatgatgtatttaatttatgtgtagtttttttaggatttgtgatgtatttgatctgtgtgtaggatttgtgatgtatttgatgcgtgtataagtaacttaatatttaggatgctgatttagggatgtgcatcccactcgatttgggagaaaatataaggattaactctagccattagcaaatcaacaatgaaaaaacaatgaaaaaaaagggcctcgagggactgccgctaccctattgggactaaagattccccctctttactctcggttggtgttaccaacccggactaaagatcgatctttagtcccggattcgtagtcccggttgaaaaaccgggactacaaagggttctgaactgggagtaaagagcatttctccaccagtgccagccggtctctggacaaagtattgatgtatatatcgtttatatatcgtagtaaagaactaaatgttcatgaagatatatatgtagtttctaaaaactatgctatgtcagtttatatatttcaaatttgtaatttgcagttgtgctagcataaaactccattttcagtgactagagggagagagtagtaaaaactctggatgcagacataaatacataataattagcccaagttcaaatgtaagaaatcttgcaagagctggcaaatagacctgaatataacttggtttgacgatgcagtttaatatattgtcttgtgccttgatcgtttttgttaatcaaaataaaccgagttgatgatagttatttatcttagttcacaggcatcaaagattgagagcaacttgaggatttttccgcgtggctagctagctactcatcaggctatctgattgaattaatcaaaataaattgatcaatcttccttgatctgtcctgcacgtcaggcagatgtgtttatatacactcgtttcgtatgtttggtgttgcactactagaaaaagtatttttacaggcggccaaaagtgattttcccaggcagggggaggactgcctgcagcccacaatcggggcagtggcccgcctacaaaaatccattgaacgagcaaaaaaaaaaaaattgcgggtgcgccttgccgccgccgcccacccctggcccgatctaggcggggaggggaggggagccgccaccccgcgccgtcttcgccgccgccgccgcagccgcagccgagccatcgtcgttgccgccccgcaccccaccgcccttcccaggcctccctctggccggatctgggaggggaggggaggggagtcgccgcgccgcaccgggagccgcatcgtcatcgccgtccacgccgccgccgccggtagaggttggggaggggagggggacggcccggccggtggaaagtgttgagggagagagagagagagagttgagtgagggaaatgagtggtggggagggggtggagaagataagacttagatctttttggggtagatacgattttcgcaggcgcggcttaagtggtccgcctacgaaaatgattttcacaggcgtcgcttaagtggttcgcaggcggacagcgaacttcaacctgatttatatttttgtaggcggtcaattggcttcaagggtcatgtccgcctgtgaaaatcagacctccacgtcgagaaaaatgtatttttctagtagtgttattcacctgcattttcgtatgtatgtacttagacgtttgaatttgatcagcttgtggcatacagttgaaaactgtttaactctgtaatagctcttttttaaggtttaaaagccggactctacatccaaacaaaccggatgtacgtaccaacacctctgcaataactatgatcattgataagctgctgaacagtttaaataatcttcagtatttatgtaagtttagtcgaaagcagggatagttggttcaagatcagacaaattaagttttagcttagcttatcacttaacggcgctaattaagcatcaaattaattaaatcaatctttgttccggctgtgtcttgttcccaactcgatgaatcaatttcataccgtaattgagagtgaaactaaaatcatctcagtcaaattttggcagagattaaaaatttctagaatgctcttctcacatgtaatgtaagacagtaagagcagtacgttgagaacttgagattgagatatagatagatagaaacgatgctgcgtcatcgcatgccatggcgcttgcaaccgcttgtcgtcgtcatcctcggccaggccgattgactgctagtgctttcggcgtcagaccgcgtgtcgtcctccctcgcgcacgcacgcaccttgccatggcgtcacggcatctctcaccttcttcctcggttcctcctctttatatctatcgatcagtgccgatcacttcacctaactcgatcgcttaatttccagcaaccaggaaccagcactcgtcggagttcttcgttctgacctgagcaagcccctgatcaccatggccgagagtgttgtctctgtcgatgctgtcgacggcgagcaggagcagcagcagcggctgcagcaggaggagttgcagctggctgacctgcccaacgacgccttgcggagcatcctgctccgccttccgtcggagccggggtacttggctgtcgccgccgccgtcaccaagaactggcgccggcaggtcctcggcagcaacggcagcttcctccgcgccttccgcgcggcgcacggcggagtgcctcccctccttggcttcttctgcaacaggagaaatctgccctgtccgttcttcaccagcacggtggatgccggcgtggtggatctgtccccaccggccgggaaacagcggccgttcatccacgacgtgcgccatggccgcgtgctactcgacgacggggaggacggccagctcctggtctgggaccctctcgcccgccgccgggatatcatccccacgcccagatgctacttcaccaacgatgacagctgcggcgctgccataatctgcggctgcgatggcctggaacacgtcgtcggcgccagcgtcggtggtggtgactgccatttggcgccgtaccgtgtcatcgttgcattcaatgaccggcccaactatcgttcggacgagtggaaccatgaatgcatctgcactagagtctggatctcggagaccaaagagtggagtgaggtatactccatgagaggaagttgcgactttgatttcatgccgagcgccctcgtcgccggtgccatccactggctggtgggggacaccaatagtgttcttcagttcaatctcattaccaaaaag

SEQ ID NO: 57645 - DNA, 1820 bp, Oryza sativa
aaaattttgttttggtgggttgtataaattgtgtgtaaaattttggtacctcgaggtactttctcaatagctagcacatcccgttcttaatagaacgatggcagctcaagcataaggagatggatagaaggaaaggacccaaattagagagaaaccggatggtcgcggtgatgatggtgcatggataccgcggaagcaacggtccgctggcggtaggggcgcaaccaaggcgggcaagtgggattttgcctacttatcccacttttagttcattttttatcctaaaatttatactactatgtggcggatatgggatcgggttcgggaacgtagtatccgacggatatggattatccggtaaaaaattcaagtattacccggataaatatacggatattactcgtattatgtttttgtgaggcactttttctattatgtattggttttactatgatgtattgtgccctatttatttcctaaggtcctaatggcctaatataatcgtataatgtatatatggaattgttaaatggttattgtctatgtgacatataagattgttgctccgacttgatatccgataatattcgtaaccgatagtatatgtatctattttggtacgtatttgttccgtatttttgcctgacattatcgagtttgtatccgtatttgcactatccgtgtccgacccgattctgattataaaatgtgggttaggatatgggaagggtgagatctgaccgaacctgacccgttttcacccctacttatggctcgattactttctctcctctggtcctccctagcttctgacctcatttggatacggtcaagtaaggttatcatatcgtgtaaaaaaaagtaaggttatcgcgtcttcggattggactacaaatcctttagtgtcattctttacctatatacttattcatatttgggtatatcttatgatagatattacttttgactagaaaaaaatacccgtacgttgcgacgagtgaatgctattttaatcatattattgttaaattgttttctaaaaagtacatcctccatttcaaatatgatgccattgactttttcacaacatttgaccattcatcttattaaaaaatttgtataaatattatttattttgttatgacttcttatatcatcaaataaaatataatcttaacatatacttttacatatttatattatttttttgaataagatgaatggtcaaacgttgtgggaaaagacaacagcgttatacaatttgatagttttgatatctagtttgaaacttttattggggtgatggtcatatcttgtacgttgctttcttatgacttggcaagagttctgaagaaattaggagtctgattcttctcgtaagttaacgtgcgagttttttaaaaagatttcttatatcattccttatgtatttctaaaagcaaacgaacttgaaaactgactcaaatacggatgacgtaccaaaatatcgacgggaacatcttcaatttttatgtttgatgtagataaattaaaatcgggaagagtgctactaatggtgttttttttcttctttttttgattaatgtggtataataattcctagtctctggagtgaacatgttagtttttagctatatttggaacaaaatttgaaatccaaaagtttgttatattttagcatgagggagtttttttaattgcgatctaaaataaataacacgctcaaatatttttttagttaaatagagagaactttttggcagcaactgaaaaattactcctcgcaatatgtatgtatgcatgtatatgtgttgatacct

SEQ ID NO: 57646 - DNA, 1563 bp, Oryza sativa
ataatttaaacatgtatatataataacaaatgtaaagttaaattgcaatatcttccatgcacgaaatgccaacgcatctgtgagtacaacatactaaaaaagcacaatatggaattgtaagaacacatagagatttgcaatgaacaaggggtatgatcgtgaacaatttttctttgaaaaaaagcatgacggttatgaaataatagtttccatcccaaataaatttgaatttaaacaattatttccatctaaaatgaataaaactgaatatttattttgaaatcacatgattcaccaaaataataattcccattgtggacaatcttgaatgtgtccttaccatttactgttaaagccgagccgattgggggcaatgcttgcccaaaagaacacaaataaagaaccaattgcaacaaactcagcaaataaatcagtggcacctgaaccatccaaacctgaaaaaaaataacccaagactagtaaataaataccactaataaatcctcaatgtaaattataaagcctgaaatctagaactccaacaaactagcaaaaacatggtatcccattattaatttgagcatatcttttaaaccaccaaacttagcaaatcaattaagtaaatcgcagcatctacagaattatcaacaatttccatggtttgcttctctgttttttccgacacggtcatcagcagtgttttgatgatatgtcaaccacttattcgagttaattggaaaaaataccaaaagaaagatattgaaatatgacagctataacttttctttttaagctacaaaacatgattaccggtgcagagtgctagatccaatcaccccaactcccggaaccaatggattgagcctcctcaggccaccacttccctccatgcgttgcaccttctcctccagatcttgcaggcagagttgacggtaatggcaaggtggccatgatgacggcactatgctagcgtcacttccatgtctatgctcgtccttggccttgttctgctgacatccatggtcacctttctccgtctccacctcatgccgatctggtaggtagtagctagtgcacgccattggcaattgacttggagtgattggatctagtctcaccctggaggtggtggagcctgcatggatggtgaaaatgatgacgaaaagaccggtaaggcggtccggctaccgacaacggtgacaaaacgtgatgacaagggggtggcagacacaagatatagtgacgatgcagttacatcaatgacagtgcatgatcagcctagcgcgtcggatggggttaatgatcgcttgttctttagaataataaatgattgtggcaacaaagtttggaaatgaaagcaaataacattgaaaattattgatatgttactatatataacactatgttgatcgtcctaacacactcaaattaaggactcgtagcaaaactaattaaaggcaactgctttacagtacacaaaagttacgcatatagtaaaagaatacaattaattaaagcagtacaagacattccgtaggttctatttttccaaagacacagaaa

SEQ ID NO: 57647 - DNA, 5395 bp, Oryza sativa
tcggtgtacgtgccgccgcggctgtcctcccgaatgtgccacctcgccaacctcgacggctcgctgtgcgccgtgttcgacaaccgcgtcgaaggcgacgtctacgggctgttcacgtgcagcgagccctcggcgtcgccgtcgccgtcgtggtcggtgcgttgctccatctacctgaataggctgccgcgagaggtgagcgacgagctgatggaggagcgcgtgatcgtgccgctctgcaccgccggaggcaagatcctgctcgccacggggcaccacaaggtgttcgcctacgacgccgagcggaacaccgtggagcgcgtgttccgcatgcaggagttcgtcgatctacggcatgactacatcaaggcccccctgctgatcaacattggtctccacgacgaatgcatcgccgacgttcacaatggcgacggcggcggcgagaggatgctgcgtgtgaacatgggacgccgcgacaacatggtggtgaagcaagaggtggccgtcgagtaccacgacgctagcaatcgtcaattcaacgtccttttgaaggatttaaagaggatagctgcctgcttccgccgcacatgaacatggtttttgaaaatcaaataccacatccatttcatattataagtcgtttgactttaactttctctagtcaaaatttgttcagtttaaccaaatttataaaaaaaattagcaatatctagaatatcaaatcaattttattaaatttactattaaatatattttgataatgtgtttgttttgtactgaaaatagtattatgttttcctataaatttgatcaaatttaaagaaaattgagggagggagtaacactttatacccgatttcaattttatggtagaacgtgacattatggtagatatcctcacccccggtggtggggttttagttattatgattttatgtgttgcgggagtgaataaaactgaaagcatataataactaaagatacataaagtggactttccccctcattgctatctttccccaactcaaccttcgacgcggttgtcgaacacggcgcaaagcgagccgtcgaggttggtgaggtggcgcatgcgggacgacagccgcggcggcatgtacaccgacccgaactgctcggcgccgacggagaacgacaggatccgccggatctgccagtcgccgggggcggctggctggagcagccagtagaggtagccgttgacgaacaccggtggcaagccggggaggaagttggccgcggacgccggcactcggccggtgcaggggcgccacccgccgggctttcccagggtatacacctagcagacgtgctccccgttgcgtttcttgaagagcctgaccaccttgtgctcgccggtcgccgcgtcgaagccaagcccggtggtcgagagctcgaaggggtcccatggcgacatcgacgggagataactcgtgatgccgccgggtaataccctggctattggttccgagtgtagctccgcggccggctggcacggcggcagcgtgacgtgatcgccggtggacaggttgaggaggtgataccgcggctcgcggccgtcggagacgagggtgaggcccctgcacggcctgggcgacgtgacggcgtgcttggcgctgaagcagtcgatggtgaggagctcgcgggcggcggccggcgcctcgccgccgcggagcgagcaggcgtagaaggtggtggtgctgctggttctgcggggttccggcggcgcgaagaagagaagctccgggtggcggcgcgcggcggcggccctggcgcggtgggcgaggatgaagtagtcggaggtgagggcggcgttccagtcgcgggagacggcgcggagtcggacggcggcggcgatggggaggcgcgtgaggatctcgtcgacgaggaggtggtcgggagagctcgagctcgggctcggtggcgagcggcgtagcctcttggcgtctggcggagaagagtcgttagacgccatgtgtgattagtttttgattaatgcgtgtcacacgtgcaccatcatcaagcagataatgcatatatgtatagagagagagagagagagatcgcgcggggttaatctaattaagctgacaatgaaagcggcgaccttgtaggattcggaattgtcctcatacagatcggccattgcgttgctttggatgcgacgacgacgacttgggtggcgggcctggcggcggcgtcagatgcggaacgtttcgggacggcgggggccgtgtgaaagcccatgcggcccatctctctctgcctcccgcggcccgagcaccccatggcccatgaacaagtagaaggcctacgaataatagatgaacttattcctaatagagtgggaccacctatacatttgttgacaaattttctcctaaaaattgataaatgtaattataatacaatcgtagtgtaattacactgtaacttgtatggaatgacactgtagcttacatttaactatagtgtaacttgtacgtaagtttcacgtaattttgaatcgttagatctattataagatttgttttggtgaggaagaaaaaaaatcacaacacaccatatgtgaaagaatttgttcccacaacctctattttaccgaaataacatgttatggagagatttttgaaagttacatacaagttacattatagttacagtgtaattatatgcaagttacagtgtaattacactacgattgtactgtaattacatatgtcaaatttttaggggaaaatttgtcgacaaatatatagcaaaattgaatagagtagggttaattggatgaataccactattataaaggtgtcattttataaaaatgccattcctatttttgtctatttgtatttatgtcatccgaatacgtataaagttggaaccatgacatttccatcaagtttttaaattagttgtgtgtggttatgattaagaatttttatggtacgatataatgatagcatatactgctagtataaatgatccaacggtatgaatcgatttggtttcccatttaaatagattttaggtttgtattataaaatttagaggggtaaaattgcctgggtgtccctgggtgtgcccctggctcacgccgtccgtcgcccgtccgcaaggcatgcccatggagggaggcgcgacccccacgaggggaacgcgcgcctccacaccctttacctgaggagcagctcatggtccccgtctcccccacctcctccctctatatttttcccttcttgctcctcttgcctcggccgcagtcggaatgtgagttccaagatatgtcattgttaagtgtgagttccataaaatgtcatcgtacaagcaactttgtcccaataatgtgagttctatgaaatgtcatcgtacaagcaactttgtcccaaaaataccatcaccgttagggttctattagcaaccctctgttaagtgctataggatgaacagtgtatttaacagcgcgggatagacggaaccgtaacagcaatggcatttctaggataaaatcacttgtatgatgatattttatagaactcgcacttgtcgatgtcattttttggaattgggcgcttgtcaaaagcatttcttatattttcttttttttaaaaaaaatcaaagataggccaaagccctctctcatttccatgatgagaaacgtcaggtttagcactacaggttcaacagagaaagaaaacaacgccaacacagcagggaagggtgagatgagatctagcgccaacccacttggtcagctccaagcctccccctgcagcaactaccactacaaactatcgatcaacattactcaggggactcaacacatggtcccagctcccaggagtctcaaaagaacttcagcatgaaccttttctccacgttttctcacattttcgatcctcttgaacttcatttgtcagcttcaaccccatcagtcagtcctccagcccgctcctatcatgtcgctgtccatacttcgagttgtatacttcaccgaccacccgtttcagcagttgcgttcccaacagagttcttctttgtatttcttccgacttctgcaacacacccccaagacataagcaaagaacaaacaaaatgtatcacttcagctggatattttggcaactcattctgaaaacaggctttatttctggccttccaaatagcccagatgacagtcacaattcccaccatcaccatcctttgtctctttatcaaatctccccaagcccccaaacaaatggtcaaacactgtaaattgctttcagattaataaaggcacatttcaccacattccaaacaaaacgagctagcaatggccataaacatatactataaaatttgacaatctgacggctatgcacacacacacaaccttgcaaggtatagtaaaaaaaaatagcataccacaattactagctcagatattagggcacatataaaatttcaactatattatgacatataatagcataccacgactgccggtacctcacctccagatgttctacctcctctgcttctgggtccaatggaaccattgccacgacgtggtcttcaggaatcagtccttccgttggaaatgcaccaacgagctgcgttgatgaggcaggcctatgggctgatcgactacctagaaaggacagaatggtgatttcagtttgtaaaaatatgttttcttccccctcaacaatctaactgaactgtaaaactccctgtactaccctgaactcgttgcgatgatatgaatacatatacaggtggggaactctacacttcagcgaattgttaaaagaaagaaagaaaaccctttgtggatttcaagtcggatgcctgtttcccagaaaacaagaagtatgcatctcccaaagaagaaaagaaagaacaaaaagacttacatttatttttttgcctttcttctccagcttgagattcacatttcctgttcttctccagattcaggttcaggtcaagttggcgcagcttccttcatataagaatcaatgatccatacacgtaacgtacatgggaccgcgacgggagatctccctccaactcccgccgttgcttgctactccgcaaaagaaaagagaagcttcacactcacacaaccagcttgaactccctccaactcactgcaggcaaattgctaagccgctagggatccattcctggttgaagaaatgcctgcctctgcctgctcccaaatatcaaatcggctggctctcctagtcctaatacgatggagtgggggctctttggcaccatcagcaggaggcatcgagctcgaccatcgccgccgaccgatcgaccggcggcggcggcggcggcggagtggggaaaagataactgaccgacgaagacgaagagagaagaa

SEQ ID NO: 57648 - DNA, 6487 bp, Oryza sativa
  unsure (1)..(6487): unsure at all n locations
gtgtgggattaactatacagataaataatttgaacttgtgtagtactatttaactaatgtattgtttttatatgtggatcaaatataatttctctaccatcttctccttttctcttttattcatttacctattgttttgtgtcatagacactttttttcacaaagtgtcatggacactattttgatccccaatactattttacatgtttcttttcttattgtacctatttgtttgtcctgataaaacatactggtttatcttttctcatgtaggaaaatagtttgaggatccatttcaaaacaactttctagagcttttataatatcttgtgccttattagaccaaaatttgctagagattttgcttctaaaagtttgaagataagaggcgttgtttcaagaaacaatcaatcaagagcaaaaccttagtttgatatatagaggaaaatatatatgaaatccggaaaatacttgatcctattgtgcacatccataagggtgacaccctttaaaagtctcatctcagatgagagaatcagttgtgattctaaatcctcttcctcatcaaaaggaaatcatcacactatggagaacactgtagcaatggggactctgtttttgctgggaaatgggaataaattactcaggaataatatcgtttcttacaagaactgaaataaaaacgcacctagagaggtcctcacaccgaccccttatagcaagaaaatggatggccatattctgctcccgccgaattttcctgagaacaaattctctgcttccatccaagagatccctgatctccctaacaagataagcntgctcagacattgctctttcttttgactgtatcagctgcaaagcaantaagcaatctgtttccaggataactggtttgagcgtccaacggagcggcagatagatcccctctttaagagccaggagttatgcttcaagaggggagctgcatctgctcacagacgtgcaggaggcaaagataaccgccccctcccagtcccttataacgacaccaattccacccttaagctgctggctgtcaaaggaaccatcaacatttgccttcatccatccttcctgtggcctctcccatctcattttactggctgaactggatccatcaggtccacggcatctccttggagtagaagggattacagcttttcctttcactgaaccagcagaagattgttgtcggataatgaacagtgaactgatgtagcttctgtaaaaaccatttggaaaattcaatggggggaggtaatttgtcatgggtaatttcattttggatataccaattacgccacataatcattaatgataccatccgttcgtcctcagagagcatggccagctgatcgaataaccaatttgggttcatcctccccacagccggtacggacaaaattgttcctgcatcatacatggaaagccacaaggatcttgcttgggggcactggcagagggcatgtgcagtatcctcatttgcagttccacagatcgaacaaagggcatccgactcaagggttcttttgaacttgttctccttcgttgccaaacaattgactgctaccttccgcgcaaaaatttttaccttctgaggagcagcattcttccaaatgagatcccacgccttacaagaaatctcactcgaggaaccagagcactttgacatgttcttcagcttcagagcccagctgtacgcacttcttaccgagaatctgccatgtttgatcggatgccatgcaataaaatcctcctcttcccgaactggtaacctaattctcagaataatctcagcatcaagcggtaagaaatattggttgattttgtgtatattccaggagccatcttcattaattaaatccaagacacacttgagtctagaagtacccttgctagaaatgggtctcctcgaaaaatctcttggcaaccagggatcacaccagatgcgcaccaacctgccattacccaccctcgatatgatcccttccttcagtagagacaacccatgttcgatagctttccaccccggagacacattgcctccaaaactggtatcaactagggagccatttgggaaatatttggcttttagaacttgtccacaaagactatccggattctctattaatctccaagcatgtctgcaagaagggcttggttaaacaatttaaaatccctaaaacccagaccaccttggttctttggtttggttagggaattccaggctttccaatgtgtccttctcctaccattgtctgcaccccaccaaaaattctttgtgagtttggtaagatcttctgcagctgaatcaggtaatttaaagagccccattacatacacaggaattgcctgtaggacagctttaatcaacacttctttcccaccgatagaaaggagacttttgccccatttaatcatccttttccaaatcttttcttggagactctgaaatttacctctatttatcctgccctcaggggttggaaaacccaagtacttatcctcaaaggaagtactcgttatttgaagaataagtttaatgtcgtccctaatagaggctggtaaggaatctccaaacattatggagcatttggcagggttaatcagttgtccagtggctaaagcataacaggctagaacctccttaatcgcccgtgcctgctgaatttcttccctgaaatatagaagtgtgttgtccgcaaatagaagatgcgaaataccagggctcggcaacagacatgcactggtgaaatttctcctttgattaccctatcttccagaagcaaggatggaccgtcggctatgaagaggaacaagaagggagataggggatcaccctgtctcaacccacatgatggagcaaatgacgagagaagggttccgttaaatttcacagagtatctcaccgccgttatacactccattatctagctaacccaccggtgagagaaacccatcttgtgcatagcctgctccaaaaacttcaagtccacgcgatcgtaagccttggatagatccaacttgtacgcacatgcagcaccgcatggtcttttgttcttttggatataatggaagcattcaaaagcttctaccgtcttctattttctcttttatccatttacctattgttttgtgtcatagacactttttttttcagaaagtgtcatggacactattttgatccctaatactattttacttgtttcttttcttattgtacctatttgtttgtcttggtaaaacatactggtttatcttttctcatgtaggaaaatagtttgaggatccatttcaaaacaactttctagagcttttataatatcatgtgcctaattagaccaaaatttgctagagattttgcttctaaaagtttgaagataagaggcgttgtttcaagaaacaatcaatcaagagcaaaaccttagtttgatatatagaggaaaatatatatgaaatccggaaaatactcgatcctattgtgcacatccataagggtgacaccctttaaaagtctcatctcagattgaagaatcagttgtgattctaaatcctcttcctcatcaaaaggaaatcatcacactatggataacactgtagcaatgggaactcttgatgtagaacacaagatctatacacccatcgttcctcatcacattgttagcatgcgtcatctttgtcgcccgttgcctccatgtgcagcagatggattcgtatcccttgcattaaatgcgagggcagctgcgtgacatgcagaaccaacggtccaggccccatcatatttatggcacagtaggggccccgagcagccaacggggcctaaactcggggcctaccccgagctcatgtcctgagctcaagaatcgtctttgtttaaagcaagaaaatgagttcctaatcccacctttcgctggcatggcccgatgccacatggccttgccatgaaatccttcgtgccctgagtagccggtagtggggacctaggcccccacttcttcgatagatgaatacctacaaaaataacttggaacaacaaaaccggtgaaattcgttagtctaaagaaaattggtgtattgaacaatgtttttgcgcatttagtgcagaaggtcaggggtcaaaactatgtttaatgaccaccaggacactactagtaggacatccacaatgtatggagaacctgagtttaagcaattttttttatggctattcaacatacattgtgaggatggacataagctctttatctgaaaactagctcacaagttagaggtggtattcctgtctctacccttcatcattgcagtcatgctactgcgaacccagatatgtgaaccggcaccgatgctatgcaccattagtgctgctacttgggtgccaattggaacatccagcatatatgcacgaaatatgattgttgacggtcgttatcgatcagtttcgaccgtcaatattactaaaatagaggagaactagtaatgcttgcaatgcatatatctattagaataaaaatattccactagtattaggtatactaaccttttgcagagaatgacaataaagtggaggagaatcgacatcaactcagacgataaatcaatcggacgatgtcgataaccagacttatgtatgaatgggccaaaaactcagaattgacacgatgaattgggccaaaattcacaagtctacaaagtgaagcaatagaggaggctgccagccgaagatgggccgggaaggcccagcccatagttcggccgaacctggtggttcagccgaacccatcctagcaccgttggatgcagggttcggcgtggacgtccaggattgcatcccaatgacggttggagggtacttcggacaattccccttccacaaccgtcataactacctctatataaggacttcaccttctcacttcactcacacacctcaagcaatagctctctcatttctctcaagtttagtttagtagtatctagctggtggaataggaatagagtagaaatcaggagttcggaagtcttcggaagagttcgggtatggctctagtagcttttctcttctcttttgtaagctttgtacttttattagaatactcttctttatacatttatggtattgaaatacttttcgagtatatgaatgcctactttacattatgttcatgttatactgaatatatggctagcttatctgggagatgctttggtgcgggtataatatttgcttatgcaattactctatgtcatgacgatgatattagagtagtatctggtagtttagacgtggtgtctagattacaggatatcattatttggggttatatattgcagatgagaggtgggccgctgatggtgacagctcaatacgggtattcctccgcgccggtatataatcctaagttaattccctggggagggtattcttccgtacttagccccggttgtatggtcatgacgggctgtcgtaaggaactcggcggtcaggggtggcttctcgaagtagcaggagggcatcggatagagggtattagctagtatatcagttaactagaatgtatgtatactatgtatattagaagtataggaatagattctctttctcttttctttccacttagcttagatgatatattatgagaatgagtagttaatgcttgtgtatcactctacccttggattatcttaacccctgcttagaatatgattatcacaagtaatatataaattattagtcaatgttctctttacatgatcttcccacgggataaaataaatacgatacccttggaatactcacgggtgaaatactacaatggtatatccgtgcgcttgcggatgaactctgtaaccataatataccagaagtatttatgcgccattgctggaaattatatttctagtaatgtcgttaaaaaataccaacaacctccctcctgccgctggtcagaccgcccttgcctagccagtcagaccactgcaccacatgtggttagaccgccgccttgctatcggtgtgactgtcgggacctagaaaacaccggtagatgaaaactcgaagatgtagatttaaatatgtcaactttattgcatcaactagtgtttacaaagtgcatcaatagcacccctcacaaaaatctcgactatattcaaagccctaacttttctctcacctcaactctctaagaaattgatatctagaggcctcaacacctctactattttataccctcaacgtgtctatgcaaagcccacaaatctaacaacaatttggactaccaaccaactacttcccaaaatcttaagctctccaaataggatgtgtgtttgatgccttggcaaggtcatgatgatcatgtggtgagaattacaaaattttgctatgcccggtatgatagtgaaattttctgttttatttgaatataattcaaatttcaccatatcgactgatttaattgagacactaatt

SEQ ID NO: 57649 - DNA, 10078 bp, Oryza sativa
cttcctcgatgcttactctggctaccaccaaatcaggatggcaaaagaggacgaagagaagacagcattcatcacgccgttcggggtattttgctatgttaagatgccgttcggactgataatcgccgggaatactttccagcgcacggtctagggcgcacttagcaaccagcttggcaacaatgtcgaggcttacgttgacgacatcgttgtcaaaaccaagacaagcgactcattgattgacgatctgcgggaaacattcgacaacctccgacgatatcgcctcatgctcaatcctgagaagtgcacgttcggagtaccgtcgggcaagctactcggattccttgtctttggcagaggaatagaggcaaatcccgagaagatcaaagcaatcgagaacaagaagtcgcccacgagactcaaggaggtacaaaagctaaccggatgcaaggcagcactaagcagattcatcgctaggatgggagaacgaggacaacctttcttcgctctattgaagaaacaagacaaatttatatggacataggaagccgaagaggcatttattgcactcaagcgctacctatcaaacccccctgtactttttgctccccaacctaatgaagaattattcctctatattgccgccacgccatattccgttagcactgtcattgttgtcgagagagagaaagtacagcgactagtttattacgtcagcgaagctctctatgacgcaaagacaagatacccacagatccaaaaactgctttacgcagtcatcatgacatcaaggaagctgcgccactactttcaagctcacagagtcacagttgtatcctccttcccccttggaaaagttgtgagaaacaaagacgttgtcggccgcattgcgaaatgggtaatcgagctaagccaatttgatgtccactttgtgccgcggacagccatcaaatcccaggtactcgccgacttcgttgccgattggactatgccagacaacaaatcagacaaccaaggcgacaacgaaacatggacaatggcgttcgatggcgcactcaacagccaaggagcatgggcaggatttatcttgatgtctccctccggagatcaattcaagcacgcaatccacctcaacttcagggcgaccaataacactgcagaatacgaaggactactcgccgagatacgagctgcagccgcacttggggccaagcgactaatcgtcaaaggggactccgagctagtcgcgaaccaggtgcacaaagactataaacgctctaaccccgagttatccaagtatctcgtagaagtcaggaagctagagaagagattcgatgggatcgaggtccgacacgtctatcgcaaggacaacgtcgagccagacgacctagcacgacgcgcgtccagacgagaaccgctcgaacccagcacctttctcgatatcctgacgaagccatcggtgaaagaagttagcggcgaagttagcccgaacacacccgacatcagctcggaggtcatcgaggcagaacgcgccgttgctgacatcgaaaccacagacgactggcgcatcccatcaatcaaattcatcagcagtgaggagttgcccgaggacgatacagaggccgagaaaataacccgtaaagcaaagatctactgtatggtcggtaatgatttatacaaaaaagcgctaaacggtgtacttctcaaatgcgtctctaccgatgatggcagacacctcctcctcgacatacatgaaggcatatgtgggtcacatgccgccggtcggacattggtcggcaaagcttttcgacaaggctttttctggccaaccgcccttaaagatgcatgcgacatggtccagcgatgtgaagcctgtcaattccacagtaaacacacaaagctactcgtgcaagcgctccagactatccctctgacttggccgttctcgtgctgggggctagatatacttgggccattcccacgaggacagggcggctacagattcctatttgtggcgatcgacaaattcaccaaatggatagaagaagtgcccacgggggaaatcaaggccgacaacgccatcaaattcatcagagggatattctgcagatacggactaccgcaccgcatcataaccgacaacagctcccaattcatcagcgccgacttccaagattactgcatcgggttgggagtcaaaatatgtttcgcctcggtctctcaccctcaaagcaatggacaagtcgaaagggcaaacagcatagtactacaagggatgaaaacccgcgtctacgacaggctcatgtcacaagataaaaagtgggttgaagaactcccattagtactatgggccgtacgcaccacaccgacaacgtccaataaggaaacacccttcttcctcgtgtacggctccgaggccatgctccccagcgagctacgacatcagagtacacgagtacagaagtattccgacgagaaccaggaggaacaccgagacatcgatgtaaatcttctcaaggagcatcgtgagcgagttgccgtccaagcagccagctatcaacagtccctctgccgttatcacgagaagcgcatccgagcacgcatactttcgatcggcgactatgtccttcgacgagttcaaacccaagcagggcgaaacaaactctcaccaaaatgggaaggaccttacatgatcacacaagtcttgcggccaggcgcattcaaaatcgcagacggcgacggtcgcgaattagcaaattcttggaacattgaccaactacgtaaattctatgtatgagtcaataccactgtacctgtaagtacccttacagtatcaataaagcctatttctaggtcccatatcacaatcaaagtgttttcacccgatgatcccttactctgatgacacctagcgttgaaacctgtccttatgtccctttacgccatctcgacaaggcctccgaggaacctatgggatcttcggctggggacgcccagagtcgataaggccttgtcagatcctgtagagacaaaagaccatgtaagatctggtcgtgtaagagttctcgccgtgcgtattaaccaagccgtgaaatcggaaatcaactttccaacctcatggctgggggctaggatcagagcttattcaaccaaggcaggtcaagggtccaagagccttatcctccgagaaaattcctccgacgacaaggctgggggctagggagagtgtacgactcaaacggctgaccaaagtcgttaactgagaacacactcttacacacgacatccagagtaagatacatttgtttaaggaatatttctttattcacaaaataattcttgtagtttttacataaattttccactacacatctttccctaagatatctgtgacagggcacgagtactaccaagaaggccaacgccagtccatagactggaagattttctcggccagcggcgacatcgacctcgctagatggtctatctccgccggagttctccgagaacaagcaaaaccttcgcggagaaactcgaggtctaggcgcgggtggtgatctcgtaggcaagccagcacgtgccctacggcatatcgactcgctcgacgacactcttgcttcaaggcctcgtcgatatgcttgccgatgacatcgagttgggcacaggccccggttagccaagagatgtacccggccgccgactcctcgggatcaccgcggactactcgaagttccctgcatactctagccatggaggcacaacaactcttcaagtaagaattaaaccacacctcgcgacctcggaccgtctccacagcctgctctttcttcaaggccagcatggttctctcaagttccgccacttcaaatttcgtcttccaatattggatacaacgatcttgatttgcaagggcaccctcgagatctgctaaacgtgacgaccactaagacaagctggatacctcctttacaacataaataacctaatcaggaggtcactaagaggtgaaaaggctactcacttgaggtggccgttgccatcccggcctccgcatcaagagtttgatccacattgtcaaacgaaacatgtggttcgaaatcgagtaccggaatcatcgccagtaactcaggctgcccgcgctgctggacatcctcgtcatcaacatctctacaatggacaaaaactcccgagatcaacatacaaaattggacaagggtggtaatcgcacgcacgaaggcggccagagttcaagatttacacaatatgtaacaaatacaagaagtcctactcttcaaaaagggggagaacagactcccccagatcaccgacttcttccatcatctccttacgcgtgtcgcttgccaccccctgatccaagatctcgcgtagatcgagttcaggacgcgacaaccttacacacgcgaggacgtgacacgccccggtgtagatgtcgttcgacgtctcctccgcgatcctggccgcatgcttggaggggatttcccccatcgccgtcgccagttccgcaagagaggaagtcagcgaaaactcgtcgggattcgccgggatcgtggacttgacgccgcactcctcggcgagctgatagaggccagtgtaggtgacccgcaacgagccacggatctcggagagattgtccccgagttccgacattcggtcctcgagccccttccgttgacgcttgttgccggccaccaactccctcatcttcgtgaggtcctcacgggcttcagctagctcgcgcaccaatctctcagcacgcgcgttcgccgtcgccgcttctgacctcgcctccgagatctcgcggccgatgccatgagcaccagcttcgagaaggcgccccatctcgacttggagttcctcccaggtgagaacggccgctggcagatcacgacccacagcgggatcgctgacggggccgctaggcgtcgcctcccggctcccggtcacgggcacaacatctgttgaggccgtggcaggtgacgcgctggaagctctctcggacttggcccgtgccgccttcgcccgcgcctccctacggacagccacgaatcaaacaccatttgaacgagaagcacgagaatccaagaatctgtttacttacttctcgccgatcgtcacaatgcgctgcttgaaagacaatcaatacagagtaagaagaaaccctccttgctgcacgatctgacgacaagatgaaattatcgagggggtcgctgccttgcggcgatgtccgagtacagacgagaatttcctcgccttggttgggactttgccagcgctagtggtggccgcatcagatgcctccttgacaaccttctcctttagagatgtcgccacctgatggtccgcgagcggcccgatgatgttagtcaaaggaagggcctacgcttaatcacgtcataaggtgatttcgaaaggagaatactggatgcttatcaaatacacttacgttgatggcttcatcgcgttccgccgcccccttttcacaaaggggcacggggatgtcgctagccgtagtcggaccgctgatcatcacttgatcgacgcgccgctctacagcttcgctgctcagacctgttaaacaggaaccaacttttgataagtcaagaggaacacgagtacaagtacgccaagatgaatacgagaaagataccccgaggagaaacccgggtcacgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggttcgagtccttgatctcaagatagaaccacctgttctgccacttactgcgggaagaaggacactggaaggggatataacgcgacttcatgccatcacgaagtcggaacctgacgcaaccagacaccctattggattccatccaacgtagttcatagtagaaacggaagagatcgagaaaaggctccaccccaatgtaggcctcacagagatgaacaaagatactaagaaaggcgatggaattatgattcaaatggagaagagaaagaccatagaaattcaacaccaggagaagaaactcgaaaggtggaggaagaaaaccgcagagaacgtaatcttcgatcgcaacaatccgacccaagaggggctgaggatcagtacctcctacttctctctccatgtctccatggccgggaagggcgccgtcctcctgaaggttcttcaatgtcgcgccggtggaagacgacttgccgagacccattgctgttccaagatcgccggaaaacgagcctgagttggcgaactaggttttcttgcggtggcggagaaggcaaggagcgctggcaggcggtgtgtgttcaacaaggttggcagacttcaaaatgggctcccaaaattcctttaaataagcgcactaccgacggtgcgaattccaaggaacagagagagatctccgccggaaatctctgggcccgttacgcgcggcagttttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcattttaagcagaagtcgggggctactgtcagggttacgggtcaggcataccctctacccttcgatatacgttacatatcgacatggcatacccacgcgcacgcggatatttcctacataacctaaggaaacctttcacgaaatctacagatgggaagagtccttcttggacagaactgggtcgtcgacgtatcgtattgggtatgatatctccgagtcctactggagacctccaaatctgtgatataaaagggaccccccggggagggcatagatcatcgaatctcagagccaacacaacccacacagcctacgaagccgaagtctgcgaggagccaagtcatcgagagctagtcgaatccactcgactacgatctcgtcggatccgataagttccatcgttccctttgtaatctgtgttttccaccatataatcccatatcaactggattagggctattacctaccaaggggcctgaaccagtataattcttgtcttttgattgttcgatgtcatactatgtagatccttgtaccaacgtaccccaataccctctatatccggtctacggatatcacccgtcgacagagggaatactagttattcctcgtaaacaagagattcattaatatttacattttccgatgcccatatagccaattttgtgtggaagaatggagagtcacgcattaaatccaagaaaatcattaagaggataagtggttggattgaaatatgtctatcaaaagtaaaatttccagatttggaaatgtgcctatcaaaagtagatggagggagtaagatttattgtactgtaataacataaacttggtgaaacgcatatctaagtagagaggtgccctcgcatcgctctcacgtgggcagctcgggggaaaaaccctagctgcccgcactgccaccttcctccccctctagctgcctcgccgccaccagaaactgtgtggccagacaggaaggcagcggcggggagaacaagccggcgaagagctcttcctcggtgtgggaggtggacacgcagcgctgctgtgctgccgatcgtacgatgaatccccggttctgattagtgtgactgtgaacgatggaaactaactgcttgagctgtagggatattattttcccgtggcatttgttgttggacgcgtgtgttgtgtagcaaccggttgacgtaaaataccatcggctgtatgagcgctgtgtgtcgctctgcctcgcccgcccttgccaggccattcagcagggaaaggccatcgtacttacaccgttacataacaaataatatgaaacggcttcatagatatcgatttttcaaaatcgtatatacatttttcattctcctgatcgtactttactcgtagaacattatgaaccgatatctataaatacatgtatatgccgatttttagtgaaactaataaatatgaggttgtcgcctcagatgtgcttgttttttttaatgaagaaaaagaatattatatgtatatgtgctgttataaaaaatggaaaaaaaaaacgacttaacgtggcaagacgaagaggccaaaagtccatatattttgccgagtgagtgaaagagccaagccgatttcattcatcttgatcctaccgtctccaattctctcctccctatcctcccaccctcccagtatggctacctcctctccctcgacgttgacttcctcctccttgacagcagcgtcgtgtggcggcaacggcggctccggagcgatggtggcaacccggctagtggcggagctggaacaaaatataggggatataggtgcacattactcatctaatggtattttcccgtatatagtttcacgttattcaaactaacggtacttttgtcatatatagcaagacatttctctagttaataatatttgtcgataacttttgaaaaaaagatataagtgagaagtgagcaaaaaaaagcttactcaaataaacagttaaaaggagcgataccatcaaaaatccctaaatacaacctcaaagtggccgatcaaattaaactgtcaatagtcaatcgccaacaacaaaatcataatagaaatgtcttaatcttcaactgaaaatatatacaataaacatctgaggtaaatacaataactatgaaagtcaaatagtcaatgagcatactgtttaactagtgtaggctgcaggagtccccaagttgcataaccgttgtctcaagaatacggcatgcagcctttaaaagctcactatctttcatttatgtaaatcccaatttgaatgttcaatctttcaaaccctaacctttaatcagggaaaatgaaaaggcactatcaacaatcgcataattcaaatcggagtaattggataactagaagaaaggatagatcgatacctttcttagaattcctgtagcctgtcggatgaaactagaagatgcttacgacgagtaacagggcaaggaactaaggattctcaagctgtgtgggctgagctgcgtctaccactgaggagcgatcaattccggctactcaacagattgacccgagcggttctagctatagcagatcggaaaaaaaagaaagaattgtgaggggatcgaggcgtcgcacaacgtgtttctttgctcgcacgcgtaagcatttaggccgtccatctcacgaggggtatacttaattgggcttaggggggttcctatacggtgaaaataagggttaagcactaaaaatgagaattgggctgggagcctaggaacccctggcttattgggctccgcccttgaacctagggctaacggaacctagggctgacgtaatggtggctcctcctcgatgaccgccaaatccgaccactgcaagctcgaggaccaccagatctagctcccacaagctcaggggtggctagatccggccgatgtagcgtgctcgtcggcggctgcttcctccccaccccatgacaacgatggctacttcctccctacccatggtcccggctgcttcacgatgacctcctctgtatccgcgttgtcttcttgctaccaaaaggtgagtacaagattcatacttttctggcctgcatgtgatattaagaataaaaataagtgtataggattcacaattcacctaaggttaagtggggataataacgttcttcttccccaaagctttaataattttacggatttggtctggatttgcaattgaattaatcccaaggctcaaagcatcataaaggcggggtcctttccaatatttaataagggttaaaaaaggctgcctttgggaaaataattggaaggtacttaataaaggtagtaatatatttt

SEQ ID NO: 57650 - DNA, 3949 bp, Oryza sativa
ttttgtatttccgttattcttggcttcttcttcttcctcctcctcctcctctcatttcttgatttcttgggctccttttctttcttggcatcttcttcccggttcttgatttctacttccagttcttgatttcttggcatctcctcttctttcagggatcgcccgtctcggacaggtggttcatgtttggggacgcacgccaggcgcggtgcccggcgctcctggcaggtgcgtgcgcggttgtgctcgacgccacgcgccctgacggcttcgccatggtcggtcccgagggagacgtcttcgccgtcagcagcgacatcggtggtgctgggtctgatccggccggcggcgcacgggagatatcctggcgcgttgccctcttcatagaccccaacgccgccggcgttctccccttgccagacgggccctacctcgtccacagcacgaggagagggggtcgctggcgcgtgttcgtccgcacctcccccgacgaggcctccggcgtgcgcgtctacgtcgttgggacacgttcccgggaagacttggctgactctttgcacatcgccgtcgacaccacggacgacggcggagaggacggattggcccgtacgtggcgcgtcatggtggagtcggggctggacggggacacaggctcttggcgtaccaccgtccacaccggcggcagagccacagcgacggcctcggtaagaaatctcttttttcttgccaagcagtctgggcagccaatcgttcatgcaagaatctaaaattttgttaaggagacaagcagtttcatagttcttaggaactccagttctttaacaagtgctttcaatcatgagtagtagtttgcaatgcgaatgcccaagtgtaaaaaagaaaaaatggaacaacttattagcagtagtagtttgcaatgcgtatacccaagtgtaaaaaaaaagaacaacttattagctccagcactatatgctatacaacgctatgttggagagaagtcaaaaacgatggtttcttaatacaaaactggaattcactaatacagtttaatttctgcagcacgagcacgtctccagacccatctctggcgtcatacgcagcagctcgtccagctcccattcccgatcccgatcatcggagggcagcagcagcggccagcatcagcgccagagcaggtgggaccagccaccaccgcctccttgttgctccggctgtggcaccacccaccgcgtggagtgggtcatgacgtgctgccacaggctgctgtgcgtcggctgcgcggaggtcaatccatgcggatgcccagagtggcagaacaggcgggggttcgccgttcccatactgcctcagcttgcgcttgaggaggaatgcgtggtcgagggagccatcgttccacagctgccgaggtggcagatcttctacgccaggcgcaccggatcggaggtataccacgccttcttccgagtgcaggacgtcatccacgacagaggcagcgtgctctgccagctctttttctacgagatggacggggatagcagacgttggcaccaggtccgctttgagatagtggaacttccatctcgatacacatggatgagatttcctcccatgaccgaggaggatacactggcttttgagttcttggttatacagtacaggcaccgccgtcgtcagtagtccgttcgtatgtcacgctctgccctgcacatagtgtcaatctgtgtgtctgtcctgattttctgactccattttatcccatgtctatagtatatagaactgagccttgagatatggtagtatgcatgattgcatcctcagtttccaccgaatagttatggtggtgctagattctattctgtccatgccatcttttctttacaactttgtaaatcatcatccagagcagttgaaccagaactatgtgtgttgcttgctcgagacaaatcggatatgaagatactatgccttgctttttctgaagttacatgaatctcgttcacaggtagcatgtttttcttgccagcttggatgatagattcatagatctcccctttttctgctttgtttttcaaaatggtgatctactattgacatggtcacttccagattcattagtgcctcagtgggtgcattcaataaatatttccgaatgggcaggttacaaattggtgtagattgtttccttccctgtaattttgcactgttggtatctgaggtctggagaaactacgacctagaaaatttcctcaatgagacagctcttgaatcttctttacagtgaatccctgccttccaaccataatacctgccttctgtacattatcatgattgtagtttgtttctgatgaaatcttgtgggtggttacttttgctgcatctctggctcctttggtacattaaacaacccgtcatgttcaacacccatgctagagcagttgtcttgctcaaacaatttggagtacagcaatccactgtgaccaaggatgtgccctgagaatcctggaaatgcaccactgttctcctgaaggattttagggaaaacatcctttttggagtacagtaactcaagtgcctcactaaactccttagaattcctatgggcttcatctgcggaaagacgctttgcatgtggatccaagaacttatgcctcacaaattacaaatcatccttgtcactcctgggaaaagcctactcgttccctgactgcaaccccatgcacatatcattattttccatctccgtgacctcgaaaacatccttagtcctgggagatggtcagcactgctgctacatggttgatcctcagatgaagcatcatagacttgatcacttctagataagtgccgctgcatgttgcacagaatgtcactttggcattggtcaagagctttattgggctgaggcacaatgtcaagtcccaagagtcaggcaacaataccaggtgaacaatgtgtgaactccaactgttgtggtactctccccttggcagatggtgtatttgcaggaaccagatttcttttgctagagaaaccctgcaaaacacggaaaggaaacagacaattagcctcagtcgggagctcatcaagcaaatggttttcctgcagtaatgcagcattgttttgttgcctctttttttttttttggggggggggggaataattttgttggctcttttagaccctcgattgatttcaaaggcgaactgttgtaaggaagtaaacatcgggacaatgaggacgcacggtgaatcttagcaacattatttgctactaaaaaaaatctgaaacttgagaatgcaattaagcctactggaacagagctagcagaagcacaggtaaatcaaatcatacaccatacatagctgaaagctcgaatacatgacatgtaaactaaacagtgtcaataacatggtcgaaaccaccggatcctcctcctcctccctagctgacacgcccttgggttcggggtgggggggtgaatcaccagaacccaagcgagccccagaaccagtgaacaactcgcacctcggcgcgacggagcaggcgaagacaggggggggggggggggcttcgggcgacggtgcctcgccgcgggtcgcgagccaccggtggcgccgccgccttttcctctcgaggcttcgcggcgcaggccttctgttctgcccttctctctctgtctccactgactggtgggggcagtcggggtggtgggtccccccatgagaatgggcggtggtgcgctggatttttttgcacgcgacgcgggtagataactcaactgcgtgttgtcagtcaatgtggagtcgagagggctgccgcctgccggtggtggggttgagttggggagggaggccatatgatatgatactctacttctgattgagatccttctatcttaagacagtagtttctgttagatcaaatattacaaatattacatagagattaa

SEQ ID NO: 57651 - DNA, 18864 bp, Oryza sativa
caaaaggaagtggaagggtaatgttaagtgttgtttttgtgatactaacgaatcaattcaacaccttttctttgattgtattttggcaagattcatgtggaatgcagtctatatatcttttggaattcacccgcctaggaatgttgctagtatgttcggcaattggctaaagggggttcaacccaagctaagagctcaaatcgttgtggggatttcagctttgtgttgggcggtttggttatgccggaatgatgtagtctttaatggctccaatactaattttctgttgcaggtgattttcagggggactttttaggcaagacaatggtctttgctacttaaggaggaagatggccaaaaagtgagagaaggttgcttgatcctagagatgagagtttctagctttttcgcaatgaagggatggaacttaaggaaaagattgggagattaatgttctcttgttcttgtgtggtatggttgaaactttgtattaactttttaagaattgctgttgctagagcctaagtgctcgggtctagttgcttgtgatggtgttaaaccttgtgtaagggtgtgagtctatgtactcttgtgagttttgttggggctgtgtacatccttttttgggtgtagaggccggtttaatccattatctaaaaaaaatgtgtgtggattatgctgcattggtattcttataaattgcttgtcttgtatgcccataagaaggctctatcaaaatctttgataaattttgtagtaggccttttttgtgtgtgttttaatggcacttgaggaatataaatacatgtttttgacaaagtaaacataacttctgacatttacacacaccaactaaaggtacacacaaccatatatgtgaaaataaggatttaaatcttggtgtgcaaagtcatacacccacgacgttgtgcagctcatagattccatctcatcttccaccaccctccacccataaaactgagatgagcatcctccctctctctatatatgctacctcaacttgcatactgccttctatcctcctaatttatgcaaagaaaaacgattaatttaaacaactaatgcaccaaggaattcacaaattatatgacgtttggattgtcctaccaaagtatgtaaagaatttccaaccacaagcctcgagtgtgtgtggtgggtgtacatacatggcttcaacatgtggacaggtgtcattcttcatactacaagaatccataattttgttggcgcccaaaataaaagcgccaagaaaaactttccacattgttagccgccaataaaatggactttcccttgccctctagacttggtgggtattccttgttggttggctggcaaagcttattactttggtagttttatgtttttcttggtggtttgtgcccctgaagaaatatatatcttgattcttgtcatgaggttcatgacaggaagaaagaacaaagtggaaaaaagttctagcgcaaatggatgcaaaggaaaaacaaggattcaataggaaacaaatacaccattcccatccatcccactttaaccgaagtcttattcataccattttccatccatctcactttaaccgaagtcttatcaaaacaatacctattcattcatcttcctatttaggcatgcgtactactccccccacaacctatagctaaccatcaacctccatccactccatagctgccactacccccaccttgccatgacatcaacacaatggatccaatctgtcgagtctctgccgaccaccatgacgcgccttcatcaatcctctttggcgagtcactcatgacatgatcctctccagcatctttagagcgggaaccgctagatttgtcatcatcaaaagctagttggcctgccacgactagattcaccacagggtccttctcttacagtcttctcccaagctatatatctccaccactaacttatcttgttcacttgatcttcttccagaaaaaatgtaagtaaagagtattactgaagtttacactaagaagtggttcttattggccatgttattataacatggtctatcgtagcacaacatagtgttccaatttataggaaaaagtagtcattcttattaaccattttactgccatgcatcaaggaaataattgaaacagaaccaggtactaccatactagagatcagtctagacaaactaaagaccattgatgatatataaattgaacttgtcataccaccaatatcaatcactataggcatcacttccacacatatgtaaaagtgtcttacacattttctcatattcaaatttagctaaaaattgtaaaatagtgtagtgcctaaattcagcagggaacttcgaccttgaacaacctctgagtgttcctggtaactatattatatatcatgtttacctgttgctaagtgtgagtagttgagcccaaacttgttctattttcattttatctcaactaatacaaagatcgttccgatcagctctcggaacctgctttcagggttaacgccaatcaccaaagccaagacgacggcatcaagatgcaccacagggtcagaggtgggtgggcacatatttgagatcaacgggtacagattccagaagggcatcggtgttggcaagtttgtccggtcgaacatcttcactgtcggtggcttcgactgggcagcttctatcctgatggagtttgtgaggcttacaaagagtacatctcagtctatcttgagcttatgagtgacaatgctgaggtccgggcattgtattccctcagattggttaatcaggtacctggcttgtccaactgggaattgaccctgaacaaacagccagtagtgttcagctctaggggtaaaaatcggtttggaactgtcatttcacatgcctatttcaagctaagaagcgatcttgagctgccagaatcaggcttcatcaaggacaatcgcctcacaattaaatgtctacttctggttgcgaagtgagcatagctcaactggttaggttccttgtggtggaaccagcccacccgggttcaaatcctagatttgacacgggtgctcgcatttacggctaattattctttcagtggtaggcgacgtacccgttgacagcgaggcgcctgtggtgacttcgtcaatctcaagacatgccggctcagtctttcggaggtgctcataggggtagagtgtgcgtgtgtgcgttcataggggtgagtgtgcgcacgttgtaagcgcctgcgtacgtactgtgtttctcaaaaaaaaaatgtctacttctggttatcaaagaatcacatgtgtgtgaaccttcagggaggtgataagattgagatgatccggcatttacttgtggctgcggatagatatgccatggacaggctcaagttgatttgccaacacatccttggcaagagtcttcatgtggacaatgtggcaactacattggctttggcaaacgtgcacgtcacaactacacacctgatttttcctagacaaacacctcaataggttgcagacggataagtgtctgtgtctgcataactcgaccctcatttttgcatacagcttcttaagagacccgcatgcgaaaatctattttcatagacatccctcttagggaaccgtatgcaaaaatatagctatttttttagatgtgccaattaatcggccgcatggaaaaatatattttcgtagacggacctcttaaagttccacctagaagtctgagttacttcctctttcactctttagcacttcgaatttgttcaagtcatcccctctctatctccttacctcttccttatctcctctcttcctcctcctctcctcctctcctctcatactcctctctctctatctctctcaaactctctcccaggaactctctcctttccaattctcgggcgcacagcggtggatggcggacgggagcgcggcggcagaggccagtgggtgcgtggtggcaggctccccatgcatcgaaggaggcagcagtggtggtggttgcatggtggcgcccgggtggtagtagatccagtgttgggcgacggaagacgaaggcggtgaggagagcgcgacagttggccggcgggaggaacaaggcagcggcggtggcggtggcgcgcggtggctggcggtcggcagcggatccagtgtagggcgacggacatcgaaggtggcgaggggcgcgcggtagtcggccggcaggaggaacaaggtagcagcggcggccatccccctactcggatccacgcgaatccagcggcggtggcaggaggagcacacccgcggtggcgggaggagcccgacggcggtgaacgggcccaatggctaatgggttagggaaatgatttcccacctaccaaaagatatctttaaatcctaaccattcattctcccacttccatttaattccaaccctttattcatttcccaatctcaatcccaccccttatttttcattatccaaacataccttaaaggtaagcaaatgtaaatacaagctaagtgacacatcatcaccagacaatgtcctaaccatccgtttcaacaataaaagaacaaagaaagactaaaactgatcaaccataagcaattcatcattcaaacattctggacaattaatgatttggtttttctagagtgtactttatatccatttaattaattagtattttttttgaaattaaatattttcttcactagcggcttcttaaaaccagatttattagtttgcactatttctttcatactgatgttggcataacacatatatgaacaggtttacaagatagcataatatcaaaattttaatgtaagtcctcttaaagtaaatcttattttgttgctaactactagacattttttccctttgttcagttattctttttctttagtgtgcacatctttttaaagtcattaacatgtacataatcatcccgcaacaatgtacgagatgtgattagtataactatatagttcattcacactaagtacagttaatgctatttatcttctatctcattaaggcgcatcacctcaactatgttaagcccttcgatgattactctatggtctaaattgactccattctttttcttctcttataaagtcacagtccttaattagtttttgcctttgcatgatcaatcaattgtttgtagcttttatcgatgattgattaaagatgtaaattacgcaaagtatataaagttatgtcgtttagcttagattaaagtcatcatatgttgtatttctaccatattagcatacaatactcctgtagcaatgcaattatgcaaagagtttcatctagtattattgcacattagcttgccattgtgtggagcttatggatgtagcgcagcatatgccttatgctatcatagtgttgattgcattatcttcaaaatgtgacaacacatttttggagaacgtgtgtgttggatattatatactccctccagtcattattatataatccctccgtcactaaaattagcgttaaaacatcatatactaattaccggaggaagtatataagtactacactcacttccctaaaataatattggtgatttgctactctataaatattgccacttttgattactttgcactctgacaataccatgtaagaccatctgagttcaatgaattgtgggctaggatggtaattaattgaagcacatcctatttctagagtagaaaaataccaaatctaacaaaacccaatgcttatctccccattttctctccaccatggttcatctctcctacatggcaaccctgcgaagctcaaataagcctgtaactgatcataaataaaagagtaaatttcacaaaactacaggtactttgcacaatctatcacaaaatctataattttaaaaattatctcataaaactacatatttagggaccctgttattacaaaactacatgttttagctctcttcgttaaatctaccgtcacctgacagggtggcccacttgcagcctcaggaacttccccgttaaatgacacggttcctagttttcctagcgtgaaccgaataggttcctgagtcggatgatgcagttatagatggccatctgggcggcacggctcggcacggcctaggcacggcccgaccaacacaccggaccatgacgtgccagcccacatgctgaagcatcggcccaggcactgcccaatacgactcgggccatgttgggccggcccgaaggcacgacaacccatcatgcttcttcataaaaaaggtataatttccgtccctcatttctttgggtcatgtatgaataattgtaataagtctatatgcatcccttctctcttggcccgtgaattatatggctacactaagtctaattttagtccctaaactatttttcttccctcctcattggatagggccgtgccgggcttgcccaccgtgtttgggaatcagcccaggcctggccaatcgggccaggccgtacctgggccgggccatcgggccttatggccatctatagatgcagcttggacgaattgaagaaccgaaactaatgcaaacggacgacgcgcagcagaccaaccgatgcatctttaaccgtaaaacactcttattttccatcatcttaaaaaagaaaaagttggatatccaattggaaggggcaaaatataaaaattcactgcctagggtttgatgtaggagatcgaagaggcgtctcctcgccgtcgtcgctcaccatcttccgccgcaaccgccgccgccgatcgcctctaccctcgacgcacgcaaggttggtatccatcagcttcaccccgcgcttcctcctcctccgccgccgcaagaagagctagcttgcccctttcccgccgatttgatccgatccccccaacctgctctgatcgatcggttcttgggaaatttcgcagcgggggatggtgtccaagaagaagaagacggtgtcgaggcacaccacggagtcggaggaaggcaggcactcgttcgagatcgtcgggtacagcctcaagaagggcatcggcgtggacgagttcgtcgaatccgccaccttcgccgtcggcggctacgactggtgcatccgcttctaccccgacggcaaaggcgatggtgccaaggactacatctcggtctacctcgagctcctgaccaaggactgcgccgtccgggcggcctacgacctgagattggttattcttgcccccgggttgccaaagagtgtctactctgaaacaactcacaggatgttcaattctgaggacagtagcaaatttgctccgcattacgcgactttcatgcacagaagtcaactggagatggaagcgtcaggctacatcaaggacgatcgcctcacaatcgaatgctttgttaccgtcgtcgtccaggaatcgatggcgtctaataccgtgaaggcccatgaattaatcaaggtgccgccgtcagatatattggaaaattttggcgaattgttggagaagggggaaggggcggatgtgactttcgttgttgggggagagaaaatcgccgcgcacaagatcgtccttgcagcacggtcatccgtcttcaaggcggagctctatgggcagatgaaggagaagagggcccggcgggtaaccgtggaagacatgtagcctgatgttttcaggggcctcctgcatttcatctacaccgattcgttgccggacatggatgatctcagtgatgacgactactatgagatgatcaggcttttgcttgtggctgctgataggtatgccatggacaggatgaagttgcagtgcgaaagcatcctcggcgagcatcttgatgtgcagaccgtcgcaactacattggctttagctgatcagcacaactgcaacggccttaaagatgtttgcattgagtttatcgccactcaaaacaagatggatgatgtggtggcaactgaaggctatatgctgaggacttgcccttctgtcttagttgatgtattcgagaaggcaagtaagttacgtagaatttaaatgctaatgaacccccttctacttaggtgctgtctaggagtaggttctagttcttaaattgtatgaatagcatgtctgttttgcaagagcagctctgctaacaccgggggttatatgtgctgtgttaaattatgatctccttttagggcacccacaatgttgtaaaaaaccaggtagtaagcattaaatggttgcttactacctggtattagtcattgtgggagtagttcatacttaaagccaggaagtagcgctactgccggcaagaagggaataaaaaatgaaatgtgtacagtggagttctgacaaaaaattttaaattgcaagtagcctttgcttcttccaaccgttgctctcctccccagccaaccgttgcatggactgttcttcttgccatcttcatgccctacaaaaacagagatggctcataatttctttgaatcaacacaaacacattctgtgaaacttagctagctgagagcttgagatggatccctccaagagaggtttcatgaacttgttaaaccaaggctctccaagccaacaatctagccaaaactcccctcctactcaattcccctcaactttctcccaatcacaatttccccaatccccacattttactcaagcctcaccacctaatttccaaaccttcaacccttttggtcctccagccaactatcacctatatggtagttctcctccaaactttcaaggttttcagcagcaagcaagctggttacaatctgcaccaataagctttcaaggttttcgtccccaagaaagttggatgcactcaccaaatcaagttgtcgggtccgcctcatctcatggatccgaatcagcctctcagtgccctgcaagacaggaagagaacaatttggttaacatcgaagagtcaagtgacaatagccaagagacagggagaagagggacacgcgtcaactggaccgaagaagaaaacttacgactcctcagctcttggttgaataactcactagattctataaatggcaatgacaagaagggagaatactattggagggatgttgctgcagagttcaatggtaatgcatctagcaataaccgcaaaaggacagtcgtgcaatgcaagacacattggggtggtgttaagaaggacattgcaaaattttgtggagcttattctcgagctagaagaacctggagcagtggattctctgatgatatgatcatggagaaagcccatgcattatataaatcagaaaacaatgataaaacttttacattagagtatatgtggagagaattaaaggatcaaccaaaatggcaacggatacttgaagaggacagcaagaacaagaggactaagatttctgaatctggtgcatatacatcatcatccaaccaagaaactgaggaggagaccagccgaaaagagaagcgtcctgaagggcagaaaaaagccaaagccaagcttaaagggaaaggaaaaaaacctgcaccgtctcctttgggggaccagccatctcaagattttgttctcttcaacgaagctgtaaaattgagagcagaagcagtgctgaaatctgcagaagcaaccaccaaatcagcggaagcaaagaaggaacaaactaggatggagaagtatcagacatatttaaagttgttggacaaagacactgccaattttagtgatgcaaaactcaagaggcatgaagctgtcctcgaaaagctagctacagaacttgcagaagaatagaagatccctaagttatgtttgtacccctagtacttagtgtgtcactgtttcattaagtttaacttgctagtaatatttagacttgtgataggtttgtagggcaagtaattgttgtattgtgaactcagtgaatgatgaatgtaatatttcactagtgagaaggcatatgaagtgataatatttgcccacaatcataatatgtctgaaccttctgctctgtagtctctgatttgtcccataacaacagcaatttgttcttaagcagcctgcagaaaaatatacattgataataattagcacaacattttataatatggtggtttgaatagatagaaaaggaaggtatggttgtttaaaatctagctgttagaatacatccaaaaagcaagacatggttgtttaaaatctagctgttggaatacatccaaaaagcaagacacagttgtctaaaatttagctgttggaatacatccaaaaagaaagacatggctgttcagaatctagctgttggaaactagccgttgcaatggaagcaaaagcaaggcatcaatgttacacatagctagcaggatgaaccatatataaataagacatgcacatcacgaaggcagcattccccttcctttccttcaacttcttaccaacataacaacccatctccaaaaaagatgtccactgagtcacaagataattctagtcattccgatgagtccatcactagtgagaagcttgatgatatgacatgggaagaaattaatgaccctatggaagctcagcttgaagctcggttggaagctcaacttgaagcgagattgatggctcacctagctggtagctctaatcagctggggggctacacaaggaggtacattagtagagatcatgaagatgaccccaacagattatttgcttaaatatttttctgagagtccattgtacaccgatgatcagtttcggaggagatttcgcatgagaaggcatctttttttgcgcattgtacaagctcttggtgtttggtctccatattttcgtctaaggcgagatgcatttggcaaggtgggtctatcaccattgcaaaaatgcaccgctgccatgcgaatgttggcatatggtacaccagctgatcttatggatgagacctttggggttgcagaaagtacaacaatggagtgcatgatcaattttgttcaaggtgtgcggcatttatttggtgaacaatatttgcgcaggcctaccgtggaggatattcaacgtttacttcaatttggagaggcacatggatttcctgggatgttggggagtattgattgcatgcattaggaatggcaaagttgtccggttgcatggaagggccaattcacacgtggtgactatggagtacccactattatgcttgaagcagttgcttctttagatttatggatttggcatgctttctttggtgctgctggttcaaacaatgatattaatgtgttggaccagtctccattattcactgaaatgatacaaggaagagcacctcctgttcagtttaccataaatggtacacaatataacatgggatactatttaactgatggaatttatccggagtgggctgcatttgccaaatcaatcaccaggccccaaagtgctaagcacaaattatatgcccaacgtcaagaatcagcaagaaaagatgtggaaagagcctttggggttttgcaaaaacgttgggccatcatacgtcacccggcgcgtatttgggaaagggaagagcttgcagatataatgtatgcctgcattattttgcacaacatgatagttgaggatgagagaggctcatatgatataccggatgacaatacatatgaacaagggcagtattctcctcaaatgacagggcttgaccatggaccaatatatggatttcaagaagttttagagcaaaacaaggctatccatgaccgacaaacacatcggcgtctgaagggagatttgatagagcacgtgtggcagaaatttagtggtcagcaacaataagattagattttaataattccatatcaaccttgtattttactagtttaatttgtctttaccaatttagaatctaaatgtttgcttccaaaagtacttgtatttgtatgtcaaatgtattactttttatcagctacgtattccaatagggactatgtacactagctagttatcttgcaatacctacaaaaatggattgccttttatttctgaagaactatatatatgttctgtatacagctagtagactgaagaaaaaaggagagcaaaactaccaacagagaggcaaaatgtggttcctttttcctgaaaacatttgaacaggaaacaactgtgttgatacatagcaacaaggttacttacaccaacaccaatgcactggtgtcaagtatactcccctgcagctagctgatcgagaatcgagaatcagctagagccctgacaaacatatactccagtagctatatcgaatactattgaagttttcagattaatcaaactccgatgcttactttcgattagtgttgtaagaattaaacataattatatctcatcatcatgtagcttgtatttttgagaaaaaagacagtcggttgctgttaacaggccggcaacatagcaaatagatatattttggatggcaagagagttaaattaaattttctgcaacataatatttagcaagaacataaaaggttagtgctagctacatccgttcgtgatgtagaacagtagaaggttaatgtagctacctgttttaaactgttgtatgctgggctcttatggagtggggaaacctagtgttgtgttctttacttggatagaagcacgaaccataacacagatcaaacggtaaaacaactgaccgtgattaaacaaaaaatctgtccacatagttatagcaactccgaccgtgattaaaaaaaaaatctgtccacacagatatggcaactccgattctcataaactgaactagaaaatataacatgcgcaacatcgacagagaggtacatggtacaatatttatcatgcaagcacatacgctattctactacttaaatcacaagcataggggttagttggacttacagttggtcttgcagctccgtcgcagatctcagcaggaggatatgaagccgaagctgatcacacaccagagaagatgacctcctcagtctccagccgggctgaagcaccagtccgccataataagggaggtggcttgcggcgtcgggcggcggggatagcggcgacggatgaaggggaaagcgtcgcctgattgcagagaaggaaggtttgcggcgtcgatggtgggggtggagcggatgcggcgccgggtggtagcgatagaggggattgcgtcgttgggtggcggagaggaacccggcgtcagtggaagggtggaggggtttgtggcgttgatttcggggggagggggagcggatcgccgcatggatagtggggacggaggagttggcggcagcgagtggcggggtaggagcggattttacggcggcggggaaggagaggagattgcggcgccggtggaaacagcgaaagaggaattggggatcgatctggccggaactcgcgcgaaggaactgaggagcgccgattttttttatcctgtggaccccacctttactaccctctcgccgagataagcattgtggatagtgtcttctcctattaccgcctgtgactgggtcccacactaatactcatcttgataatatacattggtgttgcccttagggaaaagtgatagatgaacaatagttggatatcgatgtaaggagctgtcatagcctcaagctctcaagtgctgagtcgaacaacattagaaaaaagtttcattccactgagtgtggcaatatagcagcataactagcaacacactgatgctgtcattttaatattctgtttccctgttatacattgcctgcagagatatggcattttgcggcatgacagcatgagtagtttgattgttcaatcaatattgcaataattttgtagttggaatttgtttggatgatcgtgttcatgattaatgtttggttatctggttagctgttaggcttttaagtttcatctggcgttcgagtccaacagctaaacctgctgatattgccccaagtctatattaacgaataattaattattctatagctttgcgtgctcatgttttactgctgcaatgggaactttggatagttcataattatcagaggattttatcgactgcattggtgttctattagttattcagagtaaaaactaattatcttttacaccagcaagcactatatagagagattatttaccatgttgaaccttatgaaggtggtaaaatgtaggcctgaacagcagtacacttgaaattttagagctaaacaggaaagtacactcgaaatgccgtaggaaactgtcgacataataaacagatacgcccatcctcgatggttacgcgcgacatcctcgcctccttcatacccacgcagagctgcgcctggaagacaggcgaccgcatcgcgagcacgatcttatgcgccgcaaagctcccccttccaacaatgaaggtaacatatgctccctgctttgtctccagcagcttgccaacttgccaagatgctccgcgatgtctgacggcggcacttgaatgatctcagaggtccccttggtttcgctcagccgcgattctttgatgaccttcaccgtgctttcaaccgtgatggtatcatccttgatgtaacccggacaatgaaagatccaccgaatctggcaagatgagtactgcaaaccggctgataccttcatggctgaacaccggctgataccttcatggctgaacactcacggtgtccggcgccggccggaatcctggttcagcttcagcaatctcagttcataggatgcccacgctgttgcattctcggagtcgagcacgaggaagaatgaactggccggcgatttatcggatgccccgctgctgggtagaagcggatgctccagtcgtagccgccgacggcaaaggtggccgattggacgaacttgccgacgacgcccatggccttcttgaggccgcgcgctgtacccggcgatctcgaacgcgtgcgtcccctcctccacctccgtgacgtgcctcgacgccgtcttcgtggatttcaatcccatctggtgggtgttcgtgcaagtgcaaccaagatcaattcagagtaactgtcagttacgaggaagaaggcgacgagagtggtcgcgaacggcggagagcggtgaaggcgacgagacgaggccgattggcagacaaggatgaggtcctaagattttagtgaggtttcttcgagaaagacaagatgtagcagaaaacatgaaccataatactctcttcatctacttttcatagtcatatttcatcttggcacaatgactaaagataagtaattcttctaaacatccatttaaatatgctactccctccattccaaattgatctacatatatttttttggttattcctaaatgatgtacatatttgtgttcattcattgtgcattggagtaaatagacattgatgcatgcatccatgcacacaagtatttataacccacatgcaatatcttgatttttctattggctaggaaatagtggggatcgtacatacattgagtttgttgctagagtaaatatagtatgagagagttattagtttttcttggtcttagtgtaccaatgaaatatgtagatcaatttggaatggagggtgtcagggttacgggtcaggcataccctctacccttcgatatacgttacatatcgacatggcatacctacgcgcacgcagatatttcctacatatcctaaggaaacctttcacgaaatctacagatgggaagagtccttctcggacagaactgggtcgtcgacgtatcatattgggtctgatatctccgagtcctacttggagacctccagatctgtgatataaaagggaccccccggggagggcatagatcatcgaatctcagagccaacacaacccacacagcctacgaagccgaagtctgcgaggagccaagtcatcgagagctagtcgaatccactcgactacgatctcgccggatccgacaagttccatcgttccctttgtaatctatgttttccaccatataatcccatatcaactggattagggctattacctactaaggggcctgaaccagtataattcttgtcttttgattgttcgatgtcgtactagatccttgtaccaacgtaccccaataccctctatatccggtctacgggtatcacccgtcgacagtggcgcgccaggtaggggggcttggtactcatggttctactactatgtcatccagctttgtcgacaacaatgtcaacaccagcctcagccaagcgctccctgcttcaacaatgctggtatggactcaagtcggcgaaatcgtcttcccggtttacaccacgacgccgatctcaaccggtcctccaatgaccgaaaacgagaacgcagtggctacaaaccaaggcgactccatgtcgaaaaatccacccgtcgaaatggagaatggatcatcgacgacatccaagctcgggaaggattctgatacggccaaaccttgtccttccgacatgaaccacgagccggcaaagatgacttccgaagccacaaggtcttggtgtcctatccacaaaaccaagaaacacaccctgcaagattgttgggaactcaacgtccgtgttgaaattcgcgcctgcaaagaacgtggaattcagcgtacttctccaactcgggatgtctattgtcctattcacaagacaaagaatcatgacctctcgagctgcaaagtcttcctcggcgccatgaaagctccgtctcctaagtcatacgtctccgtcagggataacggcaaggaacaaggagcgactccagccttagatcgattcattggggtaatcgatatcgatcatcacgaaccatcggtcttacatcttctcgaagactatgggtcatcgacaacgagcgtgccgcgggaggtattggctatcgatgacgttggcacgtcagcgcaagccaacgcagaagtggcgaatcaatcgactactccaacccaacacatcagggccgttcaagctatactgagggaaactccttacgatcccgttctgaacgatgacctcgagcgttggacagaacgactacgggaatcggtgaccaacctcagcaacgcgtttgaagaagccgctaccgcaacgcatcaagatcagccgccaactggcgacgccaatggtgaagatccggaatggagggaatcacctcaacgagccactcctccacctcgcggcgctggtgatctccgagatcaaatcaacggccgccgagaagcacgacgcacacgagacaatgtaaatagctctcggcgtcatgtctcttcacggcgccatgataacggaaatcgaggagaccactcaaacgaggaccgggatcacgacgaccaccacaatcgcaacgatcgtgaacgacgggggccagacaatactggtcatggccgccgccgaaacgacgacgataatggagattggtgccgagagaatagcgagagacaatgacaggattcccgagatccaggccgtcatcctcgtaatcgtacgccggaaccaagcgacccatcgtcatcatcatcatctgcgtcctcctcattgtcagacagacatccacgaaggacacacgaccgccgataacccaccgcccccaacgctgggtgtagggctttcggtcgttccctacgtgatgtccgatggcctgagagattccgacccagagcaattgaaaagtatgatgggagcaccgacccagaagaattccttcaagtctactccacagtactctatgctgccggagcagacgacaacgcgctagtgaactatttaccaaccgcgttgaagggttctgcacgttcatggctgatgcatcttcctccctactcaatctcttcgtgggcagacaattcgtcgccaatttccaaggaacgtacaagcgccacgcgatcgaagacgacctacatgcgttgacacagaactcaggtgaatcattgagggaatatgttcgacgctttaacgaatgcagaaacacaattcctgaaatcaccgacgcttttgtaatctgcaccttcaaatccggtgtcagagatcgctacactacccaggaattggcgacaagacgcatcacagccactcggaggttattcgagatcgttgagcgatgcacccatgtggacgatgcgctaagacgcaagaacgacaagctgaagaccgggggagagaagaaatcagccacagaggcatctgagtcaagcaagaagaaaaatcgcaaaaatgggaaaaggaaagctcaagcgaaagtcctcgcagcagaatacgcgaaccgtcccaagcacccagactcacaagacagcgacacaaagaaatcttggtgccccatacacaagacggacatacattctctagaagattgccttgttttcaaaaagtcgctcgagaagcacatggcgtttgaaaaaggcaagcgagtatgcgttgtcgagaagaacgaagagacggctcctcacgaatcggattctgcgtatccagactccgacctccacatctcacacattttctgcagctccacaacgtactcctccaagcgagaatacaagaaagtggaacgtgaagtctgttcgacatggcggggagctgcacccaagatgaagtggtctgagcagaaaatagagttctcggaagaagaccaccccaagaccgtcgttatcccaggacgatatccgatcgtggtcgaacccactattcggaacatcaaggtagcgcgagttctcatcgatggtggtagttcgatcaatctttttttcgccagtactctggacgcaatgggaattccacaaagtgagttgacaccaactgatcaacccttccatggaattactccctaatcatcatccagacctttgggcaagattacgttgcctgtgaccttcggccaagccaacacttcccaacagagcagatc

SEQ ID NO: 57652 - DNA, 4952 bp, Oryza sativa
caattttggcatgaactaaacacagcctaaactcggctgaaaccatacttagaattgtaatcctatctttctatatagttaaggcccacaaaattctaaaactcaacatataaagatgccatatcatccaaaaacaattattacatctcaaatctcatgcaagcatgataatttattaagttcaagaactttataagacttggtacatggtgggtcctgccgagcttagtcaactattattagatatgtggtatctataaccaagacacatcccacataattcatacgatattccatcacttcttgtaatatcctatatggctatacagttcatcctcactcaaattttagacctttaaaattccaagcatgttaaatcatcattccacataattctcaaaatatttcaatacatctctccatccttttatataatatctatatgcatatacaattcattctcaattagttaatgttatttcactattctctcattaagttatattatctcaattatttgtatccctcaaatgattaatctatagttggaattatcgtcctccttttcttctctcataaagccacatcatacaacttttacatatcaaaaatgatttagcaatcccgtatttataaacaaaactaaatctaatataaatatgcaaatagtatcaactaaatttgggcagccatcgtggccaaatccttgaaaaatacattgaaacgacgatcgctgtcgtcgtggtactcgacgggcacctctcgcttgaccaccgtgttgccgcggcgtcccgtgttcacaaaaagcatcctctcgccgccggcgcccgggtgaaggtcggcgatgcattcgtcgtggaggccaacgctgagcagcaggcgagcctcgcggcagtcattcggcacatcgacgaactcctgcatgcggaacacgcgctcgacggcgttccggccggcgtcgtaggcgaacacctcgtggcgccccgtggcgagcaggatcctgcctccggcggtgcagagcggcacgatcacgcgctcctccatcagctcgtcgctcacctctcgcggcagcctattcaggtagatggagcaacgcaccgaccacgacggcgacggcgacgccgagggctcgctgcacgtgaacagcccgtagacgccgccggcgccgcggtagtcgaagacggcgcacagcgagccgtcgaggttggcgaggtggcacattcgggaggacagccgcggcggcacgtacaccgacccgaactgctcggcgccgatggagaacgataggattcgccggatctgctcgtcgccgggggcggctggctggagcagccagtagaggtagccgttgacgaacaccggcggcatggctgggaggatgctggccgcggacgccggcactctcccggcgcaggggcgccacccgccgggctttcccagggtgtacacctcgcaggcgtgctccccgttgcgtctcttgaagagcctgaccaccttgtgctcgtcggtcgccgtgtcgagccgagcccggtggtcgagagctcgaaggggcgccatggcgtcatcgacgggagataactcgtggtgccacggggtaaccatgctagcggatcagggtgcgccttcgcggccggctggcacggcggcagcgcgacgtgatcgccggtggagaggttgaggaggtaataccgcggcgcgcggccgtcggagacgagggtgaggcccctgcacggcgtgggcgacatgacggcgtgcttggcgctgaagtagtcgatggttaggagctcgcgtgcggcggccggcggctcgcagccgcggagcgagcaggcgtagaaggtggtggtgttgcggtggtccggcggcgcgaagaagagcagctccgggtggcgcgcggcggcggccctggcgcggtgggcgaggatgaagtggtcggtggtgagggcggcgttccagtcgcgggagacggcgcggaggcggacggcggcggcgatggggaggcgcgtgaggatctcgtcgacgaggaggtggtcgggagaggtggaggtcggcggcgagcggcgtagcctcttggcgtctggcggagaagagtcgtcggacgccatttgtgattagtttttgattaatgcatacacacgtgcaccatcatcaaccagataatgcatagtatatgcctatatagagagatcgcgcggggttaatcgaatcggataatgacagcggcgaccttgtaggattcggaatcgtcctcatgcagatcggccatgacgttgctttggatgcggaggcgtcagatgcggtaggacgcttcggagccgacgggggccgtgcgaaagcccatgcggcccacctctctctgcctcacgcggtccgagcacccatggcccagggcccagcaacaaacagaaggcccgcggataatagaatagggtttattggatctactaaggcctcatatagttcgcgaatagaaaaattttggggtcacatcgaacgtttgatcgaatgtcagaagaagttttcggatacgaatgaaaaaactaatttcataattcgcttggaaaccgcaagacaattttattaagcctaattaatccgtcattagcacatgtgggttactgtaactcttatggctaatcatgccctaattaggctcaaaagatttgtctcgcaatttacatgcaaactgtgcaactagtttttcattttatctatatttaatgctccatgcatgtgtctaaagattcaatgtaatgtttttgggggaaaaattttgggaagtaaacaaggcctaaatgtgctgttttataaaaatgtcattactatttttgtctatctgtattcatgccatccgaatacgtataaaatgaaaatcatgccatttctgtcaagttttgaattttgttatgtttggttatgattgagaacttttatggtacgatatacttgtagcattatatcatgtaatgctgatataaatgatctaatggtatgaatcgatgtggttttccatttaaatatatcgtaagtttgtagtataaaatttaaaggggtaaaattgtctttctttgttatttagtgaggtcgtttttgttaaaaaataaagcagttaatgtagatcaaacaaatccgataccattgtggaggttatacgaatgtgttaacctaacaaacattcaaaataaagcggttattacttattagtagtcattgtttgcttaatgtatatctaccatatctaccatcggataagaagggattcgttcaaataccattatttagatgggcttcgctagaataccacccctaactacgacatctttgccaaaatagcattccggacaaaaatacctctatttcttcttcctcctcccttttgtgcttgaagaggttgctggtggccaccggggcgaggttgtcgccggccaatgagtcggggtgggccagcggctgagatgacgtaagcgacgtcacacacgagacgcatcctgggtgctgccccctctcccgacacgagcgacggtggccatggacggcgcgagcaggcacagacacgaccaccgtcgccgcgcggagcgagcgtgtggcggggatcgtggtaggatgagcttgatggagatgggagttggtgcggatgtccttgtcgccctgggaccatgccgacgagtgcttgcaccatcacttcatcctcccggcgtgctcgcgtggcggcgccgccggagctgctcaccacaccctgatggcgccgccatcgttcttttctggagttggaagaggcagaggtaagggtatttctgtccacgatggtattttgactaagatgcactagttgacgatggtattatagtgaaacccaattaaacaatggtattcgagcgaatcccatcctatgcaatggtagatatgtaattttctcaatgcaaacacacttgcagcatcaagcaactattcagagagagagagagcgctcttagttaaatttactgctgatgtgaatgtttttagcccgcagccggttactctaaggattcaaattagtatcatattatctttttttaaaaagaaagttttcaaataatcaaaatttcggagagtattctatagagtccctattctataccgtaggctttgtgtgtttcctcctcgggtgttgggggccctcacgagccagaaagaggtgggccgcccgccgcatgggctttcgcgcctccccgtgctcaccttttccaactccaacccccaccacccacacatccccaccaactctcccccctccacagtcactgacaaacatacccgactttcccctatggcccacccgcagtgacctgtgtctattcacccccacgtatcaaaagcctccgaacccaccgccccagccttgcgggtcccaccacactttgaactttgaattgcttcctcaatcctcatcagtggagagagagacgagcaaagcagagcagagagagagaaggcctgcgccggcgaagcctcgagaggaaaaggatgctgcgcggcggcggcaccaccggtggctcgcgacccgcggcgaagcaccaccgccgctcgaggccgccgtcttcgccggctccgtcgtcgcggcgaggtgaggagttgttgaccgattcgtgcgtgctcgcttccggttttttttttttttctgttcgactgagcaaactggtttcgccattgcccttggtgatcgattcagcggcacggacggcaaccacctcaccggagtcgaagggcgcgacggcgttgcaggatccggtggtttcctccatggaagagacctctgtaagcacaccatttttcatttgagttttaccttcccactgtgctgcgtgttgttgccgtaagcttactatgagtagtacgtgctaatgtcggcgagcgagtatggcgtatgctttgattcgtttgatttgcctgtacttttgagtagctctgtttca

SEQ ID NO: 57653 - DNA, 773 bp, Oryza sativa
tgtgattgcctcacctgagctcaatttggtgataaagaaaattgccattctgccgtccaatacactgacaccacatgtaatgtccttgatccaatcttttatttctgcttgacaaaattgtatatatgtataagtactgatcgatgagcagtttatagaaagatcagtttagagatgaatctataagctagtttatgcattgactcattgctatattctgttcctgtctaggttcagagaaaaaagattgagcttttacttggattcacacgtacatgtaccaacaattaatttcttttttttttgggaagtgtatactcctgttgctcaacagaaggatagagaacgacgtgatctctatttattagggccatgcaattacagggtcaaaaatatgtttttttcaagtgcagtgcgtggggagctatctagctatggtaatctccgttaaattgttgacaaaaaatctacatggatccaatttcagttagcgagaagagatttactctggtccaacaaaaggtatctcgaggtaccggtacctcatggtaccaaatcgtttccgatcgttggatctagctaggtaggatggatattgttatattcaatgattagaaatgatttggtaccgtgaggtaccggtacctcaaggtactttttgttggaccggagcaaatctctactgagaaatatgcaatatggggtaggtggatcactacttcaactctacaagtaggggaaagtatattgactctcaaggggacgtcccctca

SEQ ID NO: 57654 - DNA, 5849 bp, Oryza sativa
gagggccgcgggagaggggaagatgggccgagagaaattcggcccatcgaccccgggggaggcaaaatagacttttgcggaggaatttgatttggaaagatttggattcggatttgaacttgacgatagatcggggattgagatcttgagatggcacggaccctagacgacaagcgaagaaacaaatttcgcaattagggtttttaagagataatttttccgctaggcgccacgacggaacgggcgctacacctgcagggagaagcaaccagtacggaggctgctagtaacctgatgggtagccccctcatgagcaatggattgtctaagttggaattgtcgtggtatggggaatgccgcgacaattcatgacctgctcgctttagttaaatagcataattcccatattgcttttctccgtgaaactaggcaaaagttggatcgtgtttgccgtctctgtagtagattcttaatggtagccttgccttgttttggcatgaacaaggaaatcaaagctattaatgaaagatatattaatgcgtatgtgcgagtgtcccctgttgcgcatttatggagattaacttgtgtctatggagaactaaggggttgtttggtttgctcccaaagtttgctaaaggttgccacacctcatgttaggcaagtttgaacaagttagcatattatttggttcatagccatacttatagcaagattccttctcatctattagggccccacatatcatcaactcactaaagtgtggcacaatccaattttgctagctaaggtgtggctcactttttgtaagccacaacttagacaagtgtgacataaaaagtacggtgaatggtggcaaacttagtatagcatccaaacaacccctaagaacagagaatctctatcgtatgtggacgcaattaagcttcatgatacttacttctgatgatctgatctaccgtggattgctaattggcgattttaatgaggctctttggcaggaagaacatttgtctgctacctccagacccgctgcacagatgcaagcctttcgtgatactctacaggtctatgagattggtaatcataacccagcaaggaaggtgcagaataaagtgggtggcaaatctataatggtgtatgggatgaataaatgatacggaatatatattttcttgcctgccgatgctgatgttgtattgaaaatttgtacgtcacacctcgacaggaaggggatttcgtcctagcctggcacccagagaaaagagttcggcatataaattagcggtgagtacaaagattatggattcgggacatggggaatccagtggcagtagagacaaatgttctgcatgctgttcaaaaaaaaaatgtttcactttatatggattaaatgttgcagtgacttgaaatatttgctgaaacattgtttttatataaggtaaaacagctctgatttaaacgattaaaatattttcgatctacctagtgaaacaattccgatatacttggtgaaacaacgtgcaacatttaaaaataatttaataataagctaaaaattttttcaccagaatatatccatgtgtggtcttgttttaaagatttaattacaacggatttaaaagtgcaatcggatcatgatttggataaataatttaagagaaaaaatagtttaaatagtttttgcatgtatgcatgcttgatgacattggatggctgatggcgtgcgcgtggatcggacagctcatggatgcgtccgatttttcgtctcgcgccgtacttccgacacgtagcgttctccagaatactttccatgcgctctgccagtgtcttcatgcatatgatcggtggaatgcaatgagggaggtctggatgcttcctgcacatgaggatgtgaagtatacctggaaggattgtctccttttaattcttgcgaacctatctgagctagagcaggcttgtactttaatattgttgtggcacatatggcatgtacaaaatgatatcactcatggtaagtccctgccagtgaaagaggcgtcgaagaacttcttgatgagctctatgaactccttaatgctgatagatacagcaacatccagccgctgacttgaagaatgggaagcaaaagtggtggacacaacttacatagatgggacgaagaatggacatattcagtcaacaagagcaaacaaatacaagacatatcgtattaacagttcaatcgcataacaggctcgatcattgtttgcggagtgcttgcgttgtgaagagatggactaatctgttggatgattacacattgttatacctaatttttatggcctatgaccagagttaaacctatcggtttagccgatttgatagggcctcaccgaaatgccgaaatttcggtccgaaattttgaacaattaaaatttagttgaatttgaacaaatattatcaaaattcatgaaaaaattaaaaaattttggccgaagtaatatcgtatcggaggggactggaatttccaaccctgcctatgactactataagggagtagggggtcttggggatgtggagtgacacggatcgtagctgggtcaatcgacccactgcttaatgggtagatccgtccttggaagcaagtaattgatcaatcgagcatgcgccggaagttagctcctagtcacagacctaaatctgatttggagttgcactagaaccaacctatgaatgggtgggtaaagctgaacgtggatagctccttcagtccttggaatcgtcgtccgtgactgtagcggcaatgttatcttcatctcgcgcaaagccatcacccactgttttgatgcccttgaggtggaattgatggcatgttgggatgggttgtcgttaacgctacagtggaccttgttcccaattatagtggaatcggactgcgatgtagcaataagatccttgttaattagccaaggaagatgattactccaggtgggcattcttgatctgggatacaacatatttagtctctgaaaagagggccattaaattccagaagattagccgcaattagaatagaattagtcatgaattagcacagctctagggagattaggggtgcaatcaggcctaattgttaggccatgaaagcacttgtgtctcccagctcatccatgaggattgtactaattcctatcctgattaatgatatcctcttttccccgctaaacaaaagaaactgtctatagaaactaggaaggcatgtatatatattcaggagcttgtccagctaggaatacacatatactatacgaccatttttcgctgttacctatcttactgttagggttataaataccatatacctaatagtaatcgattaaacttggcggtgcccaccacatatcaagtcttatacagaatcatacctcgcatatagatggagttccggataagaaaggaaaagtagagttctatatggaaacgataaggactactcggattgtagccacattggtcttcctagttctacttggacaaggggcacctatgggtataaatacaagcccccctaggaggagaggggacaagccaacacacgccagatctcgacataagagattagcctagacataccccatccgatgcctacagaggttggcaagagggatctagcgccatctctgatctcgacgaattcatattcaaggaggaagactaccttgtcgtcgactacgagttggttatctatgctgccaagtcgacaacagttagatagctaggttaccctaattattgtactcgtgtgattcagatgaataaaaacaacaccggcttcggccaacaggatgtagggctattgcctgtcagataaggggcccgtatgtctccgtctctttaacctcaatctcgcatataccctggtaccgatgatccctataccatccaaataccgtagtcgcgatctcgaatgtcaaacagttagaatgatataaacagacaggaactggattagaagtgaagaaacagatgcccttacgttttctaaacgaacaaagaaaaaaacgagctgatttcatggtttgggcatttaacttgtgactggtatattgcaatcaagcagttcctagcaaaacctcctgttgctaatcgctatagatagcccaagattgacaccgaaggtacaaaacagtgttgaccaacaatttcatgtcatttgcctgcttaattttcactccttccaccaaaaaagaccaaagcaatgtcaagagctgagcagttgctcattgtgcttccccatcaaatgacttctgccaaaccgactgaataagcatgagcttcaagagaggatccaccagggccaccaaggctattcatacatcgcatttatcatggttatctgcaagaaggtatagtcagcttacagcaaataaaggccatctattcctcaaataatttctttcaaagatggaaatattcaacttaggggctttagattaacagaaaaataattaataagaccatcagaacaatctcaaacatcaaaatttgtattctttagcttcagatcgactaccaacttcccctgtaagcattcagaatggattaccatacccaaaaaaaacaacctccatagtccataaaggaaatgacaacagaaaacacatccatgggctacaacaaaaatgtgtttagcctgacataaattggttttggtgcactaacctggtcacaaactgggcaagtttcactccgctccatccactcaagtatgcagcaaagatgaaaatgatgctcacatttagtcatagagcggggattttcttcatcatattctggtgaataacgaaaaactgttattacaggaattcaattgagattgaagtgataatcggtgtattagaggatcatcacagcacatgtacatcagaaaaggaagcaaacaatttatagaagaactcataaaatgttccactatttcggattctctatctacaaaccagtcaagtgttcaagccatcgttagtgtcgataatcagtttatatgattacagactgctgcgtattgcgtgtaatgcacgaaaacaacaatcataggcccatagcactgccagttagacagttacatatttggcagactctaggcattcttttcagggatttatcattatttcctaaccatttgtcatcacacccaactgaatgcatcttatataagattatgttctcactaaagtgaactgacctattaagcaaacaacagtgggaaataagagcagtaaagcatgcgtataccaaccaagtaaacatagtttaattaagatcctttcaaattgaaagtaaattatcctatgctcaagagaaacagaaccttcaagacagattgggcaaacatcctcctcatcaggcttatcttcagagacacatttttgcaatgactcattatcatccatcattaaggactccttatgttcatgaattttcctcttgatgcctgtcttctccaaatctacataagaatgtggaactctaagcattgatccataacatggagatcattaagcattgctcattctcagagataatcaatttttaccagggttatctttcaacactagaccaacatcataaggcaaaggtgtaggtggtgctcggtaagtgtcaggagtggatgtatccagatttttgtctattgcaacaattgtagaggccggattttgttgatgctgacaacacaaggtgaagaatatcagtatccttgagctaacttacatgacaagccaaggatttacagtagaaaggctgacgagtaaaagaagccatccccatgtcaacatactaataaaccgtaattctttaaaaatgtatgcaat

SEQ ID NO: 57655 - DNA, 8775 bp, Oryza sativa
aatctgaacaggccccaaatctctcagccacctcctccaccacacattccctttcattctttcttctctcctcaaagtctctctcttctcaaagcctctacacaggagagttgcaagccatggcgaggcatcgtctccgatggccgcacggcggcttcgacaatggagcaaggtgacgcgtgataggaaagaggtgctcgacctcgccggaggccacatggcgacggcagggcaaggcggtgcgtggtagggaggaggcaatggacctcgtcagcggccacacggcgggatatacagcgcagtattgaggaggaggtgctggacctcgctggtagccacacggcggtggggtgtagacaacgtaggattgggcaggaggcgctgaacctcaccggcggccacacagcagcggcaacaatgtggcagaggtgctagatttggctgttggtgagaactggacagcgcggctggtcttaggtgaggtcgcccacctcgtgccgctattcttctcccaaaagcatcagttacttggttctagcagctatgggtagaagaagaagacgaatgtgggttcattgcattggagttttagtgatgttttagcatattgtttcattttgttgcactttattgtattaaggtgtttcattttgttttgattcagtgttgcattttactgattctttgtgttgcaaccagcctatttcaaattttgcatttgattgaaacaattttgttcaagtaatgaaacatttttcctcggtcgatgaaacatctgaaacatttttcatcgagtggtgcaacatgtgaaacactttgtgataatacagtgcaacaccatctgatcttttgcaatagatcggacgtctgatttgtagcagcctccgtacacatcgcttaagaaattgcccggttaatcctaccataagtgtgttcagcaaaaaaaaagatgtccattattagcataactaggaaaatggcccgcgcattcgcgcgggcatgtgtcgtaggctatgttaatttgaacatatgctatatacaatttctccataaattgtttccatcagcattgcttttataattttctaacctagctattagttagctttatagcaaataatatttaattaatccctacaagtaattatttataatcttcttcatcatctaaaaaaaaagaaggtagacttattttatgttagaaacatgtataccaaattaagtgtcatgtcaaaagtaaggtgttttttaattgaatataggttatcattgtttattgacggatgaattgatgtgatatgaggctcccctaaatgcatgtgtttatatagtctaatataattatgtagtttaagagacaatccatatgcgaatgttctgtgtagaatatgtgggaggctccaggcaacctagcgtgaatacagttggatgaagaaatatagttgcactatatatttttatatatttttttttgaacgtgatgcatcatgaatacacacttgtttttttaagatgagatagatgtaacggatgaaaataatgggttcatcggtttaaaaggcctaggagtatatgcggggtaatataaggcgcctttatactaaaaagcaaccatctaatcgacttaaataaagtttaggacactttggcagaagatcgtttggcttgtttgcattatttgagcatattaattgcaaaaaatatcatgaattaatcagattcttttatctaagtaaaagcaccaatttttagacaattagacttgagtagttatatttcttatataatgtatatctaatttaactctatttgcaaaacaatgcacatacaatcagtgtttgttgaattttttattcttttatggcaatttgggtgattatccctatgaattgttttctatgtagtcgcttgaaatattcatgtttcagctattttttgcgaactgaatgtctaatttagtcatgtagggttgcaaaataatatatgatggtgcaacttatgttgttgagttatttcatagtttttaatggaaatttgaataacatgtaaaaaggaagtgatgttgtgcatcattaaaaaggattgatgtataattacgaaatatatgttgttaatgttttttttatattccatcgctatttggataacctgcaaagtgcacggtagaatgtgaccaaatgtcatatttttatataacaaaatataggcacatggatcttgaattgtgctttaattataaataaagcaacaattatattagaaaattatatgcatagcttaaaactatggtattttcaatatttgtttatctctttattgtagtatctgaaaatagggaggaaattggagaggaccaatagctagagatgggttggcagtgtaatagtgttgtgcatatatgattggatagggtggtggaggggacattgtttttctaatgtttctaaataatgtaggtgagaatttgttgttttctcattctaaagatctttaagagatgatatatatgtggaggcttaagattgttgtatagagaaagaagatctaatagttaaaaataatgggtcattgatttaagtgaaaaccgacagatagatgtttttttcgttgaattctattttttctaacttttaaaatgtgatacattatgacttaatagcgctatagagcacgctaagttgatttttattatgtaaaacgattctaagactacataatatataatttcactttttttttaatgttttgttgttagtgggtgaggagattttgttttttatagaggtagatttaatgagttcgtcggttttaattatctatatgtgtcaatccaattgttaaattataggtcaccaatttaattgaaaattgttggtttaatatttcttctttataataacttttagaattaaaattgttagttaggaaataggaaggtgagagaaaggattaattattggagacagaggaagtgtacgaacgtatgtgcgtagagtggtgggaagggtgggccagtggtgagaggatagttgtgccggtggaagagaagagaggaatgtgggttgtattttttgtttttgaaaaaataaaatctaatagttaaaaatagaggtccaccgatttactataataccacgtggtagtttaggagtgttcataggtgtatcacgtgatagtatagtgcctttgtaggttaatggacttttactatagttttttttaaaatggtaattaggacaacatacaaagggtagaagtctagtccctagaaattattcctttacgtagaaatttacttacgtaaatttaccatggttgaatctatagttttttttaaagacaccatcgatctaattttgatgggtccgcaaatttgttgattatttaggatgcttgttgtttagcgagtaaaagaaaatagtgcacacctgcatttgttgaagacctaatgctaatttcattaatccctagctgattacaggttagcctatttggataaccaaattaggctgagttctttacctcacattcctaactttatctctattaaatggtgtcacaatcctaactcatctctattaaatcgtgtgtttttttaaaaaaaatctatataaaaattgctttaaaaatatcatattagtactttttcaaaaaaataactaataattaattaatcatgtgctaatgtacacgtcgttttacgtgccggatagacggggtttccaacccctccttctgaacacagcctaaagcaagcagcacgcatgttgaaagcctagctatttaatgttttgatttgtcggcacatcgttgtggtgttatcgtattactctaagtttctgtatgacagtacgaggttgtaagctagtacatgctccctctctactcataaaagaatagattttcaggatagtatttaagtcaaaccttaaaaatataaattatgaataactctcaagttgttgttgagtttgaaaatgtaaaaattatatgaatagatttgttttgaaaaataatttcataaaaatatacatatatcacttttcaataaatatttttatagaaacaagaagtcaaagttgtgttttggagatcatgtcgctatctaaaataacttccttttataaatatggaggaagtacagagaggggaagtaccaacacagagacagagaggagaaacgcacatgtgtgtatgtgcggcaggaggatacatacgtgtgcctttgttttgtttggaaatatattaatttggtccaatatccggagaagtagaggaagagtgtacgtatttaattaggtgggccagtgtggaagagaaaaataaggaggatcgtggagtctctttttttaagataaatctaatattaaaaatagtgggtttaccgatttattagattgacacttgtcagtttaagagcgtttgtaggaagccacgtggtggcttgagagcatttttaggaagtttaatagaactttagtagataatagatagatcttccgtggtcatttcgaccttggcgctttccgaacattgccataggcaaaagctaattccaagactttttttttaataatgcactatgaaaaaaacacgtgtgttgcaacatggaaaaaaatgaattatgttgtatgtactattaaatttgtaatcaaactaatttttctttggtaggtttaataataattttttatataattaggagattaattaaggtggggctgctaagtactttgaacttaggtattaaatttgtacattcctggacattcagatagagactgctcaaacaagataaaaggtgatgataggcccttcagattttcagaagagctccactgctcgccactacgtcagtttgaaaggtggatcaagaacagcatcttttatcccacgagtacaaaaagatgtggtgatgtaggtgggggataacaatcaaacacagcgagaagatcatccacacataagcgatatgatccctgcacttcgggaactaggatcctaactggaatccgttggtggctcgtcaggtggggatgaagtaatcatgtcacaccgtaaacgctcaacttgcctaacaggagaggtgcatttggaagtgcagaatccttagaaggccatagtactgtttgagggggtgactgaaggcaaatgttcaaacagtagcagtgcgtcgtgaaaatttgaggagcctcgtatgccacctgtgcaggagaacgcccaagaacaatactccacagtgcagacacatgattcacagtgcagattgtttttaagtggagccctccagtctttattcccttttacttttcatctatcctctctctcctctagtcctctattcgttcccaccgtcagaagagatatgactcaagcagcgacgcctgggcggcccaagcagcgagcagcagtgcggtcgtcctcgcgcggagccgggcggagcgccggcgcgagcgagctcgtcctcgtgcggagccggatggagcgcctttcgcggagccaggcggagtgacggcacggttggcgagccctggccggcgtagatcgaggggcagcgcccggccggcgcagatcggagggcggcatggccggtgccgccgctcctctttccccgtcggccccgccctcacctcctcctcctcctcctcgctcctctcccctttctcctctggcacgtgtgggtcccgccacctgagacgaggaactcgtagccaaaacttgctccgcgttcttgaggaggccgcgcggatggacgacatggcaacgaatattcggttttggggaggaaggctgaacaccacatcggcgcactgtaaacgctcttagaggtttgaaaagaataggacttatgtgccctgctgtcacgccccgaactagtcctgaccagaactagcccgtgacgctccaaattaagctgttaatcgataccagtcccaggaaatagtgctggtatcacaggaagacagaatatcacagcaacagcggtctctttattatagagtagaggtacagtcatgttgggctgcggatagatcccgagctcacaactgcattacaaaagggaaacggaagccaggacttggaccaatcaacacaggcgcgacttgggaactaggccgaaaccctaaaactcatcgtagctggcttgctcctggaagaactcctcatcaacaggatccgcttcatcttcttcagcaactgaggggggggatatttatatagagcaagggtgagtacgggagtactcagcaagccatgggaattaagtgtttaatgtaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccggccaacaactttcaaacggccacccgggccaacaactttcaaacggccacccgggcctagctgatcccgtcagctgctgatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcggggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctggatggttacaaggggacatgatataacaattaacaaagggaggatcaatgcaacaaattaggtaggtccaccaaactgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcacaacgggtcttcgggctccggaactacacgcgaaacgggacaactcaacaaacggcgaaaaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagagggagggaaaatagacttttctcgggcggctagggcgcggcccaagagaattggggcggtctggccgagctaaatgggccggccggcccaagacggtcgcgcgcgcgggagggaggagagagagccggtggaccgggctcaccgtccgcggttccgggtgggacccgcttgtcagcggctcggctcaccgagcggagggagtacgtggcgcacgcgcgcgggcgggggaggaacgcggtgcatgtgcacggtctgtggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggctggcgggaggtagacgacgacaccggccggaacggacggcggacaacagcggcgagcggcggagcgaaccacggcgataccggcgaaaatgagcacaccgggtggttgcacgagacgaggggagacgagccaacggctcggattcgccggaggaagcttgacggcggcgaatcgcggcggcggcaaccggcggggagggaagagggaaacggcgacgaggtcacgagcggccgattcccggcggtgagagcatctacgcggctacgggaatccgatgttagcgtcggattgggcggagctacgccgagcgaggctggcgacgagcgggtgctacggagctcgagcggcgatggcggcgagcacactgtgggggcggcgccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccgaagtccccttccgcgtccttgctcgtgccggctcctccgacacgcgcaacgacgaacggcgatggcgaaacagaggggcggcaatggcgcggaggtgaatgggagaggaaaggaaaaaagg

SEQ ID NO: 57656 - DNA, 13102 bp, Oryza sativa
ctaccaccctcagccagcataatctgcagactccaattcggagccggaaaatacataagatctgggccagaaaccacattcacagccaagctcttggcatccatgttgaactcaaggatgcagttctccacgagcagccagtagagaacattcccaacaagaacaggaggcttcatgtcaatggcagaaatcttttcccccgagatggattcatcaagatgtctaagccctaatcccaaatccaaatcgtgggggatcaccgtcctcccacagaccacctcgccccattcgccggaaagcgaggagtagacgcaggcgcaggggcggcggcgctggtcgatgaaggcgaagaccacgcggaatggggtggggcggtggcactcgccagcgtcgcagagcaaggcggcgccgcggagcaaggctcgccggagagtgggtcccagaccatgaggaggcggcacaccgagaacggcgaggcgaggagcgcgcgcccgccgcggcagccgaggaagagccagcggccggggtggcggcggagggagaaggcctcggcggggacgcggtcgggggctcgcccggtggggacgaagcaggggacgttgaaggagttgtggaagaagccgaggaggggagctcggcggcggcgggcgtgggagtggaagcggcggtggaaggccgggtcggagacgaggcggcgccagcgcttgcagaccagggagaggcaggggagggaggaggggtcaggcgggaggatgtggaggatctcggccagtacgtcgtcggggaggatggacaccggcgatggctcgtcgccggcgtcgccgaggcggcggcggcggaatgggcttggcaccggcggcgggtccatgacaaacagttgtggactcgaatgggaagttctcttctttaggccgggtttagtccaaaataattctttaaactttcaatttttccatcacatctcaatttttctacacacataaactttcaacttttcaatttcaaacaaactttcaatttaatagaaaatgagtagaaaacgaaattagcttgagcaagtttggattccgccaaaattaaaggatcggagaaggctactgcttgtctgcttgagcgcgcgctcacgacggggacagttaaccaaggttgtcattatctgattcgtatagtagggtttgtttgggacggataatctggtaaaagctcgtggcttttagtttatcttatggtttttataacagaatctgaaaaaaaaaaatttagggagagcttataattgtgagagaagcggtagctacctgccttcactaaacaaacccgctgccagtcttcactaaacagacccttagtattttacgataataatatcctatcaagctgaaacataccgatcttacataatattctaacttttatagtatcccaatctccacacaattctataaaattttaggtagtatctcgatgttagattcctacaatcctataaaatattatttaaaataaggtgattgaaaatagtgtaaaaaatatgctcaaattcacataaaaaccgattaaatttatcaaaaccaatattatattatttaatttatacaacatattatatattttatataaaatatgtatttttaaaaatctgatagtatcttgaatcccgatcctatggtagtatctcgatcctatgatactacaaaggagaaagtccaaataccccccacctcaaaaaaaatttaataaaattggatggaagtccgtttagcattctgaactttgaaaccagatattgaaccccttaaattttacaataccgtttatataacccgctaagatggtttcgcatagtagtttttatctaatttgtatataagtttgatgagtttgatcacataacatacatattggacatatatattaaaattccgatctaaatctttctttttactccttgttagctaccatttacaaacaagtactaacataataattgtatggcataactatataaggataaatttgtgatttagaactgatgatatgcaaatatgttagattagttattcaaagttattcatttaagctttcaaaatatgcaaaccaccatccaaaaccatcttagggtaatatggatggtatggtaaagttcagggagttggatgtccagttttaatgtttttaatgtttagggtgctaaacggacttccattcaatgtttaggcgactatttggacttcttcctactacaaataacaaaacggtcttatataatatctcgatactgattaccttgcatttaaatgttcgctccgtccatacaaaacaaatataattacatgatatggcacaccttatgtgaagcctcacacttttaacactggagataaaaagtgccgaacttagattattatttaacaaactattattttgccaaataataactacactggagataaaagtcaggcaagtctctcttatgatcatgtttgtcgacgtttgatgtcgcaattccggtatttgcatagtatgggaatcgttggtactaggatatacgcgagattgaggtaaaagagatggagacaggatttttatacaggttcaggcccctgaattgtcaggtaataaccctacatcctgttgcccgaagccgatattactcttattcaccataatcaaaacagtataatatttggggtagcctatctaactgttgtcgatacggcggtctgaaggtctgactcgtagtcgacaacagggtagtcttcctcctcgagtccgtgcccgacgagatcagagatagcgctttcgtctctcttgacagtatccggagacaccgtaggggactagccgtgcttatccccgaagtcaatatccgacgtcttgtcttagcgtatgttggcttgtatgttgtgacttctgttgttccttgtatgttgattgtctcttctatggtgggtgtcttatatttatacccataggtgtccccttgtccaagtagaactatagaaaccaatatgaatacaatccaagtagtccttgtcgtttccatgtagaactctggttgtctttccttatccggaactccctccatatccgaagtcagttcccgtataagacatggtatgtggtgggtcctaccaagatttagtcaactactattaggtatgtggtatccataatcctgacaatgttgatagatgataattctatttcaacttaaaaacctatttcataaaaatatttctcctagtattgcatcaaaatatattttctagaatataataatatgaactatgatgatatgattgacaaaccgatgatgatagagatcattgggatactagtatggtgggtagggggagctcagggatatgatgattgatgatgatggccggtcagggctctccctacatacggtgtataaatataaggactaatcatcccctcactcgtatcagagaaccatatgtaccgtgtcgaccatagatccattttaagacgggctggacctagtaccttatcaagtttattatactctacatgggtacgtagtagtaggatgggagatgatataaacctcatgaatgccgatgatgtgcattctaggtgcatatagtagcgcggtggtatggagagctgataggctcaacacaaacatggagtgtaataaattgaagtaggggaaaagttctgtactcttagcatggtgccgcatctagtgaagtgagacagtcaaacatgttaagagtatctatgggtacaatgatacaagcctgcgcgatgcataaattgtgattcacgcctgtctcttggattggagcctaccgggagttgctacaaactctattcaatgttacgagtatactctagcttttatacgcttccttccgaaaactcttttacaaaacagaaatatactttacttttgatgacgatgaaggtgatgatgttacaaaagtatagtgttatagtatatagatttaggggctgctcagattgatgccattttcaatcatactatttttttttggcaaagttgcaaaaaaatgtctacatttggtttgttgcaaaatttgatatatacataagaaattctaccaaaattttggcaatattgccaaaatttggtaaggtttattttggctacaatctgaacagatcttatatattattattcatgcatatacattttgctttcaatgacttgctgagtacgaaagtgctcacccttgttgtataacccctttgtacaggtttgattccttgcaagtgtaagatggattagcgatggcctttaggactctcagggacgaattaaaaggtagttgtaactcactactagaaaaaagatttttcatagcgttacattatcattttcgctgacggtcatacacgaaaaccatcggcaaaaacataacgaggggtgggggggctacggaccgctagcgattttcgctagcggccgagttaagcggaccgccagcgaagatgtgctattttccctggcagtccactttggtaaagagcaccgctgcaaaaaatccaccgcccaccaatatttttcacgcttctccgcctctctccctcctctcaacgcctcgctaggcgggggtccaggggcagtgactcgcgaggcggggtgtccggcggcggcgactcgcgaggcagtggatccggcagcgccatgcctcgccgtcgccggatccgccgtcggcacgccttgttgccgccatatctcgtactaagtttagtttatagggacaatgggagtacacaaataaattattccatggtcaatactcctcaatatggtttgaggaggtactagggtccacttaaacactacagaaaaaaagtgtgaattaagagttgatggtaagtgttttttattactcactccgtttcaggttacaagacgttttaactttggtcaaaatcaaactacttcaaatttgattaagtttatgcacaattatggtaatatatataataccaaattagtttcattaaatcaacaattgaatatattttcataataaatttgtgttgagttgaaaatattttttttcctataaacttggtcaaacttgaagcagtttaactttgaccaaaatcaaaacgtcttataacctgaacgggagtataagcgtttcattatgtctccgtttagaaaaggtcaagcggttaccattggtattgtcttgcaaagagctttgccgtctaattctccgaaaaggattaatgcatcactggttatccaaaagctgattataagccataatagcttattagcagaaaaaaaaagtaatctacgtgtaaaactcttgtatatgtatttttagcgacttaaaatctaatgccaaaaaacaatgttgaaaatattttaaaatcaacttcaaaactaaattttggttttcacttattctttttagtaatcgatggggctgttagtcgaaatctactatgtaggtactatgttctatattcttattatgtatctccattctccactcgatgtggccgggaggcgcccccaacagatttgccccatgctggaaaatagataaaccacatctactcataggaacacgctctttgttcctaccatcacgattgtgcctagtgtcaacatcagcaaaataccttgagcaagcagtcaagcactcatttgcgacatatgcctctgcaatggagccctcaggccttgccatcttcctcacaaagcgtttcaaggtcaacaacctacgctctacagggtacatccatccatattgaactggaactcttaggattgcatcatcaattaaatgaatgcacaagtgcaccatcacatcaaaaaaggcaggcgggaaaatcttctcaagcttgcacaatattattgggatttcacctctcaaaggaaaatgccttagaaccttttctggaatctgccttcggctatctgcatccctccatcttgaagcaccacatattgggcatgcatccattttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtccaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgacttcgttcttggtccatgattttgatctgggtacagatcctgtaccatacggtacatttgatcatcttctgggtcatcctgaggctcattcgtctcaaattcaacattgcagctaacatcttcattcaaatgctcaacattttcagtgaccatgaccaatggttctccatgatgtatccaccgagtgtatgtgttagacatcccgtacataagtaagtcatcctccacacgtcctttatattgatgtaaccattcaaacacttacgacatgggcataatatcttctgactgccactcaaatttttagaaacaaagtccatgaactcggtgaccccctccggatgctccttgctaaacaacttacaattcatccaagttctttccatctgttacatattgaaataagacaagcatcgaatcaatgactgattattgcccagactactattttcctatttctatcacttcaagtctgtggtttcagttcaaaatttaaaaccaaaacataagttcttctcatatgtacctttcttcctaattgaaggggatggggcagtctctggtcgacctcacccgccgtctgaagtgatcccaggctagagctcttgggggcttcctagcggttgagcccgtgaagcccggcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggacggggtggggcttgggatccagccggcggtgccgggctccagcagccgcgttgggcgaagggcgacagcgtcgagctccaacagccgggcgctacgttggggacagggtggggctacagcctgcgtcgtcgggctccagcaggagcaatgggaaagggcggcggcgtcgggtccatctggcgcgatggggaaagggcggtggcggcggcgtcgggtccagcagccgcgatggggaaagggcagcggcgtcggtccttgccagatgtgcgttgggattcttatgtctcccagcaatagtgtacaagatgaaaagaatcaaagattacatagcatcggaagagtagctcagtggtttgtttcattgtttgtacttgggaagccagaggacgtgggttcgattcctcctcattgcaagaagtgctacaatttttattcttttcaagttaatattacattttttattcttttcaagttaatattctaaggtcccacatgtccacctagacatgctcacgtggctgtgccaaggtgttccttttttttaaaaaaaaaatgatttttaaattatgacaatcatattcattcgcttttgtcatgaactattgtcacaaagaatgggaaaggcacatggtgacatttgtttatgactaaattacaacttagtcacaaacgcttgtcattcaaagaaaaattgtcataaacgcatcactactgtgactaaaatgtgttttgtcatatgaaatttgtcatagaaggccaaatttcttgtagtgcggtggaggtatgtttgaagtgtatagtggcaaagttgacattcggtgttatttagctatccaaattgctagtctattcgttgtgtacatttacacgattaatcaggcaaagaacttacatttctttagaggctacgacctcgaaatgattacacatcggttcacattgatgaagcccataaaatatatttcatagatgcatatatcatataaattttgaacggttggatcataatctaaaggctagattgcatccatgtttcctacattcttttaacgaaccggtatacgctggtggagaaaccctttgtagtcccggttcgtaacccccctttagtcccggtttccaaaccaggagtaccaatccgggactaaagatcgctatctttagtcccgggtgaaataaccgggagtaaagattgatctttagtcccggttggtgttaccaaccgggactaaagatcgagctgaccttttttttttttgcatggccctgttgctgcatggtttatatatatatatatatatatatatatatatatatatatatatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcatagtagaattcacccttgggatcaaggatttcttcgttgatgaatgccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagctgcacaagttagttcctgcttttgctttgcgcactacaaataaatgacaaacaacgagagatctaattaatataaacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgttgggccctttgaatctccattctacaacgataaaagggagtatattattttctatagtctacttatatacaaggacctaattaattaaaggagacgtatagtaagaaatctaactgaacgatatacttacaaaatccaacaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcaacagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatccagaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcacagctgctacggtttcctgacgggctcaccattgcaggaggaatggtcggctggggatcatgggaccgatgtgcggccatgcgttcatcaaccttccttgccacctcctcttgcatgttgagttcgtagctcgatacccgaaactctaggtctgcaatcttcgcctcggtatctctcttgctcctcatccgactccggtacgtgtggatgtcctccttgaaaccaatcttccaaggaatcacccctttccctcgtgttcgtcctggatgctctggagtctgcagggcgagtgtcagctcgtccttatctctgtctggtcggaacgtgccctgagaggaggcttccactgcatctgttagtcgtcgcgcagcctctcgtatctgatcgccgaagaccagtgagccatcggctgggttgagcgttccaccgtgagcatagtaccagaacttcgatcgtttcggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcttgcccttgttcgcctgtcttatatgcaacgaactcgtcccagtgatcccttagctttgggaatgtgtcgaagttcagtgtctgccccttcagtatatacttctggtacatatctcccttgaacctctgaaactgttctaccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccatactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtgtatgctaagtgtttcgtgcgtatatgctaagtctaattaagactacaatagtcaattgctacttgtcgcaccaattccgtagtcaataattacatactaagtctaattacaaataaagtaatattatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataacattagaacactacacaatcttatatgataagtctaattacaggtctaataatcttaattaattgcattacaaatataacgatcatttatattattacgtcacttgcctgctccaattccttctagggctagctcttccactcaggtttgacggacgactctgacaacacgtcttttctgcaagatacagaaagatgtattaggataaatgcgaagtaacatatatatatatatatatatatatatatatatatatatatatatatatatatatatat

SEQ ID NO: 57657 - DNA, 23488 bp, Oryza sativa
gcacggggcgacgccgacggcgtggagttcatggcgacggtggcagcagcagcttggtcgtcggcgacagcacggtggctggtcgatggcattgccggctgtcggctgcggtggctttggggttctcatggcagaggcagcggcgcggagctcgttgtgacagttgcggtagcggctggacgacggtgatggggctgcggctagccggcggcgaggtggcgtcggcagcagtggctgcagtggtggtgggaggtggcatggtggcctcggtgggctagccgagggcgtggcagacggctgcatttcgccagcgtgggagagtacggtggagaggtcggagaccggcttggcgcagagaggcgcagccaatggcagcggaggccggctcggcgcgagaggcgcggccgatggagggaggacagattggcgtgagaggtgcgtctggtggaggaggtcggtttggcgcgagaggcgcggccggcggtggaggaggcgaccctggtgcgaggaggagctgctggtgggtgtggcgcagtcttcggcgcacgaaggttggccggcagggggcgccggtgcgggggtcccacatgtcggcagaggatgagtggtggtggagcatcggtgcgtcagccgtggattcgcaggtggtgaacggcgggtgaaaacccagcccggccttggctgggccgacaacgatggttaattccccctcctgagggcgttgtcgtgttgtctcacccctcaagggcggttgccgggtgaaagcccagtcttggttcctttgagccccgacggacggcggcggcggttttccgtcactcctctttttggagacgtcgtttttggcacccccttgcgtagggcgatctcgtctgtgttcctttgttggtctagcggcggccggtccggtgctagcctcctcctggtcgtgtgtgttggcgttgtcggtttgtggggggatgtatattttttcctttttcctgattatgacccttcagggttgtaatcttgtaattttttcctgatttatcaatagaacttcgcaccgtcttgtgcgagtcgttaaaaaaaaatcgcaacggcttttataagttaaaagaaaaacgatgaaaagatagatctagaaattagtaaattcaaaaggaataaatgacaaacagttacgaacgaaccgaggaggtcgatgctgatcttgccgtcggagaacctgccggtggccttgccgccggggaagtctcggccgtagggagggaagttggagcggacgatggtcgggaggtagttgttgttgcccgtgtccacgatcgagtcgccgaacgccagcaccgccggcaccttcgccgccgacgtccccggagccggcggcgctcccagaatggcctccaccgccaccgctccggcgagtacgagcacgagcaggtaggagattatcacggtggccatggctggtaatgacagtactgatgaactgatcagaaatattcagatcgtgggttttacagcttaatgatgagtgatctgatcacaactctcagtgagtggagaggctttgtccaggtgagtagaggtagttgcatgcaaacgcaagagacccggccaatctgcacatttctgtgtcttttcgttttagagtatttgagttactatctccgttccatgttacttgtcgttttgatttttttcttgttttatcattcgttttatttaaaaagttagtgtaaatgtaaaagaggataagttatacttaaagtatatttgataataaaacaagttatagacaaaataaataataattcaatttttttgttaataagaaaaaatcaaacattagaaaaaaattcaaaggggcaaataatatgaaccgaggttaggcatcgctcaccaacccataaatagccataaaattcataagtacagatctaggctagacatgagacaaccaatcgttgtttaatcttccaatttcactattatgcaccccttcgtcctgagcacttgaccgtttatttttgttacttttcgcttgacactcatccccttccttgtgtaagggtgtgtttagttcacgtcaaaattaaaagtttcattaaaattgaaacgatgtgatggaattatgtgtgtagaaaatttttttatgtgacggaaatgtaggatcgaatcacaataactaagccaaccagagggggtgaatggttggtatacccaaaaaccgaaaacttttagcggaaataaaagttaccctcgaaatcgacggatcgcagttgtcctgccggtctgaccacctggttgccatcggtctgaccgagattagatctccggtctaaccgccgagatcagctgccgctcgctgtcgcggccaccggtctgaccgcctcgccaccaccggtatatcgccagttagaccgccgaaacccgatgaaacataaatcgaagaactcttaaagtggatgacgactttattgattttctctgtgtttacaaagtgcaccaacagcactccttacaaaaatttcgactaaactcaaaaccctaactcaaaactctactcaattgctctcaaaagcgataccgggaagcctcacgctccctctctatttatatccgaggtagtcagcctaaagccacgaaccaaactcatactagaagtcctaaacaccttaggaaaccctttagtacaaaaaaacaaactttacataaccaatcgtaccaaatttagactccttgcaaattcgactccgcatcccatacgcacacaatacctccatcgtatgccatatggaatcttcaccaaccacgtacatcaactctagcctaagtatcccgcatgatctctgaccaccatggacgtcgtcttatccccaagccgactcctggtccatcaccgcaaatactctcccgaggcatcaagtcacctacacatgaaataaacaaagaaataatattccgagactaagctatctccaacttgactcattagtagcaaataatagtattacatacgtatagtatccatctagaagccataatcatgaaacaatcatggatatccaaacaaacaacccgaaaccgaaaccgacacagagtcggccggtcagaccgcgggcaaaccgacacagagtcggccggtcagaccgcgggctggtcggtctgaccgcgcgcataccgccggtctgaccggtataccctgcccggtctgaccggtcctgacaaacaacagtccctgtcaatcacctataaattccaatcatctccaaaactacttcgtgaataaattccaaataacaaaaccaataatctctaatgccaatttttcatcacagaataacaatcaaaaacacctttgattttacatgaaaagttagaggtttgaagaaaaagtttggaactaaattcggcctaagtgattttgccggttgctagagccagtttgtgtgccgacatggtgtcatgcgtgggtccatgggcacaccggcggactgctgtcggtttgccctgtgatgtgatgtgatagatgtctacttgacgccttagggtgagttcgctggttctgttcccatccagcacgtagtgaacacgaaaaacggagcaattcattagcgcgtaattaattaagtattggttaatttttttcaaaaatagattagtttgatttttgaagcaactttcgtatagaaattttttgtaaaaaacataccgtttagcagtttgaaaaacgtgcgcgcagaaaacaaaggagaggggttgcgaaaaggggcatccgaacacacccagccagcattcagcaatgcatactccttgcgttcaaagaaaaatcaacttctggaatttgaattttgttcacgaaaaaccaaattctaccatcccacatatcttcagcacataaaagtataaaatgagaaattttaccccttaaataccatttacctacatatcacgtaccattactacttttcgaataatgtgatacattttgggtatttttactccccactaattttacattggcatgttagaatggatcttttttgggacggattttacattgggatgttaggatggatcttttttgggacggagggagtaggtgacttaaaaaattatactccattttgtttttttggttcttcgaggcctaaatatattgattgattgattattacaacatatttggtatggtatgcgtcgattatctttgtcgttcacccagctactattattttatagctacgttcgccactgttggaagctaactaatgtgaagactcaccaaggcacgcacaaattatcgcatgaatcaagataatatttgcaacatcaggggagcaacaagaatattttcctttatttcatttgctggaagcacttattattctcttattaccagttaccgacagcaacatcatcctcagataaatccaggcaactatccaaattaagcctttccctcacagcaaaagagagaagaataaaaggccaaaacaaccgcagttcagaatttcagcaagaatgtgcgtatctccatcggtccaagctcaacaacaagggcgtggctgtcaactgggccacccttcaatggtgcaggatcagttttgctctccccggttactctccaattgagcttcttcatctctgacttcttttggtttgcagataggctagtctcagtcaaatctttgatctgtacaatggatttgagcaaacataattaaattaatgttaggtctcatctctttatgcttataattattttacagaaacaatttctgttaatgcagaaaaacaagggctgtgtgagtgtgacacatcacttactatcctctttccaaacagctttctcaattcaacctttgccattactgaatattgtgtgtcctcttgagcctgcaagtccaccaatataataatgagtatcatggagaaatatagaaagaaatttcatatgaactaaatgtatacctgaaaaagatgcgccaatcgaaggagtgtggtgccatcatcaagactctgaaatgttgagagatgattttaaatgaatttatcaccaatataatgctagaatttaagaggcaagaaggaatttttgtgataacctgcaaggtgatgattgcaacattatcaggaagactatagtttccttctaccgtacttgcttttgcaatattgttggatttccaactgcgttcgtcctgtcagagaaatataggccgagtttagttccaaacttttttttcaaacttccaacttttccatcacatcaaaactttcctgcacacacaaactttcaacttttccgtcacatcgtttcaatttcaaccaaactttcaattttaacgtgaactaaacacaccctatagctgctaattgtagaatctgtaacatgattttttaaaagaactgatacaaaaatggtataaatgtacctcatgtgcaaaagcaacaaggaacggtgaataaacttgttggctatatgttcggcgccaatgagctccatgtcctttcttattgacattgatatagtaagttgccctggcctgtaaaagtttctaccagtcagttgcaagatctatagagaatgtgatatcaagttgtatatcatgaataaaagagagagaaattgttttaaatgaatgtcgtataccactagcccatcgcacttttgatccacacatactacttcattaagtggttccccaactcctctgccatcgtctgcagaaagacgcctgacacaaattattcatggttagatgtataatgtgcgagggagctaggaatataatttttcattccacgaaattatcgctaaatttcaagatgttgtaaattagaaacctacgcagttaaacaatatagtgaacgaacctgggtaggttccaaaaatgatttttcaaaacttgggttgtcacatgaaaggattatttaggatgaaagggtggtgaaaggaaatagattggattataaaagtaacatgaatgaccctggaccttgacggcgcgacggagtaagatcacatcccgagaaggcagagccggtggagactaagataaatcttaatcaaatacctaatgaccagggatatgatctctccttatataaatggaggactccttcacctaatccacctgactctatccaaatgagctacgtacttatcgtgaggtcgtgaggggtgaggatatcgttcccattgggcctaggactcctgtcccaatgcccatgacataggttggatagaaaaggccctttttcatttttgctttggccagctcctctaaattcaagctgtattttggtttaaaaataacagtaccacattaagatataaaagacaacacaattagattggtgtcaacaggtaacagaaggaatatgatatcgagaccctaatggaaaatggtctggtgctagattcagtcatccagaactagatcaggatactccagccaatacctgtggagcataacttcaatctgaccatcttgaatactcgaagctccaacagcatgatccacaaggacagatagttcatatttcccatctgctacatatattccttgattgacctgcagagttaatgcataagaattagcaacaacagtaaacaatgttaatattgttcagaagcatagaagaaactgattgatacatgcaactcaatctatactactcaactggaatatatttcctcagatgggcatcatgctatttaaggaaaacagagagctaaaaggaaaaatgatactctattgatcttcaatgaaacctacccataacagtcaacatttgtaattttttttcttttgaaatagcattaagcacatatcgatccagtttgcacagctagcatagcttcaaaaagtgtcatccacaggcatagggataaaaacactgcattaatatgcatcaatttgcgatggtacctcattatgtgaaggttcaaaaaaaggctgtagttaaagagttatggtggtatctagaaaacctaagatgaatccactatgaaaattttaatattgtacataccgggtagtaatttcctgcaacaggttgagacaaattaaggtcccaatcatccctgtggtttctcacctgaaaatgaacgatgctttctgtgaactttggtataagagtacaaaaattttaaaacatccataccacatgttcaatatgactattaactgtttcccataaaaaaacaatttcgatataaattatgagaccactcgaaataaatatatggagtgcaaattatatagatattcaccctttcgaggaaatctcttccattagaatctgtataaaatattttgttggtggccatatttgttgtcagtctggtaacaacctcctttcctatgtcatcatcatcatcaacaggtattggtccaatctttcacataagagagaattgcagccaattagatgcatgttaaaatatggaatatcattgttcatcccaaacatttatttttgaggtggaagattttactaacagtatattcaacttcagcgtgctccttattcttgtagagtctcgtgacctaaaaagatcaagtgaaccacactatagttacaatcctgatggacgaacgtaaatttgagtcagtttttttttataacctgataaatccatgagctgaactgttggtggacttcgtcaacaagaggtccatggataactttcaatggcgcctaacaggaaataaaatacagaactgtatttataatatagataataaagaggtgcaattattttagtaaatgttttatttattatttatgtacttgagtgctctcttagtagcaaccggagagactacatgcgtaaaagcaacttgatagacaatacaagattatttgtttgattgtcccctgaaatactatactatgctattttagtttatatcttttgaagtgatttgatgttaggtgataatatgaaaacacaaaatattaggttccatgtacgccaccactgattcagcagtaattacttgctgttattcgaaattttaccctcatagaatctaggggaactaatgtcacaggacagtatatggatgataaataaaagaaaaccaaatgcaaatatgagatgggaaattctgttaccattcctgaaactatagtcggtgtagtcctatttggtctgaaaatatatgctccggatgcctgtaattaaccgtagataactgaaacggtcgaatatgtgaataatatgttttgcaattgagaaagttttagtttcacataaaacctgtgaatcttcagaatctcccgtgcttgaagcataccaaagaaagctctgttgaattggcaaatccacctgaaagaaactcactagttgtggtatcgcattggtagatgccatagacaatacaaacatataacaagtttatcactacaaacaaaatgaattcatatggcaaacttgatctattttataattatttcctaggaatggatctcgtagaataatttattatgccatcattttatttatcatgcaagttaagcaaaggagaaaccagtactagctaaatctaattttctaatgtaacattctgcatcaaaataattagacacgcatggataagaataataaattatatgcataatgcatttaaaaagatatatgttgctgcataaaattattgagaaatccccaaaaaatgggcaaatactacaagctcaaataggtttaaataataggcaaaatttgctacagaacactcaaaaaacgtgtaattggctgggagacactgcaaaaccatgatacggctgatggacactacaaaaattgtgtaattggctataggacactggaggcaatattttataatttccggctcaaaataggtgagaaacttttcgaaatagcgagattacccctggcgccgctcctctccagctcgctcgccctgtcacctagctagcgtcgtcgccaccttgctcgcggccgcctcctggtcgtgctccacgcgtgccctgagctcccacagcttctccttggtgcgcgccagcttggtacgcacgtcgttgagctccgatgcctgcgcctcctccaggcgatgattctcctcctgcagcgaggcgaccttcagctccagcagccgcgcctccacggcggtggcgggctgctcaagctcacgcgctgtggcatccggctcccagagctcatcgagctccgccagcaggagctgcagcagctgctcctgctccatgagcgacagccagagctccttcaacctctccacctcctcatcctcctcccgctctttctcctttgatcggtcatcgtcgcgcgtcatctcaccgccggtgcagccaccgtcagcatttcctctggccatgttggcagcggcgggaggcatcacgactctcgccacaatttttggctcgtcgtccccggctccaactaacgtgccgtgaataacgttctccaaactttatcctttcatgccaaagaagaggaagaattaagtgctccatcgcccatcgtcgccatcatcgtctttgtcggcgcctcttcttccgccaccaccaccgccgctgccgccgccgatgaccaacctaaggttagcatttggggatttcgagtgggagaagatggcgactgggtctggttctaccgtacccagtcgtgcatagatgttgcggcaccaggggcaatcccgccatttcaaaaaatttctcacctattttgacccggaaattataaaatattgtctccgatgtcctacagccaattacatattttttgtagtatccatcagccgtgttacgtttttatagtgtctcctaactaattacataatttttgagtgtcctgtagcaaattttacctaaataattttatataaatgaatgatgccaaaatcttgttgagatagatcaaatctatgcaggaattggtttacccaatggtcatcaaatcttatgttgtgtcacattttgatgtaacagccataaatttcattgtgggtgctacaaatattagaggaagattccttcaattttgtaaatagatcttctttttttcagaaataaatgaattttagactcactgcagagatagaattgaacattctcttgagttgtccagattttgatgaataggacatcttcagaggccctggtccaatttctattgtgtcattacttggagaaaccatggttgagacataccccattccattagatcctggataattcgaaggttaatgatgtaaatcaacagactaataacaacaaagttgaatacaacaggtatttgctggccgtgtacatccgacttttagtcttttagaggcgggttttacccattttcttaaaaaaaaaagataaaagaaggtattttgagcacccccactggaaaatgatacaatgtcccgccttatcaacaaaataattatgtttatctgaccaaaaagaataagcagcacttgcgacaggacaattcgataaacctaattatgtcaagattatgaagtttcacctgttccagtagattttgatatgaagtaggtgttccagccgagtggtggtacagaagcttgaaaaactagccaatactttgggggtttatcggacgtgattccaagataagcctttatgtataacttccttaaacgtgctgtcacgatatcaacttcaactagttgtgactccagagaagttccatcagaggtttttacaattaagttggcatcatttacctgcaaaatagttaaaataattatggaatacgggttagtcaaagaagctagatctagtaaaaagagcacatggtttatcggaaatttcgttctatgtgtttacaaagtatattgaagtattttgattaaattgaggtatatttttctccatatggatcattaagaactcttaatctataagttcttgtgtagaccatcagaaactactgaacagaacggttgagcagagctttgaaaaacttactggaactcttacaaagtcactacgttcccatccaagaggattataaacaactataacctgcataggatcatgtcaatatatgaaaaacttaactggcatttcttgtaatagaacagattactaatttgtacttactaaactctttgcggatgaaattccttcctcagttgaagggcagtagctaatattgagaagttggcactaaaaaagttgattgaacaagacaaatagtcacaccagggaaatatgttccaaaattgcatatggaaattttaaaatgttatttctgaaactgttgtgcaaaaacagtcttaacaattaatattaatgattggccaccttttacctttagttgtagaatcgtaatgctgatggaaaatctagaagaaactaatggtaaagagaaatgtgacaaagtactagaatcactaatatttattctttgtgaaaatgtaagcatcataaacaaaatcaagtacatatttatcttacctgactaaattttgttgctgtacatgttcctttggaacttgtgagacaacttagagcagtattaacacctttctcaacctgaaaagataggaatagatattttgctctattataaattatttgattaaataatagtacatcatgataaatcacggcaacaatttctgtagtaaatattatgaacctgagaaaccccaatcgcaaggcgtttcgaataatcatcagttgtgtgttgctttgccgttcctgagactgcatcatgatgttgggcaatccccagtggatcttccaagctagaagtaaacaatcctaaggaacttctacccaccaaaaattccaattgacgcgcagcctgcaggaaaacacatgtcctaaagttaagttattttagagcttctaaatgtctagtttaggattattatttttttaaataaaagtactattttaggcatcatcataattcctgtagttttcgacttgcattgcagaaatatcataccaggtaatatccactgatcattcgaatatatcgcttgaaagttggacggcttgtaaaatatccagtccagtaagcattttttgcatcagcatacctgcaatatgcaatagaatgagggcatgaaggataactcttcttactgatttgcgaagttcggtaacttacgggaaataatcatcgtatttgagtggccatgattcattcgacgcatgttttgcatctgtgtaaatagatggagtagagtacagtgcatgcacacggccatcctgcgttttcagcacactaagctttctttttcaagaagagaaaattacccagcggcttagttattaaaaccagatccagggcctagtcattctggttttgctaaacgaccatccatatgcttgaaccgtcgaaaaccgataaaacagctgttaaaccagggttcaatattttggttcaaaatgttcgaaacctcggaaccccaccccacccccacccccaccactatttctcaagaaaatttcatttcttttgaattcagtataattaattcaaattcgccgattcatattcttctgattaaattgcagaaagttaaaaatgatcagaagagaacataaacggcacacagacagtctgatcgatagtctgaagttaaatttgtgaatcagcaataccttgttcacataattgataagcctgtccatgttccggaaccaagactcagcatactggtaattaaaatcgtcccccatagtccacattatgtggtttgtgcgcgtaacatttgcctgtcacataaaaaaaaaagaaggcagaatccaaatctgggtttctgttcaatgctgatttttaactgggaagaaataaaccaagaaatggaaatttacctgttttaaggctgcagcaacaaaatcattcacacgttctttaagattgtagtcaaacagcaacatgtcatcctatatcgaaatggttgaacaatcaattgaaatttgtgtatctggggataactgaaactgctgatctgcaaccatgcatatacctgtacaggtacaaaatcatcgaaaatttcgaagccgaagccatctggagggctataatggacaggaaatgcatttgtgaagatctgcagtttaatcagatgtttaaatgaacagtgataatagaatcaacaacttaacaacacatgataagttactaatgaatagatatgaaactatttgcaagaaaaaagaacaatagtaacctgagaagatgaaccaaatgttcttgagccgcgccatataacctctaggcctttgtctcctttacgctttgctctatcttggtaatcgattctcgcaaaatgcatagaatcgaaaccaagctagaattgcaatgtaaacaaatgtaaaatctccacactctagcaccgatattatgaggaaaaaagaattctatgacacagtgaacttcttgaacatccagcaaaatgatacatctggcaaaatctaaactttgatatgaagataacttaaaacaacaaaaggactttaggtacatttgcacaaatacacataaatagatttgcaaggctttcagaaaatggaatagtatgtaggagcatgagattatagcggtccaatagttctataaggactcgacatgcatggtgctcaaatgtgatgttaatattacctctgccccaagcaaataaccttgaactgcagaatgaccaaaaggatcaatttgccagccagctcttgggatcttgttaaactgtttcttgattacccgatgaccaagtgtggtctgatcaatcatgtcaatataatggacggcggcttcatcatgcatacaccacccaccatttctgaatttaaaatttccaaattttctcaaacttctaaagacaaaatccaatatagcaatgagattgaatcccatacatgaactctagctgaccagaatcaactagcttgtggactatggcctggatttttgggcttttctctgcccaccatctttggaagaaagcctggaaggaaaagacatatgtcagtctctacagttgatgtggtccaacaccaacaattcttggcaggtagtatacatataggacttttattcttattactccctccattccaaaatataaggatttctaggatgtttagcggagattaaggttatgaagagaagacttcagtaccctcaacaaatatgggatgggtgggggtgggagggtaggcgagagtaagacggaaagaaatttaaatgggatatgattgatgggacaactattgttgtgaataatgttaaaagtccttatattttgaataaaattcaaatcctaaaagttcttatattttggaaaggagggagtatcaatctatgagttagatccattaagacatttgagatttcattttcatttcttaacttcagtcatatttttatgaacaatttccctgtgatctattgagactccaggaacttacaggagggatgccacctattagtctgtccaacatgtcggtgacatagaaagttgttttgaattttggacttgctatgaaaatttcaaagcatgaaatttgactttccaaaaaagtttcaaggcctcttcagaatcgattcagttgaaagacaagaaatgatttcttttcctcatggaaacaagttcaataagaaacagtttcttctctgaatgtagcagtttgtactttgaaaatacaaaaaagtaatttaaaaattcatacttttttgacaaggaaatttaaaattcccgtttgatatgtcaccagtcaccacatgcacctacgaaacgattcgtcctccataaaagttatcattgtctcgccataaaaaaaaggaagtaggaagtcagcgatttactgatattttttaagccatgtgttttgaaatgtcaattttctacttctctgaattctcaaatccgaatactacctctgattggtacagacaatcatagagaggcaattgtaggatgaaagttcgattgagtgagacactgaattatgggcatgcttatccagaacaggagcgaggtctggtatggtccatgggccattgcttgtcctctccctatactaaaatataagcacttctgattttttttttcagaagatcaaaacgagggatgaaattaaatgggagaaagttttgattggttgagatgaaaaagtagatgaagaaattaaatgggagacgattatgattggttgagataaaagagtagatagagttgcagtattttgaaccgaattttgaatgttggaaattgctatattttttggatggagggaatatcctccaaaggataaagtaaagcagacaagagacacttccccacaggccacagctaagctagaatatggtatcattggaacatagtacagtacaaagtagggattgatgcacatgtactactaatttatcaagcacattaaaatatttgcttctgattgtcgtggcaaagttgatgcaaaacacgaagccactgacagaaacgcaggaacagaccataatcacggatgtagaaacagaatagcctctcaaaaaggaaaaaaaaaaagaggaaacgattatgaagtatatctggagtatgttttgctttcatagtgaaagaatattatgagtgtgacgagcatctttgtaaacaatatgtgaagaattcctcatgaagccccagcaaagctcaaccaccttagcttctttcctaaattccaagcacaagatggcaacacgaaagtagcaccttttttggggttgctttctcttatctgatttagtccttgtactcattctacacttgtcatgcaattttgcagcactgatttcccaaaagaaaaaaaaactcataaattttgggtttatttagagctgaggcgaggtgttgaaaaagcaaacccaggaatcagtaactagtgagacatcatcaaacgagaaaatttagttacacgtagtaaaaattcagataatttagttacacctagtaaaaaatcaggcaatctagttacccaaatcatttctagcagaggtagcagataattagttacccatggtaaaatcatttctaccagaggtagcagaggatgttggtgaaatcatttctaccagaggtagcagaggatgttggtgtttgtaacagaaaacaatatcacagagagaaattaatcgagaaggaagaagaaggcgaatcgggcggagcattggtacgagcacctcacctgctctgcgaagacgaacttgcgcgcggggtccaggatgagcgcgtccaccacggagtcgagcgtgttcatcacgcacgcgccctgcaaatccccccatccccaaaccccaaccacaattaagcagcgcaccacggagcagaacagagcacgccgggcggcggcggcggcgacgcggacgaacacctagccgcgctggtgtgaacgcggcgaggctcggcgaggggagggggaaattacgttacctggatggagttgttggtgccgacgaagtactggtcgatggtcttgagccacccgacgtcgtcgtgggagtgcggcaccaggtgcacgttcagcttcccggccaccgccccggcgctcgtgttgtaccccgagaacgccaccgccgcctccgccaacgcaagaaccgccaccaccaccaccagcgccgacgacgacgacgccatgtcgtgtcggaagtgatcgatgcgttagaaactaggaggaagcatcagaagatgggggtggtggtttccacgaggaggatgaggatgaggaggaggtcacgggacggaggccggtggccggaaggtccaaagcggagggcggcccggcggccggagaagagacaagatcggtggcaggatggatcaacagggactgcaggatatggtcctatgtgaattttcctttgaaccctcaaaaaaagggggaaattggttgtatgtatcaataataagagataagtttttgtttttcctattgatgaagtatggccttgtttagttttcaactttttcttcaaactttcaacttttccatcacatcaaaaactttcctacacacacaaactttcaacttttttacacaaactttcaattttagtcaaaacttccaattttagtgtggaactaaacacagcctatatattgtagcgttggcaattttgactgaagatgttaattaatgggtttggtaattttgaataacggttttatgagtactaggtgaatgcatttgctttattatgggtaaaagaaaacgtattataatatcatataaataaaatatgtttccccatgcgatgttgtaacctgtcttttttactgtatagggaatatccgcttgtatgtggctatccattttgatttaattatctttaatatgaagaagttcatgggactaatctgctaaattcacaacaagaacaggtgaggactaatttgtaaaatttacaattataatacattgtttgttttaaaggagtatagaaatggtgactaagcgtgaggagaagattaatgcggagaaaaagcagagctagtggtaaaatgatgacatcagttgatggaaaaataggagaagaaaagaaaatggattaagttagaaaaaatgttaaaagagtattgtatgcgaaatatggggcaaaattaccaagtctgttaactgtgtggaaaatccaagtacattcatcactgacttcaccgaattcctggaggagaagcaatgaacaattttctctgcttttcgccatagaattttcgcacaacgtacactttttgcacaacatttaatcattcgccttattcaaaaatttagtataaatacgtaaaagtatgagttaggattatattttatttgatgataaacaagtcacaataaaataaatgatattcgtataatttttttaatattataagactttcatattataagaatttctagtattgtccacatttatatagatgttaatgaatataaacatgtatgtatgtctagattcattaacatatatatgaatgtggacaatactagaaagtcttataatataaaacggaggaagtaaaacattatgcggaaaagtcaatggtggcatatatattttgaaatttgaaatgaagagggtataaagtcaagagcgttactctctttactggaagtactatatgtcttgagtatgtaatcgtggcgcattattgtatttcatctaacgtaattaatccgtatatatgatgactaaattaattgagtgtgtttccatgtgatgcgtgcactacacctcgtccctgatctaccctacgacgacgacgtcatttatgaacgcacacagtcatacgctgcgggcggaaataaacaagccagccggctcatgtttatcaattaagaagatcatgatccattcatcgacttgtacaaggcgacgatgcctcctccatttctaaaatatgattgatgtcttgacactataaataaatctggataagagacgactattctgattcggaagatgaaataaaaaaagaaaacagtgtagcagagagagacccggcctggtcgatcagtaactgcatcttcgggtgggaagtcgccgtagcgcttgtcggccacatctccgacgccgactgcgtccacatctacttcctccgttttatattataagactttctagcattatccatattcgtatatatgttaataaatctagacatatatgtgtacctagattcattaacatctactccctcctccaaaaaatataacaacttttagctcttaagattgtcctaaaatataacaacttctcaccaacattctcttcccaaccaatcacaatcctccaccatctcattcacttttcccacctatctccactattcattcaatcacaatcctccaccactcacttctacctactttttttaataaccgtgtccaactctaaaacttcttatattctgggacggagagaatatattaatatggacaatgctaaaagttcaatcgtccacaattattgcatgcatgcatggttgcatgttgctccgtccaggtggcatctatgcagtcatgcagagacccagctcagctagtttatccacactccttaactaattaagcactgatcagaatatggacacgacacgaataattggggaattgttctccaatctctttcctgttatttttgtacgagcaatacattcttataagtcgatttttttaagatagtggaagccgattccacaagatgatcggaattgggtcaatcaaatcaccttctcaatgtataaacaacatctttggttctttgctattgggcgcacgcctgagcgaatgcttcaccttcacgtgtttcaggtgtttctttttttcgaattttatttatttatttatttaaaatttaaataataaattaccgtttcgaagttccatagaaatgtactcctacctaaccgtaggacggagcatataaatcgccctatgctaaagtgagtaatatgacgtgacagactgagaattttgcaggagctccttttttttcttctgttggacgatttattgtcgagagagggccacatgcaaaaatttcctaataggttgtcctaacaaagggcaatttatcaagcagctccctggtcttattttgcaggcgacctcttcccgacaataaatcaccctatgagaaggcgagaaggggatgcctgcaaaattgccacgatgcgctcctcctatcatccatcacgtcatatttctcaccctacggtagaacaatttatatatgacccgccgtacgatagggcgggaagagtatatttctttaaaaaaccaaaatggtaatttattttttaaaatcttttaaaaaataaaaataaaaaattctttctttttcttctttttgtgcgttatcacacgctagaagctgcacagacaagacctttgtctccttcatctcttgttcgcatcccttgtaacggcaaaatcgggtataatacctcttctaactttaaaaatcggtgtaaattgacttctttcaatggttttaaaaacggttttttgatgacgtgacagaatgatttggtccaagtatactgacgtggcaacccagccatcaaaggaagtgaaaacagatatggatcccacgtgtaaatgacagagataaaaataaaaaatggtggctcacttgtcagccccacttctccttatcttcttcttcctctcacaggcaaagctggcacgcacggcgacggtgacaagcggcacggaggaaataagttttggaggtaaagaagaacaatagcttggatccaaatgcgaacgtttgctccaagaaggagctacactttgaaaaatgtttgcagcttaattgagacaaaactgaagcttcgattcttgtcaaaccaggttttgtttgaactaattaagaacacaactgaggtcaggcctgctgtatcacgctagctcatggtgatgatcagatcagcaggaggcaaaccgcaacggcggcgcgttacaggagcggttcgaacaggcgctcaactacgtacgtacatgtcgctgttcgaaaaagaagtagcgctgacaagtagaagccccatttttttattacacgatagatccacatgtattttcaatttctttcatgactggattgtcacgtcagtgtatttggattaagtcaacctatcacgttaacaaaaactgctatcagaaccaccaatgagattaatttgcatcaaattttgaagttggaaattgcattatacccgattcaggatgaccaacggcaatagctgaaagaggcaaaataggcttattccgtttttaatgtctgtgtaccgggcttttgaagacaaatgggccatgtgggctatatgacatgtagatgccatgtatattcttttcagtgtcaatataaagttagtatcaataatttgtgttggtagttgtacaaatttgaattgaaaatcttctaaagtctatattgaaaattttttatattgaaagttataaatgttgtgttggccacggtggcgatcgaccagcttagccggagggaaaaagtacacctaaggtacctcaacttgtcatcgagatacaaaattgtcccacaatagcaaaaccacataccgggcgtccctcaactaacaaagccatccgctttaggtccatcggtggttttgaccccggttttgtccgacgtggcggctaagtcagtgtgggaccaacgtgggccccacatgtcagacaatccacgtcagcctcctctctctttcccctattctctccattcctcctctctctcactcactcactcttctcttctcttctggggtggcggctagagcgacaaggcagcaagctggccggcggctgaggcggaggccgccgaggcgaggcgagagaggaggaggcggcgggtgacaaggcggcggcggcggctgcgacgtgggaaaaggcgagggttgcagccggtcacgaatggcgttgacggcgttgggcgcggaggcggaggtggggccggacgccgcaacccacggcggtgggcacagaggtggaggcgtgcgcctgccgcgaggtaggtgagctagctccaaccctgccgtgcagccgagccgagcaggcgactcgtcgtcgacctcccactcggggagatctaggcgaggctcccaacgatggaggcggcggtgcgcctgatccacaccccgcaggacgcgctcaagggcgccggggagtacatcaaccacgccttggggccggccgccgccgtgcacagcctcaagccgccgctcctcgcggcctccgccgtcgccgatgacctccccggatacctcaacgtgctgtcccgcttcgaggaggcgctccacttcctctccgacaactgcggcatcgcctcccagtggctcactgacatcgtagagtacctcgaggaccgtagcctcgccgccgccctcgccttttcacacctcacaactgccgccgccaccgcctactcctctcccgcctcgtccccgcggcctacaaatcgtgaaggaggaggatgtacatgcaggacaatagtcgtggaaggagcggccatcggtgcggggccagttggcgtcctcagcgaggtggcatcgcagctcctccttcctctcccgacgcttttcccccgtggcagtagccggacagtaggtcccagcggtagcagccaccaacatcgccgggaacagggtgtatgtcgtcaccatcacctgctcgagctaccaaccaaaccttagcaggatcggattgggtctctgagctcggcgtgcggctcgagagagatggaaggccggcgaactatgtagttcggagaggagacgggagtccaagtccgagaagacgcgacggcgcaggcagaacaagagatggatgtaggggagagcatgctgtggtcgatgaggaggccggcgaggaaggcgtcgacggaggagacggtggcggtggtgccggcgaaaagcgtggccgcgtcggccttcctctacggcgccgctttcggtggagcgatttggggaagggttggagataggagtggctaggagtagccagcaagcaccaccactctgtgccggccctcctcccctgtcggcatcaccttgatgctcggtggcagcgtcgccctagatgcggccgtcacctgccatgacaagtacgagcacgtccgggaggtgagcgcggccatggcgagcgagcgcgggccggggcaagggggcggaggcgacggctaggcagcggcacaagagaagagagagaggggaggggaagagagggtgctgacatggcatcctgacatgtgggcccttcgtgggtcccacgctgactcagccgccacgtaggataaaaccggggcaaaaaccacctaagcatctattgtgaccggttttgattagttaaaggacgtcggatatctggttttgtggttggggacgattttgtaactcgatgacaagttgagggaccttcggtgtactttttcctagccagagacaacatgtgacgcgggcgctctgttgggccaagccgtgacgcgtgaccacgagctgcggagctgtaacaccctgcaaatttgaccaaaaaaaatcaaaactccaaaaatatgggcctgcaaaaactttttgaataaattgcatcatgccgattttgttcgatgattttattggattttgattttggagttcatcaatcgcgaataaggaataattaattaggaataaaccctaaaattaaattggtaaaataaatgattaaaatataatttaaaataaagatttggtgaggttggaaataaataaaatattatcgcaaccatattaataacaattgaattctagtgcgactgaataaaaattagcctaattaaaaattcaaataaattatataaataaaatatgggtaatattaatctagggtggatccattggttggaataacacaaatattgagtaaacttcatttatgcaaaatttaggatttatagaatcaaatttacacaagaaataggctaacatggggattaaataggaaaagacactat

SEQ ID NO: 57658 - DNA, 3448 bp, Oryza sativa
tgccatgctctgttgtattaggaactaatatattctaccgctacaaaatgtggatttctcaacaagaagaagaagaaatgaaaagaaaaagaaaaggtaaaagagaaattgcaccaagattaatcggtgcatataagtattgtagtatccggcaaaaatccggcaaagagagctagtagccgacgcagtcaacggccatggctccggtatccaagaactggtggaacgtgatgccggcgccggcggcattgtggccgcactcggcgtcgtcgtcgccggcgtcgtcgcagggtggatggttcaggtcgagccacaggccgccgcgcttgatgccgccgtcgtcgtcgtggccgtggacgtggacgtcgacgacgtcgggcttcttgtcgacgacgatcgcccgcggcatgccgccggtcatggcgcggtggcgcctcatgtggccgccgagagcctggccaatggcgaactcgaggccgcagatggagcagccgtggagcttgggcttggacagggagaggtcgccgtcgccgtcgagcctcggcttcttgtggctggcacggtggccgccgagcgcctggaacgacgggaacacgcggttgcacgtcttgcagacgaacgcgcgctccggggcgcggtcgccgcgcgcggcggcgagcggcagctgcaccggcaccggcagagccagcgcctgctcctgctgcccgtgcgacgacatgagcatcagcacgcgcgccatatcgctgtcctcgaatgcaaacctcttcatgatctgaatgaatgctttacttactgaaactttgtgaaccaacctctctgttgtctgaagactgaagctgatcgaaatctgaagcaagcttgagatgtatgactctccaatggagaagaagcacacccaggaggagtatttataggctggatatcatctcagctcactgtgataaatgcaacataaactaattgaccaatggcagtagtagtaaccagttggtgattaaacaaagcacaagttggctttatgagaagccaagaaccagtttaccttttgctttttattactaatctgttgcaagaaagagtcactactctgtgagaggaatactaataactatattattctacattgattcgatcatgaattgtaagagctagctatagctagcaatgcatgatgcatctgctgttggtgaggatgattggaattggagaagcaggagaccgtagacggcgtcgagttttcgccgtgccgacagctgttgcttggatcgatgcaagcgtcggaatgaccttgggatcggacacttttgttttgggtcatttcagacacggtgtcagtgcctcgttgacttgatttatgcgtcccttggttcatggagaaacaaaattctgaatctcactcactcagtctgctgctgaccttgttcatgcatgcgtgcagttcatctcatcagtgtctgtactttgtagattctgggtcaactcattcttttcttgaaagaaaaaagaaagtttgagatcaagtaggaatcacatgtgagtttcaatattttcactacaaatgtagaatcttcataaagcatggtaaactgacaagaagataacagcaacaccatttcagaaaacaaaacatatgacaatatgacaagaaacagattgtagcacaagctgagagtagtagtacactaccactagactaaatatatgtagatcattgaagaaaatgtagataatggcataatgctacatgtagtactttgtttgttactatgaggatatcttctttttttcatccactggaatatatgatgtcccattggactagttgcagtactgtagagcttaccttctgacagttcagtttggttagatttttttttttctgttcgtactatatgtttagtgttaatcaggaccgtacttacttctgaataccttgcaaggaccggagataaactcgtttgattatgcctagacatatgctgctgaatcttggaacgacaactgtacatcttccaaacgatgatcacctgcttgcttgatgagtgatttttttttagacaatgttgattgatgaatgatgagctcatgaaacgtctcatggctaatccaaatggcacatggaacagtatcttgcacctaatactaacttttgcactcactcactgtgcatgctgttgctgctgacagtatcagaaacgactcttccttatttgcatctgagtgaaacttcgtcagcacgaacagccatcttaaacaaaaatccagtagtggcaaatgaggctgaaactcgacgaagacaattgtaccagttcaataagagaaattattcctgttaaaataagcagttcctgactataattggttcttgaatagttggattgcttgcattggcaccgcacttgtctattggactgaactgatcaattattgctgcttgatgtaagcagaaaaggaagttgggggcaaagttattgtgttgtttacttctgctttctgtaacttgcattccgaactagtgctttgctgttttgatggattattatgatctaagagtttatgccttctgcaattgttccacacaatgtcagtgtttgatggggatcaaatggaatcttgcctctgttctgttgacatttacagggaagaaatgtagacaggagagaatattaggtcaataacctggctaatttgatcaaactccatgtgtatgtctgactgcaactctgaactctgcaagaagtatgactgaatcctagattaaaaatgtctctggcaagtaagtacttctgagacttggacattcagaaaagtactaactaattacagaaagatcagaaaaaaaaaagcttcatctgtttgctgcatctcatcatgttggcagcacatacaaggagcacaaacaatttgcaaaggccagttggcaaaggtggtcctttgtgaatcctgaagcaacataatccttttcctttctgttcgcggcgatacgatcaagccaatatagaaaaacaggaggaacaactgttcagtcagttgctctaaaagattcatggagctttgtgtgcacagcatgatgtccttttgccagagacacagatgagcaatttgcagtttcttgccaagaagctactgttcagcaactgcagatgattggtagcttgaattgggagttcaacttgtccctgcaacttcttctcattggtgcagcaaccctaatcagtatgaacttgtcagaggagacaagccatgaacatgactcattgcatgattataatttataagtagactttgtgtcactttcactccgacgctgcatcttgtgttgcgcctgccgttctccgcataaaagatccaaaatagaagtttgccttcattgtttgcctggagattcagcaacagttgcatcaggaatctcaaaaacttgccatcatgtcaaacttgtcctaagttg

SEQ ID NO: 57659 - DNA, 9639 bp, Oryza sativa
ggtcctcagggtgatccaactcctcgggcccgaggggtgtgacggggcaccccgagcccgaggggaggggaagaaagcggaagctctctttccgagggcgtggcccattcagggggactgggcccaccgtatccgccacacgagaagggctttcttttcccctagaccagggacccccgggcccatatcactgacaacacccaaaatttgattttgatcccttccatacccctcccttcagttgaccgtctaatttctataaaaatgaccattttaccctttagatgaacatagaaatttatgaattatattattaaaaatataaaagtttgtcacatgagactattatagttatgagttttttttatgatgcattattcatcacaaaaattatttttagataatgtgtggaggagtgatcctctctagcgaatggtcgtgagacccccccccccctttgtgagttcggccgggggagatggcacgatgatcaagggcctacttccgcttggcgtttaactgctaaatcgctctcggggatgtgtggaagacgtgtgattatacaggttcgggccgctatggagcgtaataccctactcctgtgtgtatgaaattatgattaactttcacaagaggtcatgtgctctggagggtaatctagatgttcttcttctaaagctcaagctatccaagagtcgtcccctttcctggggagtgaggtcctccttttatagttcaaggggataccacatgcaacgtccatgcctacccctccacgggagggggacccaccctgacgggattaggccaccatccatgtcttcagtcggacgtatgatggtcgcgcgtcctcgggtggggcccagtgctgacccccgcttgacacgggggtcacctctgtcattcccctttaaatgaatggagattttggtggctcaccacgcgcagaggttactcctgatagtgctaagatgggacggggcatacctaactccactccgcctgacatagggcggaatatgggggcactgcggcccgtccaatctcctgtgaccagtcatagaccggtcatgcccgactgacaggggtcagtcgcgctgcgccgcacgtccacccacaccgcattaaatgcggtgagggatggttggggcgccgcgcattgaaggcgctgaaccgcgccttccgcgcgcccgctctcctcaccacatggtggccgggcgagggcctcggggtagtatgcttcaaaagcccgaggggtgtgacgtggtaccccgaggccccttggccacttcagcgccatccgaggggcggggaaaggcgaggccgcgtggccacgtgaccagagggaaggatacttccctccgctatgtatacccccgagtccatatcaccgacataatgaaaaaaatatgtatttatttttaaaaaagtcataaaaaactaggagcattcatacaaagataggactaccaatgcttgcaataatttttttatgaatgctcccgataaaaaaatccattgtcctattaaaattttaaataaatattttaatttattacatttttttattttcaaaatttatgtaaaaattttctgcaataattatttagtctcactagtttcataaaatacacatactgtatactcaaaccaaattttcaatcggatttcaagtttaaattcaaacctaaaacatcaagggcaaaaaagatatttgcagccaaacgtaatagtgaaatgaaggaaaatgtaacggtaagggcatggaagggatcaagttgaaatttgaagggtatagaagggatcgggtaaatttcagaggtatgaaagggattaagtgagttttctggagtacatagtgaatttactcttgattttattattagctactaattcatgatcagtgcactcttcattaatttcagcatgcatgtgattaaccagtttgccatcagaagaatgtacagattcttttgctgatggtaatgagatacacatagctagactagtgacacatgcacacacatataatccaagtagtaatatagaaatgaggacagtccagggtccaagtaattgggaggtggtggttggcttccaagaaaccagcaaacaaatcatgcattgttaatttcttaattacatatatatcagacggagtcactagttagttaattaattaattaggtagtgactgtgaggtaatgtgaaagtatacaaaatggctttaatcaattggtgggctcacatgctaatcaacttttgtgatggcgagatgtgcgagtcctacttagctgtaggttgaaattagcttaattaagcttgcttgcttaattaatatagtaaattgattaaccatgcctgcatgacgatatatacatgaggtagcttgatagctggtcggcgtggtgcacgcgggcggtgtgttaaaataaatctctgaatgtttcagtcatcgatcgtcgtctctactcttgtttcataccaatgacttcattaattacctccttgatttgcctttttgagcttgtaattaagataatggttttttgttacgaaaaggaagaggtgaaggctgaagagatctgggttggttgagcatttttgatcgccttgctgtggccatcggaagcatcggtacatctcccagcagcaaaatatatctgaacgtacatgtgagcatcgtgtcgcaattcgattcctgcgagaatcctgtctcgatcgtgagttaagttcatccatgcagcagcatgtctgaatatataagttctccacttgtcgtatcctttactcaatactccgtagtaaggaacaactgatgtttttttttatttttttaataatggatttcaattaatccggcctttatattcacgagggatatacacaaccaaaaagagaaaatccatgaaatgccattgacaagcaccctaatcccagaaatgccatcgacaagcacaacttcccagaaatgccattgtacaagcctatttgtcccagaaatgccatcacagtcaatgtaccgtttagtccacaccgttagaacaaaaattttataaaaacgaccaaattgccctcactccaaattatactatctcagtccggtaaaagaaaagaaattgggaaaatcagagacaaccctaaacctaaccctatgggcgacggggacgatgcggcggacctataggaggcggcgtgggggcccccggcggcggcgcggctcccaggcggtggcagggcgacccctggtggcggcgcgacactcctaggccgcggcgatgcggcgctccaggccgcgccgtggtggcgcgagggctcccgacggcggcgcgcggctcccaggcgacggcacggcggcccctggcggcaatgcggcgctctaggccgcggcgtggcggcgcggggcccccaggcagcggcgcgtggctcccaagcagcggcgcgtcggccctaggcggcggcatgtcggcaacagcctctcaggcgacgagcggcgagaagatagcaaaatttctgaaataattttgatgccaaaatttgtgaatgtaattttggaataatttgattgatagcaaaataattatgtctgaatttaaatatgcatcaatgcaaaataatgttgcatgagcaaacaatacagaatgatgtgtgagcaaatgtttgcctagtggtaagattgtctttccatacaacctaacggagaggagttaacagcagttcggctgtgatggtatttctgggacaaataggcttgtacgatggtattttcgagaagttgcgcttgtcgatggtatttctgggattagggtgcttgtcaatggcattttatggattttctcaaaagatataagagtacttagactcacacctcaacaagaaggagaacgcacaaccgaaaaagaaaagaaaaccaaacgacctcaacacatccctgcttctctgcttcccgtcatattctcctgaaacggccaaatttgacgagtgaaagtcatctagtcgcctctagtgcgccgtgcaaacctccgttggtgccatctttatccgtttcaggtgagttgacgccacgcgccgccaattagcccactttcaactatcatcattcatcgtttagttagaactagccaactagacacgagctgatgggatcggtttttacttcgtcgcatttctaaacatccactattcatagtgcttagacctccgccgtcccgggccgtcgacgccgacgttgaccgggtgttttttttataccaagaacaaaagttattgatgccatatgcatttactgtcccacataagtttcagtccaaactcgagatcatgaaattctatcatgaaggtcggcagtacgagcactaaatttgtttttttttttttgggtgagattgtctggcctgaatctggtcaaacgctataaggtccaaagtgatccagcatatagtatcataggccaaatgtttaggcttccaatatgggctgcaaaggccgataagacgggctacgtgagcccattattgtggcccacatattggtgccgggccggcggcaggttcaggtccagccaaccctgcgtacttgggcctcacgatagcgaaatcccaatacggtccaacaaaaaatgggccgcgcgaaactccaaataccccgttctttgggggaataagttcacttagtgacccttaaagtgatcgaaatcacaaaaccggatatctcgacctccaaactcttaaaatcggtataatttgactcccttaacggttttggaggacggttttgctgacgtggcgcctatgtggtggtaattatcgggtctcctttacacgtgatgttgaggtggcatttagaatttaaaaatatatgtgggatccatttgtcagcgacacataaaaaaaattgtgggacacgtctctcccctccctctccctccagttccttctctctcctcgccagtcgccactccctctctctctctccctctctcctgcggcagtctggcggacggcgagggccggagcagcggcgggcggagacggcggcgagcggcggaggcgcgggcgtggcgcggcggcctgcgactgcgagcggcggagatgcgggaatggcggcggcggcgcccggccctcgccgcccgcggtgggaggcacacgctccctcctcgccgctccctctctttctctctctctctctttctctctctcccgcagcgggcggcgagggccggagcggcggcgggcggagatggcggcggaggcgcgggcgtgacgcggcggcctgcgactgtgagcggcggagacacgggagtggaggcggcaggcactgaacgacgggcgtcagcggcgcctaggcggagcttcaccgcctcctcgccgacggcgaccaggcgttcgagcaggaggacgacggtgggaggcacacgcggcctccctatatacatggcctaccgtccagatacgcgacaagaacgccgcaccggaagacgtcgagagcggcgagcacgagcggaaaggtgcgtacgtgttcgtcctcgctggttcctgatttcttctccccggtttttttggggggttttcttttgactggttacggcgtgcatgccgcatggatgatcggctatttgttttcttgggacaccttgcgagttgggttgagattgagaattgtttggttcgtttgcgccggtgacgattccggttaactgggtcttttttgcaggcacggtatggacggagacggcacacattgttacggcggtgatcggctccggcgtgctggcactggcgtggagcgtggcagctgggttgggtggccgggccgctcgccctcgccggcttcgcctgcgggcaccggcatcgacttggaccgcgtcgacatgagcggcggcggtgacggtggaggacgtcgtcgtcgtcgacccagccacgtgtgccttccgccgccgtcctcctgctcgaacgactggtcgccgtcggtgaggaggcggtggagctcgggccgggcgccaccgccgccactcccgcatctctgtcgctcgcagtcgcaggccgccgcgtcacgcccgcgcctccgccgctcgccaccgtctccgcccgccgctccggccctcgccgtccgccgcaggagatagagggagagagagagggagcggcgaggagggagaaggaactggaggggaggggagagagaagtgacacgtgggtcccacaaatgttttttagtaccaccgacaaatgggtcccacacatatttttaaattctaaatgccacctcaatgccacgtgtaaaggagacccggtcaataccgccatgtaggcgccacgtcagcaaaaccgccctccaaaaccaccaagagagtcaaattgtaccggttttaagagtttaggggtcgagatatccggtcttgtggtttagggtcacggattagatttcaatcactttcgagggtcactaagtgaactttttccttctttgggccgcccgaaatggaaatcccgttccggcccaactagtacggtcgcacgtaagttccggtccaacaagaaacgagccgcatgtaaatggaaaaagtacactgaaggtccctcaagttgtcatcgtgtcagtgcggccacatcatcctcctctctcctttcccctcttctcacccttcctcatctctatctctctcccttctctgcgagacggcagaggaaaagggcgtcggcgaccggcgacgggcgatgagccgcggggcgggcagcgggggaggggcggcgggggaaggagcggcgggcgggctcccccgccggccgtcgccttgaggaacctgcacgtcgcccaccccatctcgagcaccacctcgcgcggcttctcccccagccgcgtcggcccgaggtccggcaccgccgccgtcgccgtcttgtcagcggtgtccgagcactccaccaccctcgtcgccgcctccgctacggggcgcagcgcaggtgacgtcgtgctgaccccctgctcggctggcggcggcggccgtgtacttgtcggcaagcaacgacaacgccaacgccgacgaggcgcgctggcccagcgccgccggattgtgcagcgtgtatgccgccggagtggctgcgtgagctgcgagcccctcgcaatcctcgaccacgccatctgcttcccttccccccccccccccaccacacacacacacacacacgaacaactcaaaaaaacaattacagaattaccaccagaacctgcagatcaattcacagaattgtcaatttgaatctcacataactgatttgatggcaacaacagcatgagggatatatatacacacaagaaagtgaccccaaaaacatgatacacgaacgagacttggcttcgcttttccttggaaaatggagcccagtgagaaaagagagctactagaagcacatcgcttttcctcagagttggacgacaagacggcgacggcgacggcggcggtgctggacctcaggccgacgcagccgggggagaagccgcgcgtggtggtgctcaggacggggtgggcggtgtgcaggttcctcaaggacgtggacacgagcgcctacgacgacatgcaggttccaccaccgccgccgtcgccggcggccaactggaagcgggacgtgcaggttccatcgtcgacctcctctgggtctctgctgggtctaacggcgacggcaacttcgctgggtctaagccgaccgccaccgccaccgccgcccaactccacttccccagccgccgctcctctcccccggccaccattcctctccctcgtgggcctcatgggcgacggccggcgggggagcccactcgccgctcctcctttcgccgcccatgcgctgttcctccgttgcccgcgcgcggcctctacaccgccgccgccccacagctcctccccctgccggccgagttagagaagagaagacaaagagaagagtgagagagagataaggagagagatgtgggtcccacgctgactcagccgccacgtaggacaaaaccgggtcaaaaccaccgaaggacctattgtgatcggttttgattagttaagggacggcggatatctggttttacggttgggggacaattttgtaactcgatgacaagttgagggacctttcgtgtactttttcccatgtaaattgaaatccacggcataagtcaacttaccatccctcatctatgcgtcgagttcaattgacatccctaaaccataataccgaaaatctttatcccccatcttaaaaaaatcattcaagtcggatccaacataagttgatagctgatttcgctgacgtggcatccttgtggtggagtggggccacggtgtgtcgaacaaatccatatatttttttttctttttcttgattaggatactgcgtcaatgaaatcagctatctatagtgctacaggatctaacttcgatgattttgttaagataggggatgaagatttcagatattatggtatagggatatcaattaaagccgacgaaaagataagggaaggtaagtgaacgtactactacttaactgcaccgttcttgggccgcacgaaattgacaccccgttttcggcccaagtgattaatacgggcgtcccggcacaaaacgttaagtcgaatcccgtttcggcccaataaacgtgcattgcatttgcatgggccgtttctagcacgcacaccatcgatctctcgccgtcgccttccccgtctgcgacggcgaactcccggccgcgaggtgcgacgccggcgtgcccctgcccagcagcgagtgcaccgccgccttggacgcgcagttcgccggccacgatgcggctgcgacgttcacctcgtgccctgccggctgcgcggccgatagctaggtgccctgtgccaacgcgaccagctagctgtgatcggagatctcgccaatttcgccatgatccaaagctccctcatgctcatgcgtcgtcgtcgccgctgccggccaccttcagctccagcttccaataacctcttcctccattaattaagcaattaagcacgggataatgggctagctactagctagcaagctgatccgatccaatcaaatatctgattaattaattaattactactcgattcacaaatggatattcgtaaagattcttgctggattctcacagtagtactagtagatgactgtggaacggtgtgctcgcatgcgatcagaacaagggtatgcatgcatgaatcatgatgaattcatgacgatcgtgcattatgattaactgccagcgtgcattagggttaggactgagattatttagctataaaatcaacttgtacaaacttaattactactactactactgaattaattatacctcaaagttgccagctttaggggttagctatgggcggttcaatgggaggctggatactgtattcttctcttcgggtgcagtgtgatagtatcaatttaagaagaaccagttgattacgctagctaagctagctcaccgctgtttcacttcttaattaattaattacaattaacacgctgacccctctgcaagaaacggcgacgaaactagcatattactccctccgtttcgaaatatttgacaccgttgactttttatcacatgtttgaccgttcgtcttattaaaaaa

SEQ ID NO: 57660 - DNA, 10878 bp, Oryza sativa
ccaccgtggtgaccgcgcccagtcggagcgacatgagtgggccgtaggccatggctagggcggcgagagagcggtgtggctggtcccgaggaggtggaggctgcctatgaacggcagagggcggggacccggcgggaggcggcggcgagagtgggcgaggaggtcaaggaggtagacggagaggagagagcccagaagccatggcagccatggaagaagaagggacgggaagaggaacgccattttaatttcttggtgatcgtttcactactctcgatctgaccagcagacaatgccatgcactgtttgtatatatctgcgccctcccgtgggtggaggttcctctgtcgctcgatcgtcaacttgtcattcgccatcctaatacttgttcgttcccaatatttttgaggtattaagaaagtatgttaagatgattattgaaagaagtgtgtgattggttgaaaagaaaaagtaggtcaaagagaatagtcaatagagacgcctatccgttggctaaatgctgaaatatgtcatacgttgtattagcaaaacaaaaaatatttgcgaataaaaattgtatatatatatgtcttagtgatttaaatatcacagtaaaaaataaactttgatgaaaaaacttgaaagttataaaattttagttttttacagtgaccgaaaaattttagttttttacagtgaccgattctatatagtggaaatgacggggcaagagtatatactccctccattaaaatatataataacatacaattggattagacatatctttgtattataaatctggatatggacatcgagattggtagtattagaatgtgtctaatttgatcctagattattatatgagttttaaaacagagaaactaagtcttaacaaacttaaagtcttcgttattgcacttcaacggttaattcgctaattaatttgcttcaaaatatattacaaagtactataaaaaattaacaccataaggaagtagtttcatagcatgaggccaaatacattgttattttgaagtgagcatactggttaggtttttttggtggaactattttactcgggtaaaaatcctacatttgacacgggtgctcgtatttacggctaattattttttcagtagtaggtgacgtacacgccaacagcgagactcctgtggtgactttgccaatttcaagatatgcatgtttcaatttttcgttttcagtgtttgtatcgggcggtgctgatatggcgaaattttcgaaatttggaacaaaatttagttaaatttgaacacatattaccaaaattcacaaaaaattaaaaatattgaaaatttcagccaaaataatatcgtataggagtgggtccaaaatgaccgaaatttctgatttcagtctgaaatgtcagaccctgaagatatgtcagcccaatcttccagatgtgctcgtaggggtagggtatacgtgcgcgtccatatgggtaagatacattgttattttatttatttttaaaaatttacaaatattatgttttcaaaaatacggacgccttctatttatttttggaaggaaggaaattaatctccctctaccctaacgctcgggccgtctcctcctcttccaaactcccaattacctttttcctcctcctccgccgcttctcctcctcctcgtcttctcaggctcccctccgctcgcctcctctcctcctccgccgccgtcgccgtgatggggacgggatccaagaagaagaagacggtgtcgtggtgcacgacggaggtatcggagggcacgcacgcgttcaagatcgtcggctacagcctcaacaagggcatcggcgtcgggaccttcatccggtcgggcaccttcgccgtcggcggccacgattgggccatccgcctctaccccgacggagtcaccgaggattccatggactacgtgtcggtgtatctggagctgatgaccgagaacgccaaggccatggcgttctacacgctgggcctggttgatccggtcaccggagggatccgctgcaattggtcccgatcatcgccgaggctgttcgattcctccgattcgagccgtttcgggccaagatccccactcttcataccgagaagtgatctggagatggaggaatctggctacattgtgaatgatcgcctcacggttgaatgcgaggttactgtcaccaaggggccgcaggtgtcaagaaccattggttgctctgaaatcggcgtgccaccttcagagctatctgaacattttgggaagctgttggaggaggaagaggatgtagggagggatgtggttttcagtgtcgagggagagtccttcgccgcgcacaagctcgtgctcgccgcgcgatcgcccgtcttcaaggcggagttttacggggagatgattgaaaggggcacattttccatagatatcaaggacatgcagccttctgtcttcagggctctcctgcatttcatctacactgatgtgttgcctgctgacattggcgatcttgagggagatgattatgtcgaatttatccggcatctagtcgtggcggcggatagatatgccatggataggttgaagttgatgtgccaaagcatccttggaaagtatgttgatgtgaagaacgtggcgactacgctggctttagctgaccagcataactgtgataagcttaaggatgtttgcattcagtacatttgctctctggatgaggttgatgctatggtcaggaccaaaggctatgcaaatctcaaaagaagttgcccttctgtgttggcagatttatttgagaagacaagcaagttccgtgcttcttgattaattaagcttactctatgattagttaatttagttccctatagtattagcttgtccaaactttaagccatgggctgttagtttagatctaggtgaccaattcatggataggttagcagagctgatgggtaggttattcactttatttttgatttaaatgaatggcctgcagctaattttcatagagtggctcatatcctggtaacccatgtgtcattagtttatgtcttaaattttgtgcacccttttgtcgaacggttattgtataaattgtcaaatatcagtgtcttcagctgtccagtaaataaaaaagaacttgcttatgcttatagtgctttgataatgaaaccactacagaatacagataacaaatgcatgtcattgtggtaggaatggatgactaaagcaattattttgatgatattatgatattaatcatgcaaccttcaaaattggatgatagctgttaatgtacaatctggcacataatttttggaggtatgttttctgttcatatatccgtgaatgtagttactcagccaattaggctcaattatactttgtgcctggaaagccgtaagattagttcttgtatatctggtcacctgataaactatcaaatttcaatttaacatcatactgaggtttaaatgaaaggtgaaaccaggttttatagccctaagtcctcatcaataaataggtcaccgaggtattttaagtgcatataagaaggggcagagccacaaattggtcaagcagattattttctgatgtgctcatgtctaactattttatatctctggattttcataatattttaatagagctactaataataagcctaaagccaagctcaagcccaaatttccgtaggtttgcctctgcccccgcatatatataagagatttattcctgtgttatgagtcagccagaataatagctctatttttacattgccgagcacaacataaaaccctctctcatagtgaagtttatcaaggttgtatgcttggaaagctaaacaacagtatggacgaagcttcagaggtaaagatatgatcattgtcctaccgtcctactgaaattctgctgcattcataacaatattcaagttcaagatccttcataagattgaagtgatctaatatatctagcgtcatatataggagcataagaatcataagtcttgaatcaagcttctgacggcatagtttggcagctgatggaactactgcatcttagttgtttcaaccagaggagaatcaggtattgttttcctctgtaatctatcttatgtatgagtcgttcagttattcagtgatgctgatagctttgagacgacgctttattatgcgatcaaacttcagggtcatcttttagtgcatagtataatatcaaggttctatacttgtacattttaatagcatgacagctatctccatatagttgtttcattttgataagtacatggttctggggaaagatggtcctatgtagctgtattgaattccttcttttccttatttaagcagcatccatgacagaacatgaggaaaagaagatttgatgaatcctaatttaaaaatatttgttataacaaatgttaaaaaaaggataacaaagtttgtcaacttgagatggtagtgtgcattgtgttagaaacatcagatggcctatatgctgcatgtctcatttttattctgtggtgtggtttcagctcattagtttgttgagaaaaatatgtagttgggacttgggagtatattagtataaacaagcaaggcttattagagttcttcctggaggatgttggttgctgctgttgccaacttgtcgacctgaaaccaatgcatgcatatcctgacctgttgcctgatggttatcatgttatatgtaccctgattagcctcctggtcttcttttatttctgagaaacaatgcatttgatgattattccttattcaaaagcgtatctggattgaatgctactatttagctacgcatagaaggtatgtaatggctcatggctggacttggacttgatatatagcattctagattttactgtttcaatccatcgacccagatgtattttgaattttgcacaagtgaaataacgacaagtgaaatcaatctttgtggtgaagaaaaatcaacctgtctcatttccagagattccatctgcatgccgaaaggatgtgtcattagcttgtatgacagcttgtagggtgaaaattttgttcaaactgtgtgattgtctacttgtcgtgttgaggttggaataggtggtggactgatggtggtgccatggggagcatgtcagccaaattttgtcatattatggcaaaatttgctacataacactcgaaaaatatgatattggctacaagacatcgtaagattatggttttgctgttggacactgtaaatttatggtattttactactagacaccgtgagcattattatattattttcatcacattgaggagagagaagccgcatgaaatgtccgttttacccttctgatcaaactaaatatgtgtgcttagcagcttagcctgtgtagattgatgggggcacagcggcactggctctagcaggtcgatggacctctcatcatactgcccaacgggcaagcatggctgctttgtgtccactgaagagggccatcaggattcggttcctcacgcaattccgtccggcctcctcgtccatgtcgccacctggaggattcggttcctcactgcttgcgatcgactagtcgtttttcaagttcgcaacctcgcggtggcaaggagaccgaaaaggctgcaggagagcagttggccgtgctcctctgtccccttaacaccaatggagaagcaaggtggcagtagcgcaagtttcgaatggaggccaaggtgaaaggaagtaaaaatccatttgaatagaaatgtaactaagtattataagaactcactggtgaaaggaaattggaaatagggctatggatgaagagattgtgctcgctctttaaaaacctaagtgaaaatgagaagggtgctgaggtcattctttagtgtgtttctcttttaatcactcaaatatattattttaatgagaggcatgtccattagcaaaataccacaattttatagtgtccagcagcaaaatcagattattacaatgtcttgtagccaataccacattttttaagtgtcacgtagcaaattttgccatattattattgcattggatgtacgggtgatttgatacgaattttttttaaaagaaagggaaatgttcgatctaagtatataagtgcattatggttatttagtttgattttggttagccagatattgtagatgaggggtatgtgcattttgcgaatctaatcttctcaagccgacagtttggcctcaataattagaatctaatcttctcaagccgacagtttggcctcaataattagtatcattgaaccacgtggcatatttaaactttgagataaatctaggattaaaatgaggtaaagaattgataaaaatgcagatccatcggggaaaaactaaatacagaaaacaccagtagattttaaaaggaaaaacatagggcctgcccctttgcaactaaagaaattcattttccattaatcatcaaaaaataaaagaaaatgaagaccaaactgggaaaaaattaaaaaaagaataattgtgaaattatttaagaaaatgaaaataaagttaaaaaggtagaagcaaaataaataataataataaactacaaattttactgttcctaccatcacggcatcaccactgtccttcacggtcacaaccgtactgacaagccaaagctcagtgtttatgccaactacgggctagagctctctgtcatgtcccaagccatcaatgcctggccgaatcaaataaatctagctaggaatcgttctgaaaaaaaaatcacgatttgttaaataggaaagaataaaataaatagtgcattgggaaaaatctgacctactttcttctaaggataattctatcattctcgagaaggtatcatatttttcagtataaaattgaatatctctaagtattaagggtgtgttagtgtgtctaaaggcattttggtcttttctcatactcttgtgtacattttatatggtctattgatcccaagtcaatgcacaaattcaatccccaaatcttctcttaaagtgacattagatccaaaatctacccaccaaatctcccatagccggcgcgcgccgggccatcgtcgttgtcgtctgtcatctacaatcgtcaacagcaatagcaaaaatatttttggtcgctgctagcaggaagccgcattggtcatcactagtctcgtcgccggccatccatcgcgtcaagcatctcgtcactcttcgtcgttgttgtcaagtagcaccagcagcaccagtcagtgccttcgtctccgagcaacagccagcatcaagctcgtccgtcacttgatcttccatcagcaacaaaatcaaccatcatcatcttggagtagcaccagcagcaaggtctttctcccccagatcagtcctcgcttgtgctgtaggatcgcacaagatcgaacaaacctaccagagagaggtgaatggtagggaagaccaaaaacccaaaaatcttttgcggaattaaagattaccctcaaacgaagtcgatgacgaagtccagtcgccgccagtcgaaccgcccacctgccgccggtcagactgccgaagcctcgccggtcagaccgcccgtacacctgcggtcagaccaccgctatcccaccggtcagattgcgcgcacacctgcggttagaccgtcgggacccagaaacaccggtagatgacaaactcgaagatgtagattgaaacttttcgactttattgcatcaactagtatttataaagtgcaccaacagcactcctcaccaaaatctcgaactaaactcgaaaccctaactttctctcaacttgtgtctctctaaaatcgatactaggaagtctcatgctccctctttatttatagataaaaaaccccatacttaaataggtatagaactcctatttctaatagaactcaatccctcactttcctttttctccaaaaccacagccgcaccagccatgaaaaatcgccgtcgccatgtcggactccctctgctgatcaaatccgtcttcaacacatgtccttctccgtacggctcccgctcgtccagcgtgggccgacgcctgggcctgctcggccttccaacagaccagaaccaacacacatgggcatgcatacatcacgtacacacgcatgtactgctcgccacagtacacacatatgcatgctacagtacctcgccgtactgtagcgctatatactccaatccaatttcttccgatctccttgaacaccgatgcttgcacgcacacctcgtgaagtccgttgcgaagatctctctcacacgatgtccatacaccgtatggcattttgtatccaacttcgtcacccggtatccttgactgtctggacctcagctcctctctgggtctagtcctgatccccaccattgaccgaagttgacctttaagaattctgactctagtcaccttctcacatggtatcccgacctcaatagacctttgctcctctcgagcatagtcccggtcctcaccattgaccaaggctgatctcaagccatctgcaaacaatcagacaaaacgaccgtttctgggcacagatatcacaacctgacccacattagtcacatgcactcacgccaacattcacacatcatttcaaaccaattcattgattaaattatttgcacagccaattattcattacaaatattaatcatgacaatgatttcacatgtgcttgccatcctcgtccgctgaagctcgtcgtcttcccaccgcgtcagatccggtaattgcaggcttgcagccatcgtccagctcgtggtggcctctcgtcaatcctcctgtcgtcctccagttcggttccagcagtgacagcagcaagacgtcctctttgtccatcttcaagcaacaaccaacaatagcagccagcaactcattgttgcctcgcctgtgtctccgtcgacacattcgctgctgttggctccggcaaggacggcttcaccttcagtgtcaaattaaggattgtgcagtttgttcggttctaatcctaatttcactcgcagaattcacatgtttttaactttactccatcacatgtgcagtcagttttcgtgcttgctggtcgctgccatctgataaccactcatcaatcatcaccatgcttctgtcagcatgttcattagtagcatcctttggatctcttgctaataagtaatagagcaattttacgatccttgaggaggtaccatgaggtaccactttttctattgtaaatttggtacctcttggtacctaagtactatgaggtactaaattttacactaaatttttggtacctcatggtattttctcaaggaccgtagaattgctctaagtaatatgcatctttgcttgctgcacatctatcaatatttccttttgctatatctatcaatccatgtcctctactaatcaatttcctatgtctcctaccgagtcaaccaaagtacattgcatatccttcgattcgttgaagtcttgctagtatatcatcatcatcttcactagttccatgttggagctagccttcatatcctcaccagcttcacgtcggagctggtcttcgtcatcaacaactcgtcggagttaaccatcatcatcagcttcccatcaaagctggcatcatcatcaatccgtgaggtccgaagaacagtttgtgaagggccttcatcaatatcaatgtctcatcatcagtcaaggacctaagaacagtttgtgaaggtccattgtcatcatcatcaacaactacatctcagaatcaatgaagagccaaagaacagttcgtgaaggcttcaaatgtaccaaggttcgaaaaacagtttgtgaaggctccgaggtcaacttcattgaggaggagatggatttcttcatcatcatcaacaactacatgtcagaatcaatgaagagccgaagaacagttcgtgaaggcttcaaatgtaccaaggttcgaagaacagtttgtgaaggctccgaggtccatttcattgaggaggagatggatttcttttcttcttcatcatccaagaattgcacgttccgatgacatcttcaagcatggactttagatttatcctagtgtggcattaatctagtgtttagtttcaaatgcaatgttattgcatacccattgcatttgagtgagggtgttaagtatgtatgtgtgttagtttgtctaaggatgtgtgttagtgtgtctaatggcattttggtcttttctcatactcttatatactttttatatggtctattgaccccaagtcaatgcatcaattcaatccccaaatcttctctcaaagtgacatttggttgcatgcattcctctggcccgcgccggctcatctctctcatccatggtgagtttggcttggatgaggagatactacaacaaaaccattgttttaagacgtttcacttaagttattctataagtcgtctctcttttataagtaaaattgaaatagggacgatgtttgagacgctttattagttgaggatagtttaagacgctttacatgttagcacaaaattaaatcgtttagagaggaatattgagacgttttggaacgtctcatgtgtagaaatgagttttgagacatttttattatatctgtgtcatcgttattagataatatataattatttatatcgagaaagacaaaaataaacacactgttcctaatcgtcatcatcaaataccgttataataatattataattatttggacaaaaaaattgaatatttaatattcagtctcagattaaaaaagaagagtatctgctacaggacgcatgtttgtagagttgcagtataagaaaaactatctatttaccttcaagattgttcacgttaatgacttggttaatgc

SEQ ID NO: 57661 - DNA, 992 bp, Oryza sativa
caaaattcaaaaagaatttgaatccaaaacttaaaacagccaaacatatccactggtatccatccacctgccccacggtttcatcggccgagctaaaatccaaatcgaactcaggtcgcccactgacatgcgggccccactaaggtgacggagagatctcaaccaacccctcccacgcgtctggctcgttcggttgccgccatttccgtgagggaaagggaggaaagcagttaagctcaggataaaccgcctcctaatttgagataaatccgttaatccgactcattaatccacggataatcactgcggcatcgtaggccttttttgagctataaatagagctcctgatcccctcctccactccacaccaaaacctctccaatccccaaatcctcctcatctcctcttccagaacctttctttttcgatttcgtgttcgagttctttgtgattgcagcgatggcgtccgtggatctgaccccgaggcaggcgaggaaggcgtacggcggcgatggtgggacctactacgagtggagccccgcagacctgcccatgctggaactcgccaacatcggcggcgccaagctgtcgctcaacgccggtggcctcgccctgcccagcttttccgactccggaaaggttgcgtatgttcttcaaggtattcttacatcgatcgcccaaaccctctacccccatagatgatcttgcggttctgattgcgatttgagggatctaaaaaattttcgaagattgaagtggaattgtggttattttgggtagtattgttttgatcgtggttataatctggctactgtgtgatgtaaaaaactcaaatattagggaaggatctcatattaaataattagaaggggtgaggctttgaacccaggtcgtctagcgcatcatcttgtggagctagctggaagatcgctgagcatttcttagctactgtgtgatgtgaccaatgcagttttgtcgttttggtttaatct

SEQ ID NO: 57662 - DNA, 3008 bp, Oryza sativa
ttaactgatatgttgtgctgtacttagttgactgatgtactagtaattttctattcctacatttgttctatttggaattacttgaaaattaatttatcccctgcaataatgatgacttttttctatttggaattacttgaaaattaatttatcccctgcaataatgatgattttgcttagtatatttcaagatgaatttgactgatgtatcacagtatagtaattttcttttcctacatttgttctgtttgaaataattacttgaaaaattatttatctccttcactaatgatgaatttgcttagtatctctcaagatgaatttgactaatgatgtttcactgtgtttgaccccttctcaggcaagggcacttgtggcattgtcctgccggaggcgagcaaggagaaggtgatcgccgtgaaggagggagactccctggcactcccctttggcgtggtgacatggtggcataacctcccggagtccccaatcgagctcgtcatcctcttcctcggcgacacatcgaaggcgcacaaggccggccaattcacaaacatgcagctcaccggtgccaccggcatcttcaccggcttctccacggagttcgtcggccgcgcatgggacctcgccgagtccgacgccgtcaagctcgtgtccagccagcctgcctccggcatcgtcaagatcaagtccggccagaagctccccgagccgtcggccgccgaccgcgagggcatggcgctcaactgcctggaggcgccgctcgacgtggacatcaagaacggcggccgcgtggtggtgctcaacacggcgaacctgccgatggtgaaggaggtcgggctcggcgccgacctggtgaggatcgacggccactccatgtgctcgccggggttctcgtgcgactcggcgtaccaggtcacctacttcatccgcggcagcggccgcgtccaggtggtcggcgccgacgggaagcgcgtgctggacacccacgtcgagggcggcaacctgttcatcgtgccgcgcttctgcgtcgtctccaagatcgccgacgcctccggcctgcagtggttctccattatcaccacaccaaagtaagcaatctccaaatccaatcaaaactattgatagaataatcaaaaccattgatagaatattagaatcagcattgcatttgtgtaaatccaatcaaaaccatggatagaatattggaatcagcattgcatttgtgtaattccaatcaaaacactgatagaatattagaatcagcattgcatttgtgtaagtccaatcgaaaccatggatagaatattagaatcagcattgcatttgtgtataattgtgctcatcgattgatgaatttgtgcagcccgatcttcagtcacctggcggggaagacgtcggtgtggaaggcgatctcgccggaggtgctggaggcgtcgttcaacgcgacgccggagatggagaagctgttccggtccaaaaggatcgactcggagatcttcttcgcgcccaactgagcagcttccctttgccattgcgtcgtcgcgtcggtgtcgtcttaaattaggattaagtcattaataatttcatctcttatcatgagatgttactaccttctgtcagtcttatgctattgcggttgaactgtggtgattcgccacttaaaattctattctattcgagagtgccttctggtgcaaatttgctctgctttgtttcatctgcaatttgctttgctttgctctgtttttgttttgttttatctggaatgcttgaatgcttgaggtgattgattcagagaagaggagaacagctgcgctggcaaaacaatggatggaaactggataaagaggaccttatattggaatgagatgcaacaactagtcttcatctctctttgctttctctgtttaatattttgctctctctgcttaatgggttgatttgcagctatcattgttgtgtttatttttattgattttccttcagacttcagaatcgacaagattagcacatacaatttaccttttagtaccacataccttaattaattctttaaagtcaacttctcttatgctttgttactcttgttttctatgttaaatctttagtcagtggagaatatttaggagacatgacaagcttttttttttatatagttttgttctaccaaaagttttgttcctattttgtttgaagtattattaaaaaatcaaattaatccatttttaaaaaaattagctattaattacgtgctaatggactgttccgtttttcgtgcggaggagatgggttttccgtgcgacgtgtatcatgctcatggacgcatctcttggggcctgttcactttgatgccatttttaaccttaccaaattttggtaaagttaaaaaaaatatgcctacatttaatttgctgccaaattttggtaaatttgttaaggtttttttttggcatcaaagtgaacagtcccttgattttcgtgctcatgtagccaacacaacgctcgtttcttgtgaagtcaaccatccaattagcaagcagattaagacaactttaaaatactaatcctactcatcttctgctgcaatatggatattgctggtgataacgtgcagccatggggattaaacaaaatgcaagtggagtgctccacatgatatgatattcgtttgatgctatcaatagtcttgtggattttgtaatgattttacaagaactaagctgggacaagtgcagctcacctactgctatgctatctccagccttcactccaaaggatgcctaaccttatcactaatttgcttcaagcgtgaatatacttgggttccactttgcagcaatacaaactttttaagcacatagatgtactatcaatggctaaccaatccatccattcaaatgatcataaaaaattttatcaaaattcaacttcttttttaccaggaacaggccaaaaattactgatcagaaaagggaacacaaactgcactacagaacaagaagagc

SEQ ID NO: 57663 - DNA, 2073 bp, Oryza sativa
tgcgttctactccatgactacatttgacatagtttttagaaatttgaactctacttcatgaccatacttggcacaattttaagggcatgttcactttaatgccaagaaaaatcttaccaaattttgctaaaattttggcaggatttcttatatagttaccaaattttggcaacaaactgaatgtagccatttttttggcaactttaccaaaatttggtaaggttgaaaatagcatcaaagtgaacatgccctaagatattgttgccccctaacaattaggagtatccattatcatccaacagtcattaatttggcaccgttaaatcagctgctattcgtaggatagtttagaacaaggcaagtgtattatgttctcggtttcttagtgatgatttttttgaagcttcatccaaatgaacatggatggatcaaataggcaatacgtttccggtaaattcgagaaacgcctaaggatcttccggctagcttcacaagatggtgggctagccgacttagttttgaagccccactcattctaattatttaatattaggtctttccctaatatttctttttttttgttccggttaaattccgccaggttactcgcactcaaaccacatccccatgctctacttatagatagagcttgagaaatattggttttgattagttactagattatctctttttgaatgaatttcaaatgtttatagccattaggatgtaagggattttattccaatattcaaatctgatgggggcctaactgcaaaatgtgcacctgtcatcccatataaaaagttgccccaaatgattccatcacacaaactcctaaacccacaatatacaacccaagatacccgggcacatttacagaaatgccccccaaactcctcacttatctcatcctagccctcctcgccgcctccgccgccgcagcgcggcgccacccgtctccggcgagctcagccgccgccggggagcccgtctacctatggccgctgccgaggaacttcacctcgggttcccggaccctgctggtcgaccctgacctcgcgctcgacggccagggccccggcggcgccgccgcggcggtggccgaggcgttcgagaggtacagatcgctcgtcttctctccatgggcgcacgccgcgcgcaacgcctcgggtgggtacgacgtcgggaagctcaccgtcgtcgtcgcctccgccgatgagaaggtaccgtgtgtgtgtgttcgagctgctcccgagtttggctcgacggttgcttcgtctggatcagcacgcacactgtgaatttctccgtgtttttgtgatgtagctggagcttggagtggacgagagctacacgatctatgtcgcggcggcgggcggcgtcaattcgatcgtgggtggagcaaccatagaggtgatttcatttcctcttctccagattatgcccttttttttacagtagtgttgtgttggtgaagtgttttgggagaatttgacgtgagggctactacttctccctttttgaagtacggtttaactcctagcgtagttatggagcaagtagagtgagctgagtgagtggtaaaaagaagacttcaatgtggaattactgcaaatattgatgaactggtttccagtgaaattcagcttataacggtatagcatagctaaggctgaacttctctaatgcaatgaacttgattttttttaatgagctagctatttgatttttgcgcacttctcagtagatgcatcaactcttgtggtattcttggaaactctgatatgaaatgctcatattattgtgggttttatcaaacgaaactaacggttggtactgtttgtggagtgtgttgattgatacgaacatcatctctgaatattttagagttctactgccaggcttggggtcttggggccttgggggcatgggttcaactaaagtagccctcactcatatacagtttagctttgccggttgtgccccctgcaaactttcagagaactgaagacaaacgttgctattaagttataatattgtccaacatttctcttttatgcacaagtgtatgaa

SEQ ID NO: 57664 - DNA, 2334 bp, Oryza sativa
  unsure (1)..(2334): unsure at all n locations
ccccaaagtgtaataatataggagttagcaaagaagccccaaagtgtaataatatacatctcatcggtcattttgaatttccggttacttgaatcgatattgtacattggtaggaaaattggagtaaaacatacctataagtttattcatgtctaaagatattcaagatatatggtggagataatcccttgtataccgctaaaattttaactgatcctttctatgcttctgaattttgtttacttccttgtatacctccaatatttgattttgatcctttccatgcccctccattcaattgaccattagttgaccgtttaatttctataaaaataaccattttacactttgaatgaacatagaagtttatgaattacattattgaaaatataaaagtttgtcacgtgagattattaatagttatgattgctatgcgatacattatttatgataaaatttacttttagataatgaaataaaaatatatatatttattttattttttgaaaatcataaaaatgaggagcattcatacaaatataggactactaatgctcacgatatttttttaagaatgctcccgatcaaaaaaaatctattgtcctattaaatttcaaataaaaaaataatttattacatttgttttattttcaaaattttatgaactaattatttagtctcattagttacttaaaatgcacacactctgcacacaaacaaaattttcaattgtttttcaagcttatatttaaacctaaatcatcaagggcattaaagacatttgccaccaaacttaacggtgaaatgaagaaaaatgtaacgggaggggtatggaaaggatcaaattgaaattttagggatatagaagtgaacgggtaaattttaagggtatatagggaatttactctatatggtgtctgaaacaaaccgtagatatataaccacatgttgatctagctagtagaaaggtaccgtaaaagcancccaaatttgggcggggggaaaaatgcttcaattgcccccttcggtacacttagttttacttaatttaaattaattaagagttttgtaatgaacggtcattctataggtattaactgatagaccgcaaaaaaaaaaccaaaattaataggaaaaaataattaaattggtgtcaaattactagttttcagggtttattctaagttaattatagttggtggtatactttttcaacaatagtattaattaaaaaaattctgaaatgtatgtgttgtgatattatatatatatatatatatatatatatatatatatatatatatatatatatatataatatcactgtctatcgattactaataattattaagggtagcaggagctcgatgcggttcatgaattggcaggacttatgtcttcaaggtaagctaattcttgcttttagcttggatttgattgatttatacgcactcatgcacagaagcttagctttgcatatatgaattgatgtctttctcctaaaatataatataacgtgtagataaagatatttggctacaatgttttcttaactgtcttgttaataaattgaatttcatgggatgaatcacagaatctgtacatgcttcgagtaaagaaaaagataagcagtgtagtgttaaaatgattttgtgatatacggttaatcagatcaaagatttgagcaaactctctacccattcagttgttcggtcagtttagagagagagagagtagtgctaggctcatctcaccttataaattaaatttgataggtggacttgcgagatctacgaatctggacatctttatatctaaattttgtactataatgtatcacatcgtagtacgaggttgaccttttttggacggagggagtatattatatcgcggcatatgtgtgttgctgtaggatcaaggaggtcgactagagggggtgaataggcggtttttcaaacttttggctaaaaccgagttttgtatgcggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatttgcacaaaataaaggagacaagagacaaggaattttcaccgaggttcggaaactcgccggtttcctaatccccgttgaggcgagcccaactccaccgctcaaccacgaagccatcgcacgcccccttcgtcaagagatgggcaaggcgggagtcggcccacggagaggactaccaaagcctcaatcactagggt

SEQ ID NO: 57665 - DNA, 2447 bp, Oryza sativa
tttcctgagtttggctttgacctgatacttatgctccacttgctggtccaagatttcatttatgggggcgggtaagttacgaccacctgttgctgcttggtgatctagatgagagatgagaacaagttttggtcatttgttacaggtcactgtcctccaatgtcaccatccttggccatacatatctacagctgctgtttttttctctctatccagagctcagttttttcgtaaggtgggcagtgaatgtgaagaaaggaataccacctataataagcagctgtgtgaaactttttcgttaaaaggaagagaaaaagattggccctttggactgagaccagtgactgtgactcttgaggcagactggagaatggccttttgtattgatgttcttcattgcactattgcggtacatatatttttcttcctatgtgaatcactgatgtgactgctggatgatccgtagaatacctatggactatgtgggtaccatgtaggagactagtagtcgatctgtagtacatgttgtgcaagttgagatctttttgtccctgggagtatttgtagtaatttcctgctacaaagtgtgtgcttgtgctctttcacagaatcatgtaaacctgtgtttactcgatctacaactgtagctccttacacaggaagcaagggatcctgtgtgacaccgagattaacattactatatgatatagttgaaacaatgttgcactcaacttagactgtgggccttgaccaatggactggtattgttatatgtacaaaaacaaagggtaccccgtggttgtaatgcaacgagcacaaatggactctttcattatgttgtactatgtaaaactatttttttaagaaacaccactcatgcacaagcgcgcacgcctgtctatgtaaatgtatacatgcacactttactcctataaacactttcgaggaccggcctggtcagtatatcttgaaattaataaagctataatggttacctcactatattgtgataataattaaccgtaaatacgagcacatattttatcacaatgaatctaacgaatgtaatagtaatattatgctttgggaatagaagtttaattggataacatttttggtgtgtatagaaaaccaccctttcctataaacttgggattaaacacctattcgattagcacagctacatataataaaattattttacaaaactcttacaaatgatcgtatcaaccaatcaaatctagaatcactcgtagcgtgaaacatcaatgttattaagagtttagtaagataattctagtacgtatagactgttcactatatacgcataccatccccctaccaccaccaacacctccatgactatcaacatcaccaccatgtgttcttcctaagattacatacaatcacatttcgtatgcatgaattaatattcaatttagaaaactgctctatatgcttctattaaatccacaaatctatgatatatttacgggcctgattggtagagctctaattcttaaatttagctctaggagttgagcatggagtggagctgtggagctgtctaaactcagctccgtctctctaattcattttgtaagagagctccacctagctctgctcttatttttggtggagttaaaactgtttggctgagagctggagctggagttgtaccaaaacaggcccacgcgtacttatcttaaatcattgcaaagttagcaaccgcctttcatccaacacatgtccagttcctgagtgtcagtgtccaaagagcaggtgtacctaacattatagccaagccaaggagaaagagagagtggccgttttatgtttttccgttccgttcccctagcgcttaggcttagcgctccatgtaagaccaagacccccgcgtcaaaccgcgggccccaccgcgcagccgcacgcacgaatctcggcgcggatcggacggcctctcccgccctcaaaaccctcacccacttcccctcctctcctctcctctcttctcctctcacccgcgacctcgctgctcgcctcgatctcccgatctgctcgtccccaagcgccgcgattcgccgcgggtggatccgacgccgccggatttgagcgtgggattcgactcactcggatcaggttgggggttcttctacttttgtttttttttctgattttttttggaatttttttggggggtgtggaatggcgtgagaatcaccatgcgggtttggtgcgatttcgtgtaggtttgcgtcgccggtggtccgattcgggtggccatggccacgcccgacgacggcggagggggtgtcggcggcggcgcggggaagaagttctggcgctccgcgtcgtggtccgcctcccgggacacgccgcccgatgcggcgacgcctgcgggggcgggcggcggttcctgggcggcggcactcgacgcggtgcgcctg

SEQ ID NO: 57666 - DNA, 38349 bp, Oryza sativa
gttggtgttaccaaccgggactaaagatccggggggggcctgacaggccctgacagcattcgaatcgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatgtattcagaccctatttagatgggactaaaacttctaagtctcagtcacatcggatgtttggacactaattataaatactaaacgtagactattaataaaacccatccataatcttgcactaattcacgagatgaatctattgagcctaattaatacatgattagcctatgtgatgctacagtaaacattctctaattatggattagttaggcttaaaaatttatctcgtgaattagttttcatttatgtaattagttttataagtagtctatatttaatactttaaattagtgtctaaatataaaaactaaagttaagtccctaatccaaacaccacctcactctctctattctttcctgattaagggtttccattagaacgcttttgacaccaataaccggtgcccgttgaaaaactttatatatatatagattgcactaaaatatcaaataaatctatttttttagtttataataactaatactcaattaaaatgatatttttgttttaggtgcccttagttaattttagtgctgatctttccattaaaggccgagtttagttctaaactttttttcaaacttttaactttttcatcgcataaaaaatttcctacacacacaaacttacaacttttctgtcatattgtttcaatttcaaccaaacttttaattttatcgtgaactacacacactgaaaaaaagaaatctaaatcctcatcaatctcgaacgggatgcgaatttcatccgatttataaccgctccaaaacccttctagaacgtctcgtcgttcaaatcgtccgcaccaaaaacccacacctccttttccttcttcctctgcaagcaaagcaacccggtcgaacaccacacgccgcgccccctcctccactcctcctctctcctccgccgccgcggccatggtgctcgagctcgaggtccgtatgccctccacccctcccctcccctcccctccccatttcgtccctcctctcgcttccccccattccgcgaggcgagctctagccgcggcgagcccggccgctacggcgattgaatttctgacgggttttggaatcgcgcgcggtgcaggcgacggtgatatgcgtggacgactccgagtggatgcggaacggcgactacccgccgacgcggctccaggcgcaggaggacgccgccaacctcgtcgtcggcactaaaatgacggttcgtttgcttgcttcgctgcctccgcttacgcggcgttggattggattggattggatcttttttctttttgggtggggttttgattccgggattttgggggcgtcgtgtgcattgcagtcgaacccggagaacacggtcggggtgctggccatggctggggacagagtgcgcgtgctcctcgcgcccaccagcgaccccgtcaagttcctcgcctgcatgcacggtgcgtgacttgccccctaattgccatctaattctgtgattttgcctgtttctccaacgatccagaatgtggggtagttcattggtcaatccatgatcactttggtttggtttgttgtgtttcaggattatcagttcagataaaatgattgttggttaatggttgagatgatatattgatcaatccatgatgttgtttgccgaaaatgtaataacgattccagaatgtgggcattgatcaatcctcttttgtttggtttgttgtgctccatcaggattatcagttcagatagaatgatggttggttggttagagtgcagatagtttattgatcaatccatgatgttgttacttgtttgccaaaaatgtaataaggaattaaggacactgatcacattttttgttagtagagtagcacgaaggaaccattaacttagcttatcctcctggaattcaattatgaatatatagtcctgtcttaagaaatatacacaccttctgatcggcgagtcttctccaggatgatcagtttagatagaaatgatgttggttagcgcgcagtcgtagtttactgatcaatccatcatgttatttgccaaaatgtgacaagcacactgatctctttattttctaaggtagtgctaagaacactctaaggaagcattaaattagcttatcctcatggaatgcaactctgaacatatgttgtcaggatcactgagtctaatgtgttcagtgttcaacgaataggtaagaagaaccacgacgagttgtcgtttctgtgttgcttatggaatatgttaatcgcattttgttgtacgatttggctaaattcatgcaaagaaacaatgcttagacatatctggtgtctcccctgtatggtccacttgtttgtaaaggaattgtggtaataattgtgcatttgtactgtcataaactcatcacctatatttgctttcattttgatatgccattctaaaagtattatctatattacaaggaagagatgatatggatgtaatgagaaccacaaaatgttaaatcttgttgtgatcgatcaaatacttgatagttgttaacactgctgctttaaagaaatcatgtgtcacatattcctataactgaaacactttttatggcagggctggaagctagtggtgaagcaaatttgactgctactctaaatattgctgaactggtacttaaaaatcgtcccgacaaaagactgagtcagaggatagttgtttttgttggcaggtaccgcaaaaaagttgcatgatagattctgttccaaacttctcctatcacaagtctatgttgatgtgaattggatgccgtgtatttgtgactggagggagcaataacaatctgaaatttttatttgagctgaaattatgctacattgtcccttgcagccctgtaaaagatgaaaagttagagacaattggaaaaaagctgaagaagtataatgtttctcttgatgttgttgaatttggcgaatctgacgatgaaaagcctgagaaactagaagctcttgttgctgcagttggtggcagcagccacatagttcacatcccacctggggaagatcttcgtgccgtccttgccaagtgaacatctattatgttatctgcaggatcttacccaaatacctagtgctagagtatgctatcactaataagtaataatcctattcctttcacagtacaccgataattactggagatgaaggagggggtgctgcagccggtggagcatctagatatgaatacaatgttgacccaaatgtggatccagagtttgcagaagcacttcgtttatcagagatagcaaggcaagaagctgcagccgatggagcatctagatatgaatacagtgttgacccaaatgcggatccagagttagcagaaacatttcgtttggctgcaggggaaccttcaacctcaaacactgatactgttctcttggaatctgactcagacacttatgttccttttcatgagttcatacaaaataatccttttgtgactggagcggaatctgcctcagatagacctgctgacgatgagagggcaacggtatgctactacgtgtctatgttacagtgttactatccttattgagatcactggctttctttgtgcacaagtccaactactatcaaaccatgaactctatggctgcagaattccatcaagcatatatttgtatttgcggtgatgtctatcagtttattgcctcggagcactcatccctcaaaacatcaaaaatcactgtgcacccatgtgtgctagtgcgtatagcaacaccctatgaacttaactgcccttgggaagtgcttgttctgtcccgtgtagtattctccagaaaaaaaaaacataactctagcaacaatctgtttccaaatcagtttttagtaaacagtaatctgattatatgaatatgaataaacaggaactacatttagacttctaatcttggatctgtttagaattttaaatattccctttttcttatttgggaaccttattttcttttgaagcgccttgaatgtgttgctagaatcttgagccacttcctcatttgttgtgcttaccttctaaagatgcaaattgccctgaaaaaagattgaaatggtcatgattattaatcatcatcatttgatttctttggtgctattttactggcaggataacattaacaatataattggtgagataattatagatgctattatcaatgatttaagatttgaaatatatatcctatggttatcagcatatgcaaaatgtagctacaatataagtcaggattacttttctgggttccttgcgttttatttgggaccttttgtgttttacattcatgttcaattgatgatgtttgaagttttccatttccgtcgcagcaacttttattggggtgttgttgttgggggggggggggggttccaattttgttttatcttctatggaacattacaatgttatcagacaagctagttatttatgtcattcaggaagaagggttccgtatgatacgagaagctcttgcaaggtctgcaaatgcagcacatgctgaaatatcaggcaattcctcatctgggcaggagttggaattaggttaagcgagaagattaactacatattgttaacatgtgtccattgtttttgccatatggaggttggcaggttgcgcttctggtttttttaagtcatttctttgttaataatactggcattaaacaatgtgagtttcatcaattgtgtactttttacaacctaagattattttatttagttgtataattgatcatatttttttgctatccacatcagaaggtttattttcaacagaagaatacctgttccaactggtaaggtactgttatatgatgtcaaaaattgtgaccagctagagtaatctgaatgaaaaacataagcaaacttgttcttcacaattagcagatagagggatccaaaataaaatcataaaaacatgccatattacaaactatatatgctgatgatatctttgtgcattgtttatccaacttaggtaaggctgaattccattatcgacaatgagtaaactatgtttgtgcagacccatatccatccattgctcttgcactgcattcaaactgagtcactagtatgttttgtgaattgatacttgtttctcagaagaattgaaaggagatctatttttggttgggatggctctatatatttgttgatattctcgtcgtatgatctattagtctctcaaatgtgctgtgatgtggtgcagatccgcaaaggactggagagatatgctttcagtttgaagtggaagatatcatcaatttggtgagacatgaagcttgacgttttctcagcagccatgattgtcccatactctccacaatccttacaccagtctcaattatattgatttactaatgaacgtttatttctaaaaacaaattgcgtacagatatgctggcaagggtggcagcaatgcaaatacaggaggtatgctttttgtatgacagtttctgcttgttaacatatggtttgctattatgttcatcttaaagttaaaaaggtatatgatgcagacctgcaattttgacccacttacacatctctcacctctcaaatatcccatcaagtattgcttcgctagcttggctgtgttcccaactcatctccctcgttttccgcgtgtacacttttcaaactgctaaatggtatgcgttttgcgaaaaatttatataggaaagttgttttaaaaagtcatattaattccattcttcaagttttttatagctaatacttaattaatcacatgttaatctattgctccgtttttcgtgcggaggggaggggttcccaacccctccaagagaacagtgtgtttgaactctttgaagcacacctattttgcacttgataggagcgaagagtcaagagcttaccttttttttatatatataattcaagaaacaactgaattccgtgcattgatcttttacagttaattgtttcaacacactcccaaaaccacattaacgatgttatatttctctttgactgtttgtttcaagggttcatctaaattttctctatacctgtctgtgtaaattcatttatttccacattggcccatgcatctgaatactggtggagtgatgctgttgctttgtttgctcagcaagaggaggaagaggagggagacgagcaagacgaggcagatgatgacgtgtaaatgtcgtcaggtggttctgtttccttcgagctcctttgttagctctggaccggatttgtagtcagatgaatcgatcatagcatacataggaatatacgattggtatagccatcttcttattgtggttctctgtaactatcgattgaaccaccatattgcgtagtcaaaggaagaagtagagaaagagctgagcctgttagaagtagtaaaatactttgtacattgctgtacatgttggatcttggatttccctggttttgttacgtcgtggtagagggaggtccagtacttgcgggtatgttgtgaaaaacgttcatgtgtacccagaaacattgaggttttgagcttttttatctgctatagcctatacattggaattccttataatctgtttgttctgcttttacagggcgatgtctaattttctatgttcaccgtgagaaatgaacaatttctcataaaattcatgtgcttttatgtgtctcaaataattctcaaataatacgggaggaggagaaaacgtgcggaattggaaaatcatacgggagaataatttgttttgctgccaccaaatggaaatgtatacatattaaagggttaattggatatatgccattgcaactttgctaaattaaaaaaaataccaccactattcattatatcaactatatgacactggaaatttctaaaattggaaccatgccactcccgtcgctttttcatctcctctctcacgccatttcaggtcctgtcctagcacacgcacgcggaagctagggcacccgcggagcagggctgaggatgcgcgcgcggcgcttgtcggggataggagccgcggaggcggcggagccgcgccgggccggctgaggtggctgaggtgcgcggaggcgcgtggagccatggaggcggcggatgcgcgcatggccggtgggggcggcggggccacgcgggggcgggcggggctggtggaggcgcgtggggccggcagaggcggcagagtcgcgcgtggcctcgcgctcgtccaccggctcgtcgccaacggcgacccgcgctctaccccatggtcaaggagagcacgcagctctcctctgatgtcgccgtcgtgctcgccgtcctccttgaccgcttcttcgacatggagcaccgccaagcaaatcgacgacctcctcgccttctacggctggtgcgatgacgtcggcctcgcgcggtaggctgacttcgccgatgtcaagcgcatcaacgacagaaggcatccataggcggcgggctggacccgctgttgctactgctgcggcggcggagccgcgtgtagccgtggataggggatgaggacgggaatagagacggcgtgagcgagaaggacggaaaatatgactggagtggcatggttctaattttagaaaattttagtggcatgtagcatatatatcgaatagtagtgatattttttcaatttggcaaagttgcaatggcatagatctaattagcactattaattaacgtgaaattacttcctccattcattaatatatgatagttttaacactagtttaagtgtagttttagcatcgaaaaacgttgtctattaatgactgagggattataattcatttaaggaaaaaaaagttcattttgctcccctaaaagatttggcctttgtctcctaaataaattttcgactcattttacacctgagctattagcattattttttttactttatataagttgtattttgctataaagtttggtaggattggtagatgcattgtaaccttaccatttaatattttctcgaatttgttatcattgtttacgttggaagtatatgtaaaactatctctagcgcttccgcacattgtatggctatactcaaccttttgtccaaatagacgggaacattactgccatgtgggttctcgcaaagggttccattagagacatactcaaagaccataattggagcatttttctctgtacaacatccaattagcctaactacattcttatggttgacttggctgtggacaattacttctttggcaaactcttcttctgaatctatgcgggaatatcttttcaccgcaactgcagtgttatcatcaatgattccgttgtaaacttttccgaatgaaccatttccaaggctagtgctgtagttgctggtagttcttttgatctcatcttctgtaaaatactttatgttatgattattcttagctatccattttgccttgtcagctccttggataaaatctctaagcttattttctggaagacctagtttatcttccattttgtgatgtgaataattaaagatctttctttgaatgaaatgctgatcacctttcaccacagaaataagttgttaacatagcttgtacaagagcaactcatttatttcctgttgtagtataccttaatttgtgtcccattaccatattggatttgtttcacctgtatatttgatcatttttgtaatgcatcttagtagtgagctgtggttaggggtgtgagtaaatctcacaaaactaaagatatgttggtaaaattagcttacaacagtttaaagtgtgacaaaactagaggcttttttcttgaatttatcactaagccacagattttcaaggtgaaccagaaatgttttcttattctaatgagtggatcccacctgcagttgatagacaagctgatgacttctggtgttgcctttttttttctttcagaaaatggattaaaccagcctctacatccgaaatggatgtgcatggccattctggtaccctctagcatgcacagttttgatttatgaaaacagtacaagtaaaatggacaataagatgttatgggttaggattcatagggggtaaacaccatcgggaggatagccgggcggcgacggctgctagggatgagagggggacttaggttgggagagactaatcttgattcattgcttaattagaataacggtacaatctatccttatatagatggagggaggacccaatctaatcttatcgaaccgactctagctatccttatccctagggcctcgacccatcggcccactacttatgacaaatatgtaggagtaaaatgggatcctgttggctttaaatattcaaatcctaattttctagttactgaaatactgaagggagcagctagattatagatggtaacctgtaattgaatttacagttaagatccaatctatgctggcaggacatttgtgtaagtatttagtaagacaccctgttttgtgaaaactttccaacggtcgttgaaaacttataatctgtaatagtacttttattcttgtgaaaaaatgagaatacaactaaatcgagaaattatcagatactactatactagagaggaactctagaagtaggaaactaggaaagaaatcgagagagatgagttgataataccaggcctgaacagaacaactgaagggtcagccgagattcatccagcttcgcttcggctggtgctgatttgatttcaagctactattattttgccatggctgcttgcatcctagcttagcttgttcaagctaatgcttctcccatgaatgcatgatatgcaggcaaagcccaggatgatgagacgacgacgacgacactgccattgtatacaatacatgtctctgtcgggcagctggtgaacgaactcgacgaaagagtggagttggaattgactagcttgtcagcctacgcgcctgttgttctcatggtttacttctcgcactgtcgtagaaacatcgatacaaatctcttaattcatcgctgacggttgttagaattcacagtgatattggcaagttggcagctataaccaattagtacccccccttcttttttatccaaaaatgtaagcattttttttggagttaggtagtacagtactaagtaggatttaggtagtatatgcattattaaaaattttaaaagtaggtgtaattaaacaaggtaattttgtgattggttcataagagtagtcatagaaattacatttgagatacttatgattggttgaaataagaggctaggtgaaaaaataattacatttttggactaaatttaaattatcaccatcaatttaaattttaaattaaactagaaaaggtgcccgtgcgttgcaatggatgaagtctattttaattttattattgttatagcaacaggaaaaaaataaaattataataattactatatgattagatatagtttttataatatcagctctttaagaaaaatatattcttcaaatagacctagtaatcttatgtgcaattcataatttaccataataataataagaatataaaaaagtcttcaccctaaaaagtggaagaaaaatcataagatgaaaccaagaattgagcacaatctcataacggaaaatgaataagagtggagaattattgttttaagggtaactggagtctagtttaatttttcattatgaggacgatataaaaaaaacgtgcataacgtgtaacgaaagcacttcggtttttagtagtgtgtgatctccaactgctctttgttagacgaaaccaggcatagtcgggacggttacttcaatcctgagaccagtcattaaaacaaagagttatcatggtccaagaataaaaaagacgttttctcaaatattttatttagtgggatataggattagaaatattaatatcaacgttaacagaaagtcgagtcaatcttctgttagttattaatttctctatcgaacaattgagtatgatatcacagaagcatgagttctccttgaaagccaagcattattttgtgcattaaaatatttccggttaattatccgccttgcaccctcgctgattagtttttttttacggacccttgctgtttagttgctctggacggaaacggattcgatttacatggcggggttgtttgacgcgggaaacgctttgtagacgatatcagtacgaatcgaaaacggacgacgtacgaaaacttgtggcaaaaatatcttaaacttttacaataggtaaagatagttagaaatatctatattttatgatgggagggaataattatcaccatcagttcttattgttcatcaattcttattgttagtttccttgtagactctgatattgtcatcttggggccagcggactcgtaggacgccatcatctcggtccgtgtggcattggcaattggttatggtaaatgaagtggacatggtgtacatctctaccattataagtcatttatgtttgagtcggtttttaaaatttgttttattttggaaatataagtccgtgtttgagtcagattttaagtttgtttgtttttaaaaatacaaaagaagtcatataagaaatctatttaaaaaagctcgcatactaatttgagatgaaagtcgtactcctaattacagctcatgattatttttaaaaaaaattcaagcgaatttacagtcatatgttgaggaaagcctgcaattgtttcaggctttgggtattactatttactcactgactgcatcaaactaaaactgagtatgcatcgtaccgaacatagattgtttgtcaacaataaaatttcttaagaaaccaaacagtcatggtcaaaacgactatgactatcactacatgtagatggaggtaaaaaggggcagcctattgactacagtaactgcttttgctagtgagcctgagggtttaaaagatacatcacactaactctcagaaaatacataatagcacacctggttactggtgttccagattaaatacaaataaaagtaagttcagttctgaaaacgattacacacaacatggaaataataatcaagcagattgctctgacaggttactttgctcctcacgcattcctccaacagtttttaccttgcccctgctcctaggcctttagcatcactcattcttcttctgtaaatgtcgtcaattatatacatcacgcaagacatttctgaatgatgctgtagactacaataactacacaatagagagattcttgaaaaccagccttattgaaacatgacttacaataatttaaactcaccttcatcactactaggatagggcagattgtgcctataattaaaactcatcttcatcacaggttcacaactagagtatgacgcactatcatataaattggacgaactgggattgggtggttcatcgatgtcgatggtgccctgaagcatctcaacaaccttctgcatggagggtcgatggtctgcactgaattgcatacaccacaaggccgttttcaccatgtgctctgctgtggccatgcttctggcagaatcataggcctctgcctggataatgcatggatccaggcagtccacaattcgttgctttagataaacttcctgatagactatattgacgaagtcaaatgactttctgcccaccaactcctcccagaacatggtgtcacggataccaaagacgatatccagcagcagctgaccgaagctgtagacgtcagcctttgccgtgatgaatccccgagagaaaaataacctctctggtgccatatacatgtagttacctggtactacttcagtagtcatgatggtactctcattaataattataggtgttggcttggacaacttggagcagaagttaccatccaggagaatatcccacggcgtgatgctgccattcagtgtgtccagccacttctcgtgcaagcatgctatcgcgttcgccacccccaacgcaataaagtgacgtgtattcatatccaagagtgacctttcccctgtttcttcacccttctccacaactaggtaattgcaaagggcaccattgggcacatactcacacactgaaatcggatgatccatctccaggcaacaaccaaagagcttgacaatgttctgatgttgcacttgagattggatgatcagttgcaaaacaaactcctcacgagattcactcacgttagtgaaaaccttcactgccactctggtattgtcatcaatgtctcccaagtaaacatcgctgctagagcttttactcagagcagttgagaagttctgtgtgatattaagtatttcctcatttgtgtaaatccttatgttgtagatgtcttttagtatatgtccaccattcttcttaaagttattggttgcgccaatccagttgaaaatgccaagactcttcctcctatagagaaccgtgttggagttggaattgcttctttcatgctggttctcttttttcaaatcattctgacctccagaaaagaattgccaacctgtcttttcccccctagttcaagagttttcctgagctctcggagacgtgcagcgacatcattcatttctggacgtttatcaatgtcctcttttatgcaatcttttgctattttccaaataccctcaagaattttcatgttgctctcctttgcaatgtccacatcaaacaactcctttgcacccttccgtttttgaggagcttgaataaatcttctagtgacatttttctccatgtttgttggctttgtttttgtaatgagttcaataagaacaactccaaagctatacacatcactttttggtgtgaggcgcgcccctcccatgcaaatgttggatccatgtagccgatactccctcgcacattcacagttagatttgtgttatctgttgacagaatccttgatattccaaaatcagaatttgtgttatctgttgacagaatccttgatattccaaaatcagatatttttgcatgaaagttctcatccacaagaatattggacagcttaaaatcataatgaacaatgggattgtacatggagtgcatgcaccctaatgcttccgcacattgtataacaatgctcaatcttgtgcccaaagagattggagtatcaccacaataaagaagatcactcaagtttccattagcagcatactcaaatacaatcattggagcattgttgtctttacaacacccaaccagccttactacattcttatggttgacttgagtatgaacaattacctctttagcaaactcatctagtttatctactctgataaatttcttcacagctacgaaacggttatccccaataacccctttataaacctctccataagcaccctttccaagcttagtgctgtaattgtttgttattcttttgatatcatcttctgtgaagtaagttatgttgtgattgttgtccggtatccattttaccttgtcaacatctgggatataatctctaagaatgttttctgggaggtctattttgtctcccattgtatgttgatactgaacacaaaagagctctggctaggaatctgaaattccaataatatgatcttcttttctcttctttttttctaaaaggaacaatatgatctgacagactggaaacacacaaaagcaatttgttaaaatctacgtaaacctgtgaacatgatttagatcacagataatgttaaaacagtggcttcatcatgcatgttttggggagagtggatgaattttcctaaatttatcactaagctacaggttctcaaggttttgaagcaatagcttctgtcctgatgagtggccccattcgcagcttctgtcctgaattctgattttctgaaaatgatatagggaaatactttcataatacttatgtagacatgcaacaataatccttttggcatccagtttgcaggatgtaaaatgggatcctgttggctttgaatccttaatcctttgatactgaaagttgcagtcagactataggtagtttcttgtgttcattattctggttggacctaacctatgcatgatatttgtggaagtaggacagcctagtatttttctaaaaacttatcagtccgcatgtactaatccatgcgtaaacagatcctctgcagtatgtagtattgccctctaacttttagttgataacaggtaggccccatgaccagcaggcccacatgtcagtgatcccatgccaaagggcaatactgtagaggagactcatccaatccatgatgtattttattcttgtgaaaaaaaggtaatacaagttaagaaaccattagatctagagcagctccagaattaggcagctcgagagagggaaagaaagagtaaagatacgtgaagatcaatcgaggtgcagcttggcttgggcttgtgatgagatttgatttcaagctactctgccgtccaacgtgatggctatggctgctttgcaacctagcttaaatagcttgtactaccaactaattcctctaaaaaaaagaggtcattttcagccctcgtgccgctcagccctgggacggcacgggcggcgaccaccgagcgccaccgccaaccacttctcctcctcccctccgcctcgccgctgcccaagatggtggcggcagggctccttgcctcctctctcgggcatggcggctcggggcgctgccaagatggagggaggatcccaagtggtggtcgtcggcgaccagcttcgacgacggtggggacagatctgggcctctcatggccggatccggcgtcccaactagtgtgtaggcggaggtggtcgttgtgcgcatggagaaggccggcgacgcacggggaggaggtcgacgacgtgtcgggaaggccgcggcgatggtggccctcggcccgctgatggggatggccggttctggcgccccttggccagatccgccgcctggatgacgatggtgagctgccaatgcgaggtgggggccagcgtagcctcgcgcggcgcgggaatggctacgggaggtcagccaaggagggagtcgggcgcgcgtgacagaggcgggggcctggtgctacgacggagggggcgggtgcgccattggcagttgcaggaggccctcgtcggtgtggagacaatggcagccacctgctgcgcccaccggcggttgtggtggcgacggtggcagcggtgcagcggcgtgtgggcgctcacggtgacgttggcttgccgtgcttcgatagtcagatccatggccgccttggccagatctggtcggtgcagcagaggtggcggcaggttggcagcacggccgactcgcgaggctgcctaagttgtgggtggtgggctaggcttggtggctaaagggacgatgtggcggttcggcaacgtacgttgtgcaggtgggttgtgtgtttttggatgacgcttgcgaaagccttggctggcctttggttggcttgacgacggcggcgccattaggcatcgttcccctccttggaggcgtcattatgtcgtctccctcactaccaagaaccttttccatgcaaggatggtcgttcatggaccccccatgtcgaagctctatgagcccagctatttggtgaggccttcatctcctgggtgccgctcttggatgtggcaagcgtccaactttctccgttttcttctaggtgaagtcggagctgatttattagggtgcgatgaagcttggcaatgataacacgttgcagttttcgagggaggttggtgttagctgtgcacaagtagtagtgctcaagtggcttgggctgatgttcaaagtggacagtcggtgtcttgctcgttttctgcgatgcctttgtcaacgatgatgtgatagctgtggagtcgaagctactgtgtcgctaggtgacaagctcggcaacgataacacttgcctcgcgaagtcgaagcctttgtgtcgctttcaataagctctttatcgatggttgttttgggctccgccattttttcttttttcgcggtgttggtagcttaggttagagtgttgtggttttcatccagttttccataattaactgcgcattgtaagttgcgcaaggtttagtctcgttttctacttaaaatgagacaccttcttctttatataaaacatcggaaatggcctcatcgttcgaaaaaaaaactaactcctctcgcatggttaattatgcagacacttgcagttccaggaagatgagacgacgctgcaatttgtgcactacaacacaaaattaataggagtatatgtatctatcgtgcaggaaaacagatggacaagagagtgggcttgactaattaacttcttctccacatactatacgcggcaacttgattaattaacttgacgtacgtccaatgattattagatcatatattccaccagtgtacgcgttcaaggctcacacgtgctcgtatatttcttttaatttgcttcaggattaaatcttgaacgagtcattgcgcaccatgcatcttagaacgggatgcacaaatttagatgatgctgctcagggctggtactatgattttgagggccctagacaaactcaatgatccctctaagctatatataaaattttatgatatatatatatctatctctatctcttctctaatacttaaaaaattttatgatatgatatatatatatatatatatatatatatatatatatatatctcttctctaatacttaaaaaataagaggtacttccatcgtccgttaataagtatttggttcggacaaaaaagtcatgtccgatttcagaaaaaaaattacgtgaaaactaaatccgttacatgaaaacaaaatcccgtcggtttccagggaaaaaaaaacaaaattgctgttgggccatacctacagaatgcctattgggccatacaatcagtttgagatttcctgtagcccaaactaatatgttttagcccaaagccatatttactaatatgtttcagcccaaagccatattttagcccaataggacttggccactattacaaaaaatgaaatgaagatgtttccgttggaattttggtacgtcattcatattttagttggttttctaattttcatgttatccgtatgtgagttagttttctaatccatcaaatccttgtcattcgtaattgtacgtctggcatcatcatcacgtcagtcgtatgttagttgcagtctgtttcacacatgcaagtccctttttcatacgacaattgcgtgcgacatgtgtgtgccttttttttatccgagatgcacgtgctcgagttcctttttcatgtgccccttgccgcgcgccgtgattggacctgtgacggctcgcgcgatttgtttcctctgcggtgcagccattgggcccacagttgcataaaattgtatcaaattctctatactgcacattttttacgcatcaacatgatctctgtttcccattttatatatacgtaataagtagccagtgtaaccagtttgtctcacttgggaaaccgaaaactcttgaagtgactaaaactcttcaagtgcactagaaattgatgtatgtacctaaaaaaatataaaaagattgaaagttttgtttctcatgcgcataatcggcttattaggctagaaaatcagttttttttaatctctaacaaaatcccattccctctcgctctagcatatgtcacctcccttgctaagttgctgtagaataaccacactatctctccttccacattgccatcttactaggttgtttgatgatcatgcctctctatctatatactcaactttttcgtattttcttcctgttgcaacgcacgagcactttatgtatatatatatatatatatatatatatatgtatatgtatatacgtacatgtatacatacatatatatacatatatacctacatatatacatacgtacatacatacgtatacacacacacacacacacacacacacacacacacacacacacacacacacacacatatatatatatatatatatatatatatatatatatatatatatatatatatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcccaatccataattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcatataaaccatgtagcaacagggccatgccaaaaaaaaaaggtcagctcgatctttagtcccggttggcaagccgggtaacaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctagcctaaaaatttatcctaaaagagtgtaattaaatttgtctgtaaaatagtttagttatagagtggttcattaggcctctttaatattagattattttttttcgtttttagctattgtaagtcattgaacagatgtagggagtactttgacaccagaagtttttttttaggtatttttgtttaatttggtgagtgtgcgtgtatgcatcctccgacctcaaccacacttcagtcatatttcacgcagaattatgagcccagattggcttattatggcctcgatcgaagaaaagaaaagctcaaataaaattttaattacaattgcgtgctcctacgtgaacctcgtgatactgtagtaatataatccaatatagtatttgctgtgtttcattttatttcttcagaccgatggtcccgttatgccggccagccaatgcttatactgtattcttcatttcctcctttaagagttgtccacatgaccgaatggactgtcctgtgatcgaacaagacgacatcaacctcaggttcatccgcattggatttgaagtttgtatgttatgtattaaaggtttaaaattttatattttatttaaaatagaaacaaaatttttaatctaaatgtttcaaagatttagattatggatttgtagagatggaaatatttagtttaaaagaaatttcgaaaacggagttgtgccaatcagagtacttaaaacaataagttcactttaggtctctcaatttgtcgttgaatccgaacttcgtccctaaaccgaaatatcccatcccggcatcttccaacgaacaataccatgtaaattttggtctctcagcagtttaattgccgattttggttgacgtggcgagtgggacccatgtgggtcctacatgttagtggccaattcttctccctcttctccatcttctcttgaggacatgaaggaggggaggttgacggcttcgccgacggagcggtactgatcagactcggtggaagaggcactggacgagctctcggggagatgcctcctcactgacccagccatgccgggccaccccatcgtttacgcctccaagagcctcatcttgctcacagggtactcacctagggaggtgcttggccgcaacacgagactattctagggtgcgaacacccaccatgttgtcgtgcccagggtatgggaggccatgcagggtgcacacatcagaggaagacaagcatgattgtagtgtcgagcataaacagccagtagcacatgcccggagacgggcgttgagccagccccacccttgcagtaccggcgccatgccgcacgcgtgtgccagcacaggcggcctctgggtagcaacaccaatatgtgaccccgtcagcgccgcagaccgggtccaggcggaagcgtcgcacggggcacagcggggccttgttccccctgtctgacacggggtatgtagcctagtgattggagacctcggcctccgaggccgtgcggatgaggccagggtttgggtgaaaggagtgagagggccgcgaggaagaggacgaggcggcgaaggcgggcggtgggggtgtaggagggtggcatggtgacgaagacagtgtcgccgacgactgattgtcgccaacgaaaggcttggaggggatcatgatgccggcctttgtagtggtgggtgaaggaaaggggagggtgcgacgatggttaggtttggaagttaacaacacagtggtggaacgggtcgacgtttagagaggaataagagttggccactggtatgtgaggcctacgtgggtcccacactccacatcagtcaaaaccgacaactatactaccgagaggccaaagttaacacggtattttgagttgggggttgtgctatattagttatttcggttcagggacgaatttcagactcggcgacaattaaatcgaaagacataaattgaacttattcccttattaaaaaaagaattgaagaagaggagctagggcctagggatatgggtcggctactgtgggcctaatgggccggtatttaaatacggatggcaatgatatgttgccttctcaaaatcaagtgaggccggccaattagtacttgctagcgacaggcctgctaaggtaagaggcccaaacttagtccaatccacgttctagcaaaggaataagttcaccagccattcctcaactttacaccgagtttatttgacatctcttatcctcgataccagaaatctctaccattaaactatacgaaaccgtgcaatttaggtcccatagcagtatagatgtccggtttcgctaacgtgtcatcctagttagaaaaaaaagtaaatgccactttggtccatgtatatttaccaaagtggcaacttgcaccagggcaaagtctaagttttcatatcacaccatctttttttaccatcctttacagattgcaccagggtttaccgtttaattgggcgaccaagctaatctttggcccaatccgcgtgaacaatagcgttttggctcgtgcggcggcgacgagtcacgcgcctcgacagtgatggggatcgacgacatgcatctctcgacgtcgatgacgcctccgcaagtccacatacatcgaccgaccgccccgccacaccatcgtgtaggattaaacatggtgggattcacgaagcagccaccgtcggtcgctgctgaagatcatcgacggcgacgagagccagttgtttgcttcgctgcagcagtatgcggcgccgctgatccgggtgagccccgagtgcagcgtcgtcgtcaaggatagcgagagccgagagctcgttgccgccaccgtctgaaggtagcagataaacaagcatgcatccatcaagtgggtagctaattaacaagataatgcctgtagactttagtgatggagctataccctatacctcgtaatagacacgccttgtgatcatcatcacgacgaggtccagcagcctgggcgtgtccgacggtgcagcatatcatgtctggcaccgtccgcagcagcggcggcaagaggggtctcctccggcgccatgggcggataagctactgacctccggcgccggatgctagcttggccctccaacagcgatgctgtactgcaggccggggggagcactctcgctatacgcgaaggcgttgtcgatgtcgagcgagccctcacgtcattgctgtcgctgctctccatcactaccgaaaacgaatctaaatgtatctatatgcatgggacatttatcatggccatatccgggcgcgatatatactgcgggttgatgtcatatattcgtggtgcgtagcaggcgaaaagatctgtccgatatacaagaatctatttaatctatgacaaaaaaaattcgtcatagatccctgaaaattcgtcacataaatttgtccgtgacgattctacttatcgtcatccattgagagtcacagattaaatctgccgacgttttctctgaaatcgtcacggatcagcacaatctatgatgtttttttaaccgtcataaacacttttgggctcatgtagtccagccccggcccaacctttgtgacaaaattaaacgtcacagatagttgagacatggcggccaacatggcagatgacgtggtcgttgacacatgtgtgatgacatgtcactgatgacgtggcaggtaacgtcaacaaatatttttaaacggcccattatttttttgacggcccattaatttttttgacagcccattaattttccagtgtaaaatttggtatctcagtacctccacgttagaaggtaccaaaatttacactaaaaatattagtacctcctggtacctgtaaaagaccttacaaacttcaaatctaccatggattttggatttgaagctgtgctaaatggaaccataatttcttaatgaggttgaagatgaagattaagtgttttatgcaaaacgatgttgtaataacgtatggttaattgagttttaattattccaaacttgaaaatagattaatctgatattttagaacaacttttatatagaaagttttcacacgaaacataccgtttagcagtttgaaaagcgtgtcacgagtatccaaaattcaatccaacttttgttggagaaaagaacatggcctaagggcaagatattgcaaagcacatgggacagatgaatcaaccagggtgatcacataattaataagcatataaaataccccaatttatcgatcaatatatcttgataaaaggtcataaaaaacacaccccatcaagaacttttcactaattccagtgaatattactactatgtaaacccttaattagccttaggccttagccattaccaagatgggtttacttaattgcctcacaacccctcaaaatgatagaaaataaattcaagaaaaaatacacactttttttttcaccatttcttccatccaaagaaaaaaaagtcttggagaaagaaatggaaaaatagagagacaccagaaattaaaaacatgaataatagtaaaaaccaccaccgccggcaaatctcgcatgcataaatatcggtgcgaatgaggcggcggcggcggcggcggtcaacgccggcgtggacgtccttccctcgccgacggcgttctacacggcgcaggaggcggcggcctttgcggcggcggccctgacgagggagaaggtgggcagcggcaggctgctgggcggcggcgccagcgcgtgcaggaggtcctccacgaacccccgcgtcacctcccgctccaggtcgtcgagcgcctccgccaccgccgccggcggcggcagcggcgccgccctctccagcggcctcctccgctgcggcgccctcgcctgcccctcccccgacctcggcgtcctcggcttcttaatcctcctcctcacaaccgtggctgacggcggcagaggcggcagcatgcgagggaggagaggtgttgccgtcgccggagccgacgccgccgccgccgccgcgtagtaggtgtaaggcaggtgtagtgggagagagagcgaggagtacagcgacgccgcctcgtaagtcgtgtactgaaacggaggaggagatggagcagcaaaagtgaagctgccctggatgcttctacgaggcggtggcggcggcgccacggcgagccgccggccgaagtagtcgtcgaagccgccgccggtgacttggccgatgaggaggacgttctccatcgatggatggatcgatctgaagccaagaaatcaagaggcaaagctagttgtggaaactctgcatcaagaacgtgttgatatgatcacttgatgatgaacagagcaaaaacacttgcaaaaaagaagaaaaaattgcaggagaggagatcaaaggatgtggattgtttgatcaaaataaaaggtgattattagtgatggaaatttctcaaactttgatctgatggaaaggcgctagagaggaagagagaagagtagggtaattaaaaaggcagaggggaatttaattagtagctaattaattaagaagctgctaattaacccgcctctcacaggcctccggggcaagggcaagggctcgggctcggaggaggtgatgcctttgctgcctatttatgtagagatcttagaggagggtggtacagttgactttccaagtcgacatcttgcttaattttatgctaatttattggtattagcaagtgctttgcacatgtgattctctaatcccaagttgttattcttttcttctgcacccgctgtactagcctaattattttttgacgcatcaatggcataggttcattaggaattcttctcttcaaaactaattatttaaagatattttttcgataaacacactacaaatgcggacactaaaaagttctgctcttcaaaattaattatattgatgaactaaaactgcagaacggtttttttttacgcaaattaacagatatattgtttctaaggaaacagctggagtctcttaaactcgagatggtttgattacacatatatttaggtgaaaagaaagccatgatatgatagacatcatgattaatatcatgcaaacaaattcacttgtaaatttatattaatatctttattttcaaataattgttaattttgcatatggccagctcactttgaccacaaattacttccatatgattatattataatgaattaaaattgtttggctagatttgtttacgacaccacatacttcaatagtacgacatattctaagcacatgaagtttttttttttgggaaaatattaaagttttaacttgaatagcgaatattgattatttgagatcggagatgatattattttacaagataaaaaataggaaaataaaatctaatccaaatgcacaaatttgagtaatcaaatgaagaaaaacattcatgggtctccatgcagaaacaacttgtcccaacttgcagcagttgcacatatacatattctccattttttccgatcaaaaaaccaataagagcaccgaccaagtacggcctgtcatcacgtcaccctctggacccgaccgcccatgaccaccatccaacccccaatcatatgatcgcacgacagcgacgccgccactgacagtgggacccacataacccgatggccccacatggaattgacacgggtggctcaaccacgccgcgatctctcgtgtggctgccgcgatttcccgggcgtggcgggaatctctctctctctcgctgcgggcatgtgcgaggcgaccaaccgccaaagcgatggtggccgtcggatcggggatcgaggcacatctggccgtccgttgctgcgtctggcactgctccccacatgctgcccgtattcgtctacttgtccttttcttttagattttgtcgagctgctgtctaggtcaccacccggtcattgtacatgtacatcaatatcttaactagccagattaataataattgtgcgtttttgctatatattcttaaataaaatagttttacagaattacggtatttaagaaagtacctggatatatactcaggtaccctaaaatttgtcttttaagtaacacaccgtggtgattttgccacaataaaacgcttttttattcaattgagactcactatgttgtccaaccgttattaccaaacactttttatatttaaactttgaccacttagattttttaaaagattataaatacttaaaaagcttccatttcaatcaccatagtctaactatggtcgaagtttaaaaatgcttgtcaacaacgtttttgccggggttacgactatatcacagctaaccagaatagtccaacaagcataaagataggagcggctgcagccctcgtctgccgaacaggcccaatatttctgaacatgtggaattataatttgtaggttttatatttaaaaaaattactcttaggtttttagattattgaacatgcttgctatatttatccttttttctaaaacagtattcctgatgtaattaacactagtgcacacgcgcatatatgcatccagtgcattttttttaaccagtgagatgcgcagtggaccggatcgatccgtacgtaggattggcgaagacggaaaaggatgaaatataattctccctccgtttcaaaatgtttgacaccgttgacattttaggacatgtttaaccgttcgtcttattcaaaaacttttgtgaaatatgtaaaattatatgcctacataaaaatatatttaacaatgaatcaaatgataggaaaagaattaataactacttaaattttttgaataaaacgaacggtcaaacatgtactaaaaagtcaacggcgtcagacatttcgaaacggaggtagtagtaatttgttcatcattagtggtggtgagcacgtgtactgcacatgaagattcggcaagcaccgaccatgtccaaattaaccgaaagaagaacgatcgatctatacatgcatgcatatataataaaagaaaagaaaagaagaaaacgaaggaagaagaatctcacgcgctcttagcttagctaacgatggtcgatgcgccggcccgatcgtacggcgcccgtacttcatctcacaaaatgtcaatcgcacgatcggagcaggttaatcgaactcgttcaggatttaggccccgtatgattgaaatttttatctcggtttctcttagtactactaaatggtgtcgtgcgaaaacttataagttactttaaaatacgaaataaatatactttttaagtttgtactacctctggctctgtcccatagtaattgtatttctaggatttgaatttgttttaaaataattatcacaatagagtactaatggtcctattaatcacttattgtccaactttctttctcttttacccttaactatcattccacttttaactttacatcatttaataaggagcattataatctttcttctcaaccttaatatatgctaaacaacctacaaatacaatttatatgggatggaggtagtaataattaaaactcaattaatgatacgctaatgatttttttttcgtgccttaacttcattaccatctttattagaaatgaacacgggatggttgacattaatgaagattaagattaagtaagggcacacaaaacaagaaaatcattatatcaatattaattatttttaattattacaaacttaaaaatgtattgatattttagagcaagttttatactataaaaagttttcgcactaacacacgttctaaaagtttgaaaattaactatgctaatgaaaactgaggtagaatcggtatcctaatcagtaataaataaataggcctagtagccggccacttgctaaattgtttatacaatattatgagtatatattattgataagtgtagtggtggaatcctgacctagcatacaagggttatatatcctattctaacggtgaaaataactgtgcgagtttacagttggcgtgtagagacaacaattatttttaaactttttaattaactaagctatgtaatttttttaatatataggtatgtttctaagatgtggtttgcctattcttattttaatttgttagatatatatggagccattaggcctgccaccactgtaccgaggcctgtcgcagccggtggcatggttgagggctggaggctagctagggcggtcagatcccgatggcacgagctcatggcagtggtggtagcaataccgttgcactgactggggtggtgtttgtgtaggggtctacggcgctgtcactggctaggagagagtgttggccgggtggagcagatggacatgagaccgtgcagtgctggggaggagatggggatcggtggtctctctaaggacatggaggtgatgttaggagaatgcagctaggatgggacttatacacatcaaccgttgatttttattatatcacctatttttcaccacaagttcaaaagaagaccatctacaaaaatagctaaataggagctctcttataggaaactgtatgtaaaaatcatgtttttcataggaggtcacctaagaaaagcacataaaaaataaccttattttcacatgcatttcacatgcagttctcttatacaacaattagtcagaatcaaatttctcgagtgttttaaaagcataggaccaccttgtaagtattattagtggaatttcttaacccatcctgtaaaattaaaacaagggtgtctacaaaaattactttttactactaatatatttttatctctattagctagtgatattttattgtcactactgcaaaaattgacaacgacgaccttccaaacgaaccgccaagttgagccaaactcacccgtggcttgcagctccctcttagtcgctctctcgctatctgcccttatgtgttgccctcaatctcgccacctccatcatctctctctcgagcttaattagggttactagatcaatctaggcctctcatatagtacgacagcacagtcggtgccggcttctagctccgtgcggctataactaatttggactacgactagcaacataatttgggtcaacggtcaaactaatgccttcatgcaccggccgtggcctgcttacggtttatacatacgtgattttagtcagtcgatcattcgaaagcagattctggaaaatcgtctagtcaaaaagctagctgcaagctagcctgcaaatcgcgttcacaattttggacatgaatttccgaaattttgggtctactaataatgggtcgtggaagcgactcgtgtaaagtatgtgtgttattttaattttttatttttctgaatttagcaaaaacttgctcaaattgtagtttatttgaatttgtagatattcggattttccatctcctgaattatttgtgcttacccatcaaaagtggtaggtacgtaatttaattaggcatgttggtggccaccgcccatttgaacacgtccacatatcggctcctatgtacacgtccggccttccagacttccagtgcaacggatggtacgctgataaaagctagctaaccggcacagctagcaagcacactagttcttgacaccgaatactatcaggtagtgtttgcttggtgggatgggatgggacgggacgggacgggacgaatctatttttagaggtgtttggtttagaggtgagtgggatgggttggtccctagagaggaatattcctctcaaatccgggaccaaagccatccggaaaaatctggcggacgaactcgtctcacctaggatgagtgcacggcgtgaggcgccgcttcgccccgctcgcttgctcgcgtcgtgctctgctcctctgcccatcgtgcttgctcgcttgacgacgacggcgtgctcaagcgacggccacggcggatccggtggtggggaaggcggcagcggcgaatccggaggcgagctcgggcgacggctgcgaatccagtggtggggagggcagtggcggtgaatccggaggcggggagggcgacggcggcgaatccagcggtggcggcggcgaatccaaaggtggggagggcggggatggctcggtggcagcggcgaatccggaggcgggctcgggcgacggcgacagatccggtggtggggagggcggcggtggaggggaaggcggcggcgatggcgacggcgggcgagggtgagtgctgcggccaccacccacgtccacatcgtcggtgtctctaatgtcagcgccacttctccttccgcctgcgccactggtcgccgctccttcttacgctcacgccgccggttgccgctcatccttctgccgctccgctccttttttttgctgggagtaacgtggtgctaacgtcactccctacaacgaatttacttctaatgttgtaataacttacttccattttgtgctaagttattcttatgatttatgtaaattaattttatactttattgaatttacattcataaatgtatttacttaaaaatcttctctacactctgcttgtgaattttctctacatagttgtcaggattatggataccacatacctaatagtagttgactaaatcttggcaggatccactacataccatgtcttatacagaaactgacctcaagggagttccggataaggaaagacaaccagagttctacatggaaacgacaaggactacttggactgtatccatattggtttccctagttctacttagacaaggggacacctatgggtataaatacaagccccctaggaggacagggggacaaccatgacgagacgatcaacacccaccatgggacagagaaccaccatgaaagacacccatgacaattaacatatgcccaccagaagccacaacatacaagccaacatacgccaagacaagccgccggatatcgacatcagagatacgcctggatcgaccctatccggtaccttcagaggccggccgtagggatctagcattgaatctgattccatcgggtgcgagctcgaggaggaaggctaccctgttgtcgactatgagtcagatcatcagaccgctatgtcgacaacagttagataggctaccctacatattgtactagtgtgattatggtgaataaaaagcaacatcggctccagccaacaggatgtagggctattacctgatagctcaggggtccgaacctgtataaaaatcctcgtctccatctcttttaccttagtctcgcgtataccctagcaccgatgatccccatactgtccaaataccgtagtcgagacatcaaacgtcgacagtggcgcgccaggtagggggattttggtgcttcaggatttcgacgagatgggttcaaaagatggattctccgacaacaagctactcgacgaattcagctgagggagagatccaacctaaccagatcagaaccatcatcatcatcgacaacttggtctattgagatcatccaagcctcaagccccgcggcgtaccaaaagatgtcagattgcatgatatcaaacgagtacgcaacaaggtaattggtagattggttttttaaattgatctactaatttcgtaaatacatctggcatgtatctacaaaggtacgcaatattttatctgcaatttatcatacctattcagatcatacagtattgtcagatctataatttattatgtatacccagagcatgttctttatacaataatatctgttgcgcgggtgtccccgatgttaaattgactacgatctaacactgggggctcgctctgtcttcttctgtataaatcatgcttgtttacggtttacataatgccctgacatttacatctgctcgttatgtcctgataatactagaagatccatgcagttttttgagtacatactcgatattatctgctatatgtcttgccttctagaaaatatttttcaggaacaattgagcactcgagtaggttgtggtcgagtacgctctattatcaagaacattcttgacaaatgcggagttatcgcacccaacctaccaacgaagaccggcgacctatctcatagcatcggccatggctggactactcgagaaaaggttgttaacggataattcctcgcgaacgccgtcggcttgatcacccgacatgattgcgaacggacatccggatatgctaccagttgggtgtgtgagtcatgctggccacatgagacacacatgtaataaaccaactctagcacctccattggtattcgagagataattctacatgctcgcttgtcctcgaaccagtacgtagcaatctctcgcaccgcagcttccattggtgttcgagagataattctactcgtccgctggtcctcgaactagtacgtagcaatctcttgcaccgcaacctcagatggtcgaggtacgactatagcaataacgcagcggtccttgcaccacgacttcaaatgatcgagagacacctactcactggttctcaaccagtcaatcgtagcgatctctcgtacaattacttctagtggtcgagttagcgtttctcccactatctccatttcaagtggtcgagttacgactactgcctggtgctcgaccagcgatgtagtgtttctcccactacttccactttaagtggtcgagttacgactactgcctggtccttgaccagcggtgtagcgattctcctactacctctacttcaacaaagttgatatcaggtatacaatatcgccaagtgttttacccagaaatcccttaccacgacgacacctagtgttgaaacctatcctactgtccctttacgccatcttgacaaggccttcgaggaacctaagagaactttggctggggacgcccagagccgataaggccttgtcggatcctgtagagacaaaagaccatgtaagatctggtcgtgtaagagttctcactgtgcgtattaaccaggccatgtaatcggaaattgagttttccaacttcacggctgggggctaggattagtgcttgttcaaccaaggcaggtcaagggtccaagagccttatcctccgagaacgattctccgacgacaaggctgggggctagggagagtgtatgactctacaaactgactgatcggagtcggtaagagagaagacgctcatatacaaaacattggtctgtaaatttaattcatttacagttttccatacatattataacatgtcaccctttgagcattcgctcgggggctatttctatttgatattcttttctgagtattgatttcaggaaaattctattcgacattgacgaagactccatgtctctatggttctacacctagatcgactaaggcgagtacgacaaatgttgacaaagctccgtcgcacactctacgccttctcgatcgctcgagaacggttgctggatttcgacaaggaatacgaaatgaagagatggtgtacccgccgagataaaatttcttgacttcaatccaaattctcgattacagcaagacgtgagatttagtcgtacgctctatactttctcggtcgacatcagagattgacttagacaaaccctttcggtgcccgcacgaggctgataaaggaagtctaacgttatctctagactcaccgagaatggtcacgtgagctcaataacagttcctccgaagtctgcggttgagaatatgaactcgttcatttgcattgaagtcgggggctactgtcagggttatagataccacatacctaatagtagttgactaaatctcggcaggatcgaccacataccatgtcttatacggaaactgacctcgagggagttccggataaggaaagacaaccagaattctacatggaaacgacaaggactactcggattgtatctatattggtttccctagttctacttagacaaggggacacctatgggtataaatacaagcccctctaggaggacagggggacaaccatgatgagacgatcaacacgatcaacacccaccatgggacaaagaaccaccatagaagacacccatgacaatcaatatacgcccactagaagccacaacatacaagccaaaatacgccaagacaagccaccggatatcgacatcagagatacgcctggatcgaccctatccggtaccttcagaggccggccgtagggatctaacactgtctctgattcagtcgggcgcgagctcgaggaggaaggctaccctgttgtcgactacgagtcagatcgtcagaccgctatgtcgacaacagttagataggctaccccacatattgtactgatgtgattatggtgaataaaaagcaacatcggctccggccaacaggatgtagggctattacctgatagctcaagggcccgaacctgtataagaatcctcgtctctatctcttttacctcagtctcgcgtataccctagtatcgacgatccccatactgtccaaataccgtagtcgagacatcaaacgtcgacaatagttttttttatttcaacttagtcataacgtaattatttctactgttatagagagttagttctagtgcatagctaagttacttcttcaattttaataagttacttttaaattaataaaaatgtttgaatatattcaacatagatcttgttttgtcatatattttacgtagaatacaatgatacaaataaatcttgaaaataatatacaatttaaaagatataagtcattaaagagattaaaaaaaagacatgcatcataggctaaaggggtttaaacattccatatgcatatcttgtttattagttcctacttaattagtatacccttgttccctcaatagatagatggagtgatgagagctagaatatatagcatacaaaattgtgtacaaataaataattattgcgagctgaaaaagggaaaaataaaggaaaaaaagctagctagatgatcgatcgagagccggccagtaggtaggtggctagctatagaaatcggaggtaacgtttgatgacttcatcgaccatgagcttgtaggccctctccgtggggtggtagctgtcgaagaacacgtactgcggtgggtcgttgcacagcgggctcgcgaagttgcagagcacgctggctgccaacccgatgtatccacagcacgcatccttcccgttcttgaacccttcatttttcattagtgaattttatagtatgaaatagaaggaataaatggtaacaaaaataacaaataaaacttaaattagtatacatatacttgcagttaagtttgttatttttttacaactaatacgtagaagttaaatttgaacttccatgtttgtggagtgatatactacatattaatttatcttgtaaatttttttaaaaaaatttaaaaaatttattcataactatttgattgacatgtaataaacaggtggacgtccactcgggtaattaaaaatcgtctccaaagtttgagtgctatccgtgtggatgcaaaaagtgcatcatgatgttagaatagattatggatcgttcgtcgtacctagggcttggtatcggtgcatgacgtcggctaggatgttgtagaggtcgacgaggacgatcttgacgccggcgagcttcgcgttgagccggccgatctcctgcccgagcttgcggttgtacagcagcgccacctggttgcggggggtggcgcactgccgccgcacgccgccggcgatgatccgctgcgccgggacgcacccgacgggcggcgcgccgacgacgacgagcaggcgcgccccgcgggcgacgagcccgcggacggcggcgaccgcccgcgccgccatgaagtcggcgtactccggctccgtcatgccgtcggagacggtgaagtgctggatgacgtcgttggtgccccagcagaggaggtagagcgcccggtcggggacggcggcgccggcgaggcgggccttgtactcgtcgaacagctgcagctgccgctccaccgtgagcggcgtcatcatggtccggcaggtggcgttgtcgtagccgctccccgccgacgcgaagctcacgccggtcttcagctcctccgtgctcaggctcttgttcaggtacggcggcaccatctccttcacccccagcgctgacgctgctcgccattgttggatccatacatgcatgcaaatgatcgaattaacatgtatagaatttatttggcacatggttcggggtgtgtcctctggagcacatccttccacgatagccagttgtaggtatcgatgaaaaactttataacattttctttctatcttaataacatttggataaccttcttctgtcatcccggcaaagaaagtgacaacaatatcatctagacgaattacatgtactataaaattgatattttaaaactattttgaggacgagatcttaccatatatactctctgttttcaagagttgagtcgaaatatcccaagaaatatcagtggtcaaagtttaacgcattttttaaggggaagtttaaaccaattgactgcacgcatttaaaaaatcatccattttgtaacagggacatgtaaagccgtaaaaatatgaattaagataaaaaaatattatggataaaacttttatatctatgttatacacggtttaaaaataaatacttcaaaataaaatacatgaaaaacccaaatcaacactaaaattaaatacttacatttaaattttcgcaacgcaaagagcctccgagttgttactgtccctaggacatcgcagctaagctctcgcgtcgccctccccacgggcgacacgagaggagacgctgccgccgtcttcttcctcctcccctcctccatctttgcctcgccgccgcttgagcgggcgccggcaaagccgcacgcccgcggggatggcggcggcggggcttcgcccattaagcactcgggtggcccgggagctggcacggcggcgatggtggcaaacgtccggatccgcgcccgcccggccggatccggcggggacgcagttggcggcggggcggagtggtggcggcggcatctggcggtgtgtggtggcggcggacagggctggcggcggtggaaacccgctcagatccacgccgttttggccggatcttgcggggctgacgccgagcgacggcgggcggcggggaagcgggcgtgctggtggcggggaagaggcggtggcggggaagaggcggtggcggcgacggttgcgcgggcggcgcagctggccgcgggtgaggccgggcgcgggcggcgcggccgggcgcgtcgg

SEQ ID NO: 57667 - DNA, 26560 bp, Oryza sativa
caagtttcgaaatttaacctctatgagtaattaatttgcggtaggaatttagatttatttaagaactaactaaatgtgttgaattcttagtaatttatttaggagacataaaatatcttaggttgagggatagtcctctttcgcgaataatatagttgatgtaaaaaaaattcgcccctcgcgctcgcttttcgatttggactttattggattttattcgaattctaatggaattcaaatcaattcttcgcacgtaattttagagtccaagggagttgcggatccgagcgagggtcaagacctgcaggactatgagcaaggcaagtcatcactattctttgaacatgttgatcccaattgcgaaattgttttgtttaaaaataaaattgcatgcaatgatgaacatcctacttgtgattatgccatgccttgattattgtttacccttaaatctttgtaaccatgattacgtatgagtccctagtcaactatgaccattgtttagaaatgctatgctagaatcatgcatactcatatttatcaaatgctttatgcttgggcaattacctttgggaaggtaattgagatgcggcatgtggagacatgagcgccacattgccatgatattgatgacatgatttgtgaaaggaaaataaagtgaaacaactgttttcgactggggcggacggaggatttgggtggtatccggaaaaggctagtaccgtccctggtcaattaaggaccgagccatgaagttaagcatgaaacgaccctcgtacaaccgcacttctcgtatgggtatagacctagcggagtagatagctgagcggaggcagtatccatgcataatggtttcttgatgtgtgaggctggggctctacggtggggcagccattggtaggaccgcgaggcgggtgtctacaatggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagtgggtactgccaatgcgaggttatcgaaaagctttgccgtgacgcgtctcatgtgttgggacgaggctcatgtgttgggcagtcgcggagtgtgggtaaagtgtacatccactgcagtgtgagtaaaccaaatctattcgaatagccgtgctcgcggttactgagcaccgggacgtgtattacacttggttagactctaaattcttaacttgtgtgggatgggatattgcatgatgatttttatgctgttggagccatttcctgggaggcgggaaggtggacgtcctcagaaaaccatgacgactcaatggcgggaagctatccttgggattacaatggatggtggacagaaccatcgttatttaaatgtgaacactggtactaaaatttgatcagtcaatgctaggtcttaggcttatgaaaagaattacaaaactgactttgcgcaaagaaccatagccatcctttgaatacccctatcatgtgcattgttgctatgatggcttgctgagtacggttggtactcactcttgcaatatataaacttaatcagaggccggagacgaagcttcagaggatccctatgcatactatgaggagggtgatgaagacgatggcgctcagtaggtcttagttacggtcgttgcctgtggcaatggcgtaccgttgtcttatctacttctgcttttggaatgtattccggaccgctcggtccgatgatctaagactatgcctgcgggcttatgatgtaataattcgcactagactttcgtgtatgtgcatttggtatttcagctatgaactcatgtgtaccagactacttgatctagggaaatggtactgtttacacgattgattcctgttataaaaacgggggtccacaggagttactgggctaggctcggacaagcaggctgtcctgaccactgatcagtccatctatatttacccgttgtactaccaaaggaattattagtaacgctaaatccccaaattcataaccagctgtagtaccaaactagaaaataggagtgccaattggcgcacctattaataaagcctatggtgatattgttattcatgttcgagatacataaagctatagtaccaaactagaaaataggagtgccttttggcgcgcctattaataaagcctgtggtgatattgttattcatgttcgagatacataaattgatcattttttttcttgagatttgaagactctatacaaacgaacggaagcaaagagactaaaaaggaaaatattagaatgaaattcacctccagaacacatagttatatagttatagtacccaccggaaaacatttagttagacacattccacaaagtcaagttagggtgagtagtgtaaaataagtcattaagtcatatgcaaatatatgtgaaattcatatacttaagagctagggagattaaatatatggggttatctacataaatagttttatttttattgattaattctaaaacatatatgaaatggaatatttgttatattcctatttgaaaaaaataatatgcaaatgtataattctaacaatatatgtaataaagtggcaacaaatcctaagtgatttttacagttggatcactcttccaaataaaaaaaagcttagggtctttaagtaaatacctctctatgcaagttttaagtggatcagcatatgagggggaggggggttacatccatttaatccaatctaatcgaaatgttctggatgctgagtttgtcagggttatggataccatatacctaatagtagttgactaaatctcggcaggacccaccacataccatgttttatacggaaacaaccttcgaatataggaggagttccgcataaggaaggatgaatagagttctacgtagaaacgacaaggactactcggattgtatccatatttgtttccctagttctacttcgataaggggacacctatgggtataaatacaaggccccctaggaggagaggggacacggaacaatagatcaggacacaagatcaatatacaagccaacatacgccaagacaagacgccggatatcgactttagagataagcatggctagtcccctacggtgtctacggatactgtcaggagagacatagcgctgtctttgatctcgccggatgcggattcaaggaggaaggctaccctgttgtcgactacgagtcagtacgacagaccgtcaagtcgataatagttagataggctaccccaaatattgtactggtgtgattatggtaaataagagcaacgtccggctttggccaacaggagtagggttattacctgacaattcaggggcccgaacctatataaaaattctcgtcctcatctcttttactacaatcttgcatatatcctagtactaacgatccccatactacgcaaataccggaatcgcgacatcaatcatcgacagagttgttaaggtactactttttctttaaaaaactgttaaggtactacttgcttctagaattatcacagaacttgtagttttctatttttcttgatcttctgtatttttttccttagacaaaatccaagatttatttgataagttaggggtgccacgtggcccaatcaaaagacggcataaccgccggctttagattagtacattagaagtagcaatattttgtttataaaaaaattagcaagattttaccttaataatatacgtctcaattggttgtctcttttgtacatgtcctttgattatttcttaagcaggattagggccagccctgggtctatgtagccaagatgagcgccgcgggcccatgattgtaggggcccatgatggtggggggcaatacctaatactagtagccgtagtacatgtctatggcctacctaaaagcggaaacgcccgagagatgagaggaggtgcagcatcgctgcatcgttgcctcagcaacttggcagacggcatcgcatcgcacaggcaggcgcacagcaccgtcgactcgtcgccggcatcgcatcgcacagcacacaagtcaccactcagctgcctggcgccagcccgccggccgccagccgacagccgcctgcccacctcccgcctggagcggtggagccctggacgcaatcagccaatcggcaacttggcaagagtgcaagaccagccatccaggtgtccagccgcctgctcatccgcttcctgtgacttgtgacttgtgaggtatatttttagtttaatttactaatttaatagttcatattcttgcactaagatgatttcttgtttttatgattaggtctgagatgttgcccaagaagcatttgttaggttctgagaaaaggaaaaagagaaaacatggtgatcaattggttgaaccgcaaaggggtgctttacataagttttttttgttggttcaagtaatgttaattttgcatcaagaaatgccccaagaagtatcttttcatgagaagcaatggatatgatgggttctattctttattaaggtaatgatattcgtactaaggtacaaatatatcgatattttggtcgactttatttctcgataattaccagatatgttaaatttaatatatggatgtatttgctttcgttctgcaagtaaattaaattagcgtgtgtgtgtatatatatatatatatatatatatatatatatatatatatatataaaccatgcatatatatgtttcaatacatatatatgcatacatatatatatgtatatatatatatattatattatattatatgtatatacatgcataatatatatgtatttatacatatatatgttatgcaaatgcatatgtatatagatatatatatgaccaaaatatatttacattatagaaaaatgtgtacacatgcatatagaaacatatgtagtcatgtattaattacaatctattatatgtcctagctagctacgatttcgacgtagtagtactcgctgctagctcagaagctaaggaccggtaaattgtgtttccgtcgtagtagaattcacccttgggatcaaggatttcttcgttgatgaatcccatgagttgttcttgaaccgccgcgataaattctttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgtacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgcagtagcagttaacataccaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacatactttctgtttcatccatacagtgagtgcaagccttgtaccccttgttggactgtccggataagttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggagggtgtagatacacatcgtaacgggccaagtgctatggccgctgctcatctctccaaaaggattcatgccatccgtactcaaaccaaaccgtatgtttcgtgcgtcctttccaaattctttaaattttctgtcaatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccaggaagaatgttcttgacgagtttcaataaatcgccaaatgccttgtcactaacccatttcttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaataattatagcttggaatgaaccccgactcaaacaagtggaaatgaatagtcctggatgcagaatactccttctgattcttacacttattgcatggacaacaaataaaacccctttgcctactagcttcggccactttcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaatattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatataggggtgggactttagtcagggttggtagcattaacgggggataaagatcaccgggatctttagtcgaggttggtgttatcgataggcattaaagctaagatcttcagccccggttggtgttaccaaccgggactaaagatccggggggggcctgacaggccctgacagcattcgaactgggactaaagatgatctttagtcccggttggtaacacaaaccgggactaaagatcaaatatgcccgttacccttttgaaccgggactaaagatcatatttagccccggtttttattgcatccgggactattgtggaaatcggccgaccgacgaaagatggtttctccaccagtgtgatattactcacttttcaacatttttactttgaacatatgtatgcactgatacggcatggcttgtttttcttaaaagtaatctatgtacgtaaaagtatgcaaccgtaactcttactgatcattttttcttgtcatatagattaagtgcttaaaacctattaatagttaaagggataagtccatgcttccccccataactttgcctatgtctaaaacacaacgaaaactacaaaaccgggtaaatgacgtaccctccatttatcaataccggacactttaccaaaccaaggcaggttttgcctacgtggcagcatagtcagcaaaaaaaaaataaaaacaatggaagcagctcatcagtacaagtcattgtcttcccctgctttctctctcaatgccagtgagacgccactgcccaatccacccacattgggcacccaccagtcgctgccgccgccgctagtgtaatgtccgcctttcccaggccgggctcgcttacatctggcagcttttataggttatagactgccctcacagactaacacaagtattttctgcacactttgtcctcactaagcttttataggttatagactgccctcacagaccaacacaagtcttttctgcacactttgtcctcagtagtgcgcacccgggaagaatttcccggtcggtcacacatcccaaattgctccaggccaaacacgcttaaccctggagttctttggagatcggctttcggaaaagaagttgcaacaagacctaggccgggatgttacagctaggctcctcaagccctcgagggacacctccactggtcgacctcctcctcccaagcccattgccgactgccaccgacaccttcatttgggagcttgctagcaacactggctcctcgagcttcaagcatcttgcttttacatgctgttggtattttttacgaccacagataaatccgcaagcccatggaataccgctgaagcacttcaccttcgggtgaccccaaaaggatatcgaactcagggaacatgtgtaatctatctaaggctaagactattcaaggacaacaactgacgataggcaggctaggctagagaggtctttctatgggttttaattatctaagctaagcaaaggtaattccctatttgttgcttcaggcaccgacccctgctggtctgctagcgtggttccggctatagctctatgatgtacccgaacatggaggattattaggacggaattcagggttgtcaccacctgccgcctacctctgacaaatccgtgggatacacaacaaacaaaggtaatctctactctagacaccacgcctaagttattaattactactctaatacttgcgtaggaactttcttctctatctggagtcctagtactagagcacttagtatgaatactaaacaatgaacccgcaaagatagaaatatatcttactcagacaaagtaattaaataacataagaaaggagcatgaatgcttactttatataagaagtttctctgaacccgaagcagagtgtactgacagctccggtactcctccagaattcctcctaggaagctacactcgttgaggtagaagtcggatgagtgccaaacttccagacactcctacatagctttctctcactccctaccttattataatgtacaaaagatacaatagagcctcttgtaattcagctcaaagttgtgtgtgttggaatgagagtgagctcctccttttataggctccaaatgacggttaggggtatggggaatgaccaaaacaccatgcaaccgcctctgggaaggaatccaagccatccacgtggaagcagatggcaggaagcggcaggaagggttcagccgaactggtgggttcggccgaacccaaaaacactcctcccggcctctccttcggccgagaggttgtttaatgggtctccaacaacctaggctaagttttggcccaattctaaatggtttttattgacttattgggcctctaatccgtgtaaacgcgtcctgaatgcgcggaggtgcattttgccacatgacggatgtgttttctcctcaaattacctgcatacacatatttcaccaacactagtggaaatgattagtaataatccctaccactaagtttgataccatgttttatttcattatatgcaggtattgacggtcagatattatgatttaaggaccgtcaacacatgctcaacaaagccaaggtcgacctctagcatttcaaaaagctcctccgccgagattcatgtcccaagcgtttctgtcttgttgagctcctccatcctaccatctcatcgagctcctccatcatcgccgcctggttgttgagctctagatccaatccttctcctcgtacagctccttcatcgccaccaccttgcgagcacagcatccacctccacctccaccaagcagctcttccatctccacatcgttggtggcaatatgagaaaatggtggctcttcatcctccatgcattggtgaggtcaaggtcgagctccgcctcctcaccacctctgatcagagcacctcctccatgcacaggccaactggcgagctcaagctccgcctcttccccccgcctctagctatagctcttccaccgcctccattgaactcatgctccccaacctcgccgccctggtcttggagatgggtcgcatgagcaggagaagtagtggtgttcacggaggcgcgacacagagtcctgacggcatctggcctctcccctttaaccgtggttgctgtttggatctctttatgagatgattctaacgggggcgagtcggcgatccttgggggagctcggcggcggtgctccatagtgaggtagcgactactctcgaggaggagctcggcagtgacactccacatggaggactcagtggcggtgctcctgtgtgttgccgtcgcgagaagggagaagaaagatcgatagagaatggaagaaagaggataagaccttgactgacagatgggccctagagttttttaaatattatcttttctgaatgaactgccatgttagttgccacgtaggccaaaattgcctgacctaaaacaagggtgttgggggggtgtaagttggacggttttgatagttcgagggtggtgaatactcggttttagagtttgagggaaaattttagacaaaggtatgacttgaggggtatcaattggacttatcgcatattgaaatttgaaacacaaatgtttagtggtgacgagtaaagaaggacggggaagtatgacttcgtattgcaacattaatattctctatatatcacctttgtacctttgtttataatatatgatgtcgttagttttggatctgacagtttacaatccgtcttctgaaaaaccaactatgtatatcacttgttctacttcaatattttaaacatgacttgtatttttttatatttgcaccaaaattttaaataagacggaaatatattatgttcaaaagtgaacaacgccgtaaactcaaaaataaagggcgtacaagtttatgtgttacgtaccgtggtgcaacttaatttaattattaatagtgcgtcatgaacgactaattaagaaaagatcaaaattaatcatatttttttcgtcagcgcagaactactgcacgttattgatttagtcaatcccttctttctattattgtccactaaacacctaaaacttaatatataatattagtatttattagtactcctaaaatttacatacaagcatgtcacatcaacccattaagcaaacaaaactcaacatgcaatcatacagtaattatatctacaactacaatttattttgttttaaaactaaacatacacatgctaaatcatttttataatatttctatccaaattattttatcacttttcgaatatctaacatatatttcgcagcacagcgttgggcattatcccgttaataaagatccaaaccaacactagtatatatagaactttctttccgtacctccgttagttagctgcctcgcagtttcggtcttttaattgcttgctcaccaagcagataacaagtcaagatcggacatatgcagtctctccaataatttgtcaattacttgctcccaagttctctctttcatcaaagtataattaataaaatatcttcatttcatttggtttcataacctgattcatgttgggtcaactccatttttaacccctttctcccttcttaatttatcggcattgctcttttccttagaaaaataactttataatttctcttcctctatactttgatcccttttattcgaattacatattacctgatatattacaaatgtgtttatcatatattataaattatttttttttcatattggtagggatacaccaaggtactattaatttttagtaagcatgtcttgttctcacccagagaacaaacgaatgtgtaaattattagatgttgatctagtccgaaagtgattgatcgatagtctcggtttattcaaatggtctcaatgtaaacacacggaaatttagcccacaaaaagatttaaagatacgtatattctaggacaagtacgcacgtacgtacgctgactgagcttatatacgtgtgtacgtacatggaaaattgttctaaactcttaagatatgtcctcccatcttttacatgccgttcgtctaaatagttgcaaaaaaaacttttaaaaaattacaagataattagtactccttccgtctcataaaaaatcaatctagtactggatatgacacatcttattgaatgtgtcacattaaatcttatatttacttttttagggacggagagaatatatagtaatatcactctgcatgtttaaatatgacttgtaacaaaaacaaatatatatgtggatatactcataggtttgttttttttcacaactcatagaaaggcatatttaaaactgtatatttctcatattaaaataatatgtttttaactatttagatggtatatgagagacggtgaaatatcgtcgagagttttagaatcctctcccgcgtgtacgccagaatagtaaatttacgtcgttgttgatggatggctacagctaattttttactattcaactacagctatcaacttttaattggtctccatgatttcctcctaattaaatacattcttctccaatgattcagctataaaaccttaccaaatccacaaagttaatcaccatatttaggtggataaatctcatcagatcgagctaagcttggaggcaagcacaaatggagctcacatggcttctactcctcgctactctcctcctctccaccactctcctcgtcttcctcttccatggcggtagcagcgccaccggcggcgagaagcgccgccgcctgccgccggggccggccaccgtgccggtgctcggcaacctgctgtgggcgaccaactccgggatggacatcatgcgcgccgtgcgccgcctccacgcgcgccatggcccgatgctcggcctccgcatgggctcccggctcgaggtcatcgtggcggaccggcggctcgcccacgccgcgctcgtcgagagcggcgccgccatggccgaccgcccggagttcgcgtcgcgcgcgctcctcggcctcgacaccgccaccatctccaactccagctacggcccgctctggcgcctcttccgccgcaacttcgtcgccgaggtcgcgcacccggctcgcctccggcagttcgcgccggcgagggcggcggtgctcgaagagctcacggacaagctgcgtcgccggcaggaggacgccggcgcgggcaccatcctggagacgttccagtacgcgatgttcttcctcctcgtggccatgtgcttcggcgagctgctcgacgagcgcgccgtgcgcgacatcgccgccgcgcagcgcgacctgctgctccactcctccaagaagctcagggtcttcgccttcctcccggccatcacgacgcgcctcttcgccggccggatgaaggccatgatcgccatgcgccagcggctgaaggggatgttcatgccgctgatcgacgcgcgcagggcgcgcaagaacctggtcgacgaccatggcgacgccacggcgccaccaccgccggcggcgagcgccacgacgttgccgcactcgtacgtcgacacgctgctcaacctcaggatcaacgacaacggcggcgagcgcgcgctcaccgacgacgagatggtggcgctctgctccgagttcctcaacggcggcacggacaccacctcgacggcgctggagtggatcatggcggagctggtcaagaacccaaccatccaggacaagctccacggcgagatcaagggcgccatcacctccaactccggcaaggtgtcggaggaggacgtgcagaagatgccgtacctgaaggcggtggtcatggagggtctacggcgacacccgccggggcacttcgtgctcccgcacgcgccggcggaggacatggagctcggcgggtacacgatccccaagggcacactggtgaacttcacggtggccgacatgggcatggacggggcggcgtgggacaggccgagggagttcctgccggagaggttcatggccggcggcgacggcgagggggtggacatcaccgggacgagggagatcaggatgatgccgttcggcgccgggcggaggatctgcccggggctgggcgtggcgacgctgcacctggagtacttcgtggcgaacatggtggcggcgttcgagtggcgggcggcggagggggaggcggtggacgtcgacggcgagaagctcgagttcaccgtcgtcatggagaagcctctccgggcgcgcctcctgccaagagccgtcactgtttgactctgggtgagctttgacatttgggggggtttattagacatttgacactctctcgctaatgtagtttcatgctttgtaataatggtattattattagtttccttttgatgaataaaagaattccaatctattttgtcatagcacttgacttactataaaccatcatttgactcgttctatcccatgacaactttatgtattggtaaactctaatttgtgtgtgcgcttattagtcttgttgcgtgacgggtttcaatgtcgtctaatcagacgaggtgacgtgtagacataatgacttctattatacgatcattgcttattagttactctctccatcccaaaatataagaacctagcaccggacgtaacatttactactacaatggtaaatgtcatgtttgttcctaggttcttatattttgggacggagggagtactctctttatccataaatataagaaattttgattggatgtaatgcattttagaaccatgaatctagatagagggtttgtagaactagaatacgtcatatattcactcaaagtcacttatattttgggccttatattttgggacgaagggttagtttagtttgaaagattcttaacctatctagacgcctctgaaacattatggaaaattacaaaaccaacccttaagtcacttaaagtttgatattctatttcataagttattttgttataaatatccactcacctactcagtatttttgaaaaatcatcgcaatacgcacgtgcttaacttaatcaatatgttttcataaagtatattcttgatatatatttttttaaagatttcacaaatagaattgttgatgagagattaaatgttgtcacagtgagtttagctatatatgtgctcaaaaaagttcaatcaaacattttaatgcaagaaaagaaagaaaagagaagagatgagagaagaaaaagaaagaaagaagatatgtgggtccgataatttttttcttttcatttacatgtgggtcctatcatttttttattttatattttgctgactaggataccacgttagcgaaacgagagatccataccgtcatagaaccgaaattgcatggttttgtataatttaggagtgaagatttctggtattggagattagcgatgtcatacaaatttgacgtaaagttgaaggacggctggtgaacttattccttatcattactcctaaacctacctagttgcaaaggcccatccaccaacatgtcttctgcgcttgtcgatcgtgaacggattagttatccgtttccgctgacgtgaaaatttaaaatttgtcttttgctttgacttattaggtcaaccgttgggctcctagttgcgctcgtccagcatggctaggctacgttgtttggttgcatccccgacccaagactgacatccagttccagtcatcttccaaagcgccggtggccggtgcgagaaaggagctcagtagcaggcacggcaatgggaagatgatgtcctagttgctgtgttcttcccaatctccattccgttattgcttatgtttctactccctccgtctctaaatatttgatgccgttaactttttatttaaacatgtttgaccgtttatcttattcaaaaacttctgtgaaatatataaaactttatgtatatataaaagaatatttaacaataaattaaatgataggaaaagaattagtaattatttaaattttttgaatagaacgaacggtcaaacgtatttaaaaaagtcaatagcgtcaaatatttagcgacaaagtactagattttaggaacagctaagcatagttggatctgtagggattcgttcattatataacaactatttatgctttccgtaggagtatgggagtgccgtttacgaaaaaaaatatagaagtaacatttaaattttctattggacaagtttccagaaatttcaggattgagatagaaaataaagataatgctggctaattcatgtattgcagaacaagaaacagccgggtgtgcattatgaccattatactaactagcaaaatgcccgtgcttcgctacggataaattatttcttagactaagtattaattagaaattttaatgataattagaatggataaaaccaccattgcatattgatatactcatgttctcataatactcaagatggacgtggatgatccgacgatcaaatggtggtgaggactgtggtaggatgtatctcataattggactcatctattgatggtggacattggcaacgaagaaaaccagaacagcagaaatacgactgacaatattgttctgatagatagagaaagaaacgacaacggcgacctccggtctgatctgggttgctcatttttttccggtccaatctggtttttcttctaataatacacatggtttttgccgagttttttttggcccggtctgattttttaataatacacacaggtcgcttattttttttcgtctaatctggtttttgcccgtatgttgtaacgggtgaaggctattttaattatattattgttatgctagaaaaatgcacatgcttcgttacgggtaaaggaacagttaaatgctataaagtctagagttaacatgtatatagtaatgtttcaagatagataaattatttattaggctaatgataatcacgccggataaaaacacgctctctctctctctcaacccttatgtgataaactgtgatatcattgcactgggtaatgatgacttggtgaggtgaatgaaatttggcctcaatgatttatcgaagcaccttcatagttatcacaaatgtatatttgtgtttggataattaatccgctctacacgtgcagaatgtgaatgatgtccctaacacatggtcccgatgattgtagcattggagaaacggacgtccaagcaacgcacctttacgtataatataagtaaataatgaatttttggggagttcattaattattttaaactacattttttatgacacttttataatcttttttcataattgatgatcgctataacattgcattgattataatcacaatgcaacagtacagtgctatgttctaaccgacaaaacctgaacagtgccagccataccatgccgttcctttttctttttagaaaacctcttagcacatgattaattgagttttattataacaaaaattaagaaaaattatctagtattttatatcaacttgtatatagaaagttttaaaaacacgctaacaaaaatcgagatagaaggaacggagccatggtgtgaagtttcacgccatgcacatattcaattttcatgttttaaaaaaataccggttggttcacgtgtttatactaattttttaatataatataataatctttatttttcgaattaaaaaccggtatactataagattttagaatcactaaaaatctgttaaagaaagaggtgcagaacttttgatgtttcagccatcggatgtgcatggtccgtgctagtggttgagagaaagaaaaattacgcgcaaatatgatttgggacgagggagggaaagtagacttattctagggcctaggtcaacatatatttatattgatttttgtgaatataatttaattatttttaattttcgaattaaaaactgattcattataagataagatttcataatcaataaaaatctgttgaaaaaagagaaaaaaaatcgaaggcaaatataatttgatttgggggaggcaaagtagacttattttaagagaggcctatacacagtggaagtaataataggtgcaaaattgagaggaaagtgggacttgaacccaggtggccgaagtgaaaactttctcccttaaccaagttggcagactactacacatgagaggcaattacatgaaatatatatataccgtatcagacgcggttttggagtagataagaaaagcccgatccggctgttaaccggattaaatctggattttagcgaagcgcatggtaacgacggacggaatttttcacggaagccttgcgtattttttaattattaggtagaaattcacaaaatattcacaaatcaaaccaccatcacgccgaagaaaaccgccgtcggctcaacttcgaggatgtgaggggggcaaccagggaggaaagctgtcgccgccgctgcggccacaccggggagggggagggggagtagcagccgccgttggctccacatcgggaggggagggggcagccgctgccactacgccgggaggggaggagcagccgccatcacgccggggaggggagcagccgccgtcacgccggggaggggagcagccgccgccgcttaggatttgaggagacggagaggaggcgagagaggatggtggcgagagaggaggtgtagaaaaagaggtgccgccggccagggggaggcgccgtggggtgtggctgagggggtggggggaggggaggggagggggagcggtggagagggacggtgttgctggctgaggggaggcgcagtggagaaggagagaagaagatacgggcgggcggaggagagaaaaagaggaacaaaagcggagcggaagaagaagagataaggcgggcggaaagatcgagacgcgagcgcgcagctctctcgcattctcggctccgctcgggtccacgctctgatgggcgattttttttttcgtccgtgcgaaaaaaattggacaaaaaaaccggacgaaaaaaatcagacagaaaaaaccaggcgaaaaaaacgaatccgattccagtggtaaaaaagggtgcgaaaaaaataataaaaaagaatctgcccgattccaaaactggcctaaaaaacaatttgagcccggtttttttcgtctttttttctgagtgggtcatgattttatttggttgcggtttttttggcccggttttttacaccgctgtttctgatcagttttttcttggcgcgcacgaaaggattgaatcccaaatagagtaacctaatatttatctttaactattataaaaattgaggatgattccgtcctcaccttaattttcatccgtcatatgtgttagacacgtataaaaccaaattggacaaaaaaaaaaacaaccaactggcaacacaaccaaatgcccagatcgaacaaaaaaaaccatccactggtgatccgacaaaaactaccagatcagaccagaaaaaactcgacgacctggatcgtagcataaaaaccatctgtattattaaaaaaacagaccaactatatgtattactagcaaaatgcccgtgcttcgttacggataaattatttcttagactaagtattaattagaaattttaatgataattaggatggataaaaccaccattgcatattgatatactcatgttctcataatactcaagatgggcgtggatggtccaatgatcaaatggtggtgaggactgtggtaggatgtatctcataattggactcatctattgatggtggacattggcaacgaagaaaaccagaacagcagaaatgcgactaacaatattgttctgatagataagagaaagaaacgataagcaactaactagtgaatatgctccccactccactctaacctgaatcaaattccatcagacagtactgtcatttccagtattgagcaatgagcacttccaattccaatgcttgtttagctagctatatcgagaaagtctagttcccatgctctgttcagtttatgcagtgcagtgatatgtaaatcatttctaactaaatgtgtaaaacacaattcctgtgctaggtgtaagctgataggcacagtaagcatggtggtgttcagtgatccaatttgaactggaacaataaaaaccacctatttttttttcagaatctaaacaaatgaatctaggctatagctagtactagcagaaaccaagaatgatcacaatcctctctgtgccatgcacttgtatacctactgcatcattcgttccaaatgggctgttagatctgttgaccctagtacaagcagcgagtaccagcacccaaaccaactatatgtttgattaacctcttgggcaaccaaaggacatgcaaagcattatcacaaatgacacattataccaaagtgaagtgattcttcagttttccttcaccagatagacaacatcgaatcacatgttcacagcaaacacaaaaggacacaaagctagcacctgcataaggaataaactaatgcggctaggttactactgataggtacttaattcaattaagcatgaccgaaccattagtttggatcgatctccacttgtaaagagcccacataaaaggtttgttttggatttatcttcttcttatgccttggaccagaattagtagcaactaatctctccaatatttgaaccatattcttcaatatcaggcaacgcaccagcaaatggaaccttaggcttcttggacatatcacatgggggcaacagttctgcggcttctgccatcaataagcaaacaaaagccaattagccacacaaatatgcaaatggaaacgtgactagatgagcgatgaatcactggaatccatgccaaataccccaaaatactgcatttccttcaatattagaaaaacagtcatatgatccaccaaaggccaaatcccccagattgcacgtcataaaacatctaactcaaatgaagaacatgtgtgatcacattatgtcacttacaagaagttatatagtcattctaaagtatgtacatatctggaaataaaactgacctatcaaataatactactcaaatgtacatagacaatcggaaagtaaagcaactccgggacaaaagtacaacttcatgaagaagcataaagaaaatacacaacacagtcaatacatataaaagtatcgggtaaaaatactgcactggcttcaagcttctaagaaggccaattgagttactagtttgatatttcaattggttcaggtaagtttttcatgcggttgttgctgattctcaaagtgatatcaacttatggtaaaaagatgtatactgaagccatgtcagtatgtacacgttagtactaccgcaaaacaagctgaacagagacctaaaatttggaatagcatgtcatatgcaggacagttcatctaggcatcaagcagttaaaaggaacaatgattttcaccgagcaaatagaaggcattcacaaataaccagctatagaaaacaacatgattttgctatcgtacagtgtaaaatggcatgggaagaaattacctttagtataaaagctagagaaaggataatacaggcctcctttcaggatttggggaatattcttgaattgcattgactgcatattgaccatgaagaaaccaacatgcgtgctcaaaaataccacatcatgttcctctgcaaagcacagaatcactggtgcccatgtctcaggtcctgttccgaaagaaaggagcctgtccaattcaatggttttctccagcacccatccagcaataccatcacgattggtcttacccttccatacatttagactgaaatgtgtcacagcaaggattacaagcccaccaccatcctctgctggtgcaatatggaagccgccatacgaattggtacgcaaatccggtggcgcgttaaccagagttgctgtctgtttaaccaaattgaactgaaggattgggcacccatgatttcccagcaaccagtagaggaaatccccatccaggatactggaaaatgacatgtaatccccaggactaatcggggctgagaccacatttccccaattgccggtcttggatgagtaaacgcagatgaacgccactgtcccgctcgtgtcagttcctaccacggccacctcgaatgggttggagtagcagccgtcgccgtcgacgcagcgcaccgacccatggtagacgaccatgtcccagcgatggaacagcgccgggatatccacggcgcggcggtcgccggtgaggggatcccacaccatgagtaggcgccgcctccggctgtagtgaaggacgcggccatggcggcatccgaacagctggtggtagtcctcgccgctgccgccggggacccgccatgagaagcgcgcgggcgggatgcggtccggcgagtccagcgtggggatgaagatggggtatactgaatcttccttgaagaggccgaggagtggtggccgccggtggcgggcgcggaagcggcggaggagaggaggcggcgccagcgggtgcagacgagggaggcgcgagggagggaggacggctgcggcgggaggcggaggaggatctccgagaggaggtcgtcgttgtcaagcggctgcggcggcgccggcgacggcgaggtggacatctccgtctgccggaaagtgggatttctgtctgtactgtaccgctgtaaggtaacaccgtaaaacacttggatgttggatcccataaaagaacaaaagaaaaaaaagacttggatcgaaagacaaaaaaataagttgattttttttaaggaattgctaacattatgtcgtcagaaaattcatccccaaatctggtaaattttactccctccgtccaaaaaaaagacaaaccctgatttccgtgtccaacgtttgaccgtctgtcttatttgaaaaaattatgaaaaaaattaaaaagacaagtcacgcataaaatattaatcatgctttattatctaacaacaatgaaaatacgaattataaaaaaaattcatataagatggacagtcaaagttggacacggaaacccagggtttgcctttttttgggacggagggagtaggtcactagatatgcttcgtgatttgtgctcaatgtgcttttttctccaattctggcgatctctttctcccgtgctggcgacaacccaagctgcgatggagggccaatgaattagggtcccgggttagggtgagggcgggagggataggatggggaggggggagaagagggaggtcgtcaggtccagtgggatggtcatgggagacaacggctcggtggtaggtggcggaacagacgggcaatgaggcgccagcagcagcaccgaagccgaaagggggatgggggagggcgatggactggcattggtggcgggtgcatagaaagcttgtggttaggaggtggtggtggatttggcggcgaggagccgtcggaggcaaggaagacagcggagcgagggcatctcgccaccgacggctcgaggaggaagaggggagggtggcaggaaggaggctggctggggaggtgttgacgaaaaaaatcaaacacaccggcttgggagatctgcttagctcttgtgcagatccaaatcttgatgagatgcgggcgtgccagccagtttgatcctgcaactgataagatatgcaaatagtagatcaaaacagccgatcggctgacaagccgatggagtagttccagccgatagccgataatagccgatgccgacactagccgatagcgatagggtttaagcaatcagctatatgtccaatgtagataatgatataaaggcaatcggctgatgatgatataataaaataacaatataatacagtataaaccaatcggcaaataatgatatgataaataagcatcgatccgaaggttaaagcatacaccggctggaggtctgatatcatgaaatccacaagattagattaaacagtgaaacctttgttgtcatcggccaaatccaacttatatgtatatgcaatccttatgagccgatgcaacgtccagataactcaccggctgaaacctcgatgaaacccttattggcaatcaagaagcaggctagagattatggttctaagtatgacttagtacatcaaacttaactgatgtagcactaagtatgaaaagaaacataatatctagacaatcaagccgttgactgagttttcagggtggtagatgtctaagctaatctaatctagcaacgcaatttagccgataccagcagaaaccctaaaacgagaagcagccgatagagctaaattgatatgctaagactagattaatagagacatatgttaaataggtaggcaaatatatcatccaaaccagagcaatccaagaggtcgaatgtactgatgcagccttgaacgacaccgacgtaaacgatacaattccctgggcaggcggaacattggacttaccccttagccggagatcgaacaccgatgcagccccgcgtcaggtgccaagtcccgccggacaataaaataaagtagaaaaggtaaaaggtggcgatgcgctgaattgtattgatcatgaagataaattacatagaccccaggtgtacatatttatacccatgggttgatacaagtccttgtcggacaagaaagaaactttcctaaaaataaaagaaaaagataaagtccttataggacactaaacacgctttcctaaagataaaaggaaactaacaaactattcctaattaatagataacttgccatgccgcattctctttgaactcggtctcttctggataagcttcctttagtagatcaatttccttaaccgaatatagcaagaatccgacaactaacgacttgacaactctcattggctaatctcaggacttcgaagccgatgctgactctaagccgatgactactccgggcttaccaaatttcactgttaccaggaggcctcgccgacactttttggctagctagtgaggccgagcgggtggagcgtgcgctcgtgcgtgagggaggggagcaaagcggctgtgggagtcaagattgaggtaagagggaattgaagaagatattagggttaggtgttcactacaagaatattaaagggatattagggttaggtgttttttttttcaaatgacatatatacagactctttttttatcaaacatagtgtagtttccatgaagattgcatatgttttttttt

SEQ ID NO: 57668 - DNA, 1208 bp, Oryza sativa
tcaatgtaaaggagactaaataagataagactcaagtaaacattagtctcacacttatataacaataacatggaaatcatatatatgaacctatcaaaaagtaggtgataagaagtgatacatatcgctttatctccatgaatttcatccttgtcatgattaaggtccatcatcaaagaatgcatatctaccacatctcattatcgggaaataaccttgttgaaaacttatgtaaaagagaggttaatcccataaacatcggtttatcatctatcaccaaagtaacaattacacaaattgtttaatccaagatttttcaatcttttctctcttttgtgatagataataatccgatataaacaatacaaagagatgggatgaaagataatttcaaatcaaagtagagatcttataatgaacaaaatatagaataagctccccctaaagatgtgcatacatatggatatgaaggaatgcatatgcacataatcaatcaagatcaatgagggagctcacactatattttggatctacaagagagaccaagttagaatatgtgaagtttaatacatacctcccatcatttttgctttcatatccaaataagactagtcaaagaaaggctcataaaaacgttagtctcatataattagatttatcattaatcaccgaaaccaaattaagtcacttgaacttacagttgcttagttaacgtcatctgtacatcatgaactatggagtacttgataagattgatcatggatggaattttcgacttttaagtattattagataatggcaaagtttatcactcataaatgagggcatatacattttttaccaaatcatgaagaggtatatgctctcccacgtaatatggttggctacatgcatgcatgcatatatgcgtgaataattgcatgtatacatgcatcatatcgagagcagtgtgacacgtaggtttattatcatggtatatatatatatatatatatatatatatatatatatatatatatatatatatatatatatatatatatatataaatttatacatgttagatcctctaaaaaatattatatatattatctatgtgtgtatatatgcgtgggaatatatatatacatgtaatgcacacgtcgatgaagaatatcgtaatgttccaaaaccgaaatttgagtggtgcttattaatttgctcgcaat

SEQ ID NO: 57669 - DNA, 3694 bp, Oryza sativa
atacttcttcatgccatgcaacattttgttctgcctggaaatgtataactggacactaattggatcggaataatgcaggttttcaaagagcatgaaacggagaatcttttggaagtgctgaatgctcgttaatggtaggctcaggctgtaggtatcagcatattgtagtagcttaacaaagtcagccgtgaagtatgattgaatgaaggcatctcctccagaatcgctccatgcggtggtgattttcagcgaggtataagccgttacaactattccccttgaacatatagaccacagattccatttagtagaactgatgatggattggcaattgtgcctacctcatatgatttgcttatggtcagaaaatgggcaggaggctgccagaacgttgtatctgtgagttaaaacacacatggatcaggttttggcacaatttgggtgtatattctccgctcccctgtaatgtaagctcagaaactgggaggcaacggtgtcgttttcaccctaaaaatttcttgtacatctcgaaaaagaaacagatcagatgtgtaatcctcttgtcttataagtccctccattggtcttaacttttaagctaacacttggttgttgggtgtaccttctctgattgtgatttagtactcgatgatctcccatgtttattagtcaaaaatcattgcacgataaagggaaatttggttgaagtgctgacgtccattttactgtagaaaatcactttcatgggcttcacgttccggcccaatataaaaggcccccccgcaagtggtccacagtaccgttcctgcctgtaaatgggccaaattctctcgcgtgacgcctgtttacagttgggccggaaagaaatatggctgcgcgtgacccgagcggcagaagccacggccaacaaacaagacggcgtccagcactatattagtacttgtaatctaatgactgcaaagataattttacattttatatatcaagcacctgcagtgcagagaacggcctggataaagcctcaaaaacggcagccaagtcatttcactaccagcaggctgggcttcctcaactatttgccactggatcctcctaagctaatagcctaataacccttgagccttctgagctccatgttaacacaaccctacaacctgtcgtccagttaactcatcaggatgtcttcattcatatctcacaccaagactttggtgtttggtccggtgcagcaaggcaacaaatggggtggatctcttcttatgtcgtttggtcagctgttgttagcagaattcgacgggtttgcagcggctggcttctgcggtttacttctcaagaagctttttgtgtacagggctccgaatacaatggcctgttaccgaaaacatgttaatcataactgaaacgaacaatgtgtaatatcatggaatgatttacgaaggctaagacagatgacttacggcgccaacccactgcatccagctaagaggatgtacaaaccacacacaggacaataatatactcaccagctacaacaatacatggaaaataactgttatggaaaggttaaataacacatctatacacatttaaggatgataaaaacagcattcacctgtctagtcgtcattatcgtagcaaatgtgagagccccaaatgttcgtatggtgtacgatatgaagaactgactagctgttgcaacctggaatttgaaacacagtaaaacaatatatcgtactaattatgcaaacagtcacaatctagcttcaatttgtgggttaagtgccaaatatttaaaatttgagacagttcagaagattattttttgtcctaatttaatgtcccaccagacgtactagttagtattaaatttcatctccatttacagcttatgtggagaggtggtgacatggaaacaaggaacaagcaacaaaattgcacgttaaaatatcaaaaggttagtcttacactggataggattatgacgtcgtagaagcaatctggatgacgaaacataaagtccacagctggaatcatctgattctggagaataagtcctgtaatagaattacagcaacagagatataaaatcatgaccgtagcagttgttaataatgtactccctccgtactcgtaaaggaagtcgttttgaacagcgacatggtctccaaaacacaactttgacttcctgtttctataaaagtatttattgaaaagtgatatatgtatacttttatgaaagtatttttcaagacaaatctattcatatattttttacattttcaaactcaacaacttaagagttattcatgatttatattcccaaggtttgacttaaacattgtcctaaacgacttcctttacaagtacggagggagtattgcgctgtacagtgcagatgtacagggaaaacattgatagaatcatgaaagcaaagaattgcaggccaaatttctgcagcacataataaaagaaaatacagcaaccataagggcaagcagttaccgctcaaactaagaacacaggagcacattgtcgtgtagaatatttgattgtgtatttccatgtcataccctttaaagagtttatcttggaaggtgcttgtgaaaccatcaaatctaaaatcaacaaggaaatttgatccaattagatagaagtctgagggtcagagctgatcaagagaaagtaaaaagggaaagaaaacacaacagtgaattttaactgacaataatgtaactgtactaatactccaataccactgtagtaaactcattttaggggattgaactgcttatacttttgtattccacgaacgatattgaatcatacagtggaaagattttatatttcctagcccagattttttatgtgccagcaaacatgtattggtgtatatatataacaaaagaaaatagttctaacatggcaaaattatttaattgtattttgaatgtaacagtgtgttatatgattgatgagtgcaagcaaaagcagatttgcatgccaaatagagctgagtaatcataagatttcataaatgtaaactgttatagaatgctatgatttgcctcgctgagtttaagataagaaggattacccaagataaccaagcatgagtgaaacgccccaaatagtgttttctctgcctctgttgaatggactggcatccattgatgcctgtatccatgaagacaacacaggaaaaaaaatcacttcagaagaaataccaaaatctaagcaaggtacaaaattttcaattattaagattagttcttcggatgataaaactctcacctccatactgccaccaattgaattctagcgcatgctctattcctattataattttgtaatgcgtttggaaatggtggcaattgaaatttcttatgttttccaacacattttctatccgtgtacatttatctagcacgaaataatgtgatattcagcagtaaatgaacagagatggatatgggaattactgggtatagaatgaacaacgagcaaccaacagtcacgacaactgcaaagaagtaatcttttccaccgtacttcttcctcattataattgtgccccaaatctatcaaaattaaaaacaaggtaatagatataagaaaagggaccatcttaattgtcagggaaatagaactcgaacatggaacgtgtaaagtagagaagacaaaaaacgattcacat

SEQ ID NO: 57670 - DNA, 607 bp, Oryza sativa
cccagtcagcgaataaaataaaaaattccctgggtcccacctgtcattccctaggggttatctctcgcgcacaggccacccactataaatggccaaaaggcccgaggcccgaaggcccggcccacggcacgaccttttggcccggcccaagcatagcacggcccgactgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacgatggaccgtcgtgccttcaggccggcccggcacagcccgagtcatgttgggccatgtgtgcggcccgtgggccggcacggcacggcccggtgcgtccgtcgggccgtgccggcccgacaagcctt

SEQ ID NO: 57671 - DNA, 6634 bp, Oryza sativa
tacggcaggctacaattgaagggggcggatgccaactttcttctcatcattttagtggctacttctcgcgatgatgttttcttcatcataaggcagtggcgttcagatctaccatagaccatcgtcagcttcacttcgattaaaggtatcgcttatctatatctcatcctttagatctaccctatggattttgggcgtgtgcctttttggcttctcgcgacattatcttcgtagggtatttagctatagcctatggattttgggtgtgtgcctttttggcttctcgcgacattatcttcgaagggtatctatagaaggatgcaggtaatgatgttcgtggccttttgtgattgtgttaagtttggggtatggaggttctgtctcggaatgagggggcaacaatactagtgggcttcattcaggcggtacttgttactaattctttaactccggggttaaatccctaagtctgaccttagttggttgtacttggcaatggatgttctttccttcttgaaggcattgtctggagttcacagaatttccctaggtgaaaacctatggtctgatcttagttgattggaacatgacaatgatgacgcgtgcgtgcgtcatttcctcattggaggcgttgttttaaagggagtccatttgatagtctaagtgttgttttggtggagataagagatgaagattacttgtggttgtaagtcgctgcggcacggttgtagcagttgtgtcgctctttttccttttcttttataatattgataggctgtgtgcatcctagctatgcagaggccgagagtggtcttagagaaattgtatcttctcgatgtaattgtttaagatcaataaaactctctttatctaaaaaaaaaaaagggtccagttctagaacgaagtaacgggagcaccaagatgcatcgcccagtcattttgatttttgacgaccatatttttgtgttaagaaaaaaatcatttcatgactagattgaatcgaaccccgcaccaccaaaatggaggctcagtctataggcgacagagagcaaatcagccatttgtgacgcggatttcgaggaaacgacgaacagccacgacagatcgccacaatcccccgagctgttacccccattggtgggttcaaaattgggcgtgagcgattggaatgtgaaggggaggtcgaagaggggcacctggagaaggccgtagatgaggagggtgctcatgatgccgacgaccgcgaagccgcacctccccaccaatcggcgccggtcctccttgtccttccccgtcgccgccgccgccaccggcagcgtccccgccaccgccgccgacgccgacgccgaagacgacgccgcgtccgccatgccctagcctagcctagcctagcaggcgaatcggatttcgcggcgcggcgaggggagaggagaggaggcgatcgatggcggaggcggaggcggaggcggaggcggagtgaatgcgtcgaggcgcgtgggccccacgtggcagctacctccgctgggactcggcgcgtgcgctgactcctctctctctctatccggtgaaggcgtgcgaccaaagcgtacggccggtctgtaaccactaaccagtaaggcagtaaccacaaacacagggaagcgttcagattactccactctacacatgccaataagataagatagtgctcactccgttctactccaacgaatttagatataatagagatatgtccagattcatagtactgctaggttagtcttttatagtactaagggagtaaaatataacagcacttttgatttgtccccataaataacaatttttccttatcaaccaatcacaaccatccaatatttatatttcccaaataccttcgcttcttaaccaaacaccaaggttcacaattccgacaaaaaccggtcgaattccgcgaaatttcaacgctttgacacagctcataattaagtttcgattggaatttcgaaggttaaacggtagatttggtcaaaattcagtcaaaatttatcgaaaaccgatcgaaaattattcctatttaattctaccttctttaattctaaaccgatcgaaaagtaatgtaaaccctgccaatcacaacttattcctatttaattctaccttctttcttaaaaaccgtattcaactctaaaacttattatattttattatatttaattctacctacgaagatatatcctccgttcaaaaatattttaaattcatatttaggattagttttttttacagagtagtatattgatatattttatagaaaaatgctattaagaagcattatgaaaataatttctatgaccaagttttgcgacaatattgtataatttgaacaacactcgcaggatctcagttgcagtaatcttttttttttctaaaaactacttaacacaccattcacatgtaccagcatctttgagaagagtatgacgctcatcattatcactaaatcgcccgtgctagcatgtacgtggtgcctccgatacgatattattttagccaaaattttcaattttttttgaaaatttttcatgaattttggtaaaatttgttcaaattactaaattttgttctaagcttcagaaatttcatcatatcagcactgctcaatacaaaggccgaaaacgagaaagtgaaccctgggtggggatactttagaaatattttacattcgtgtacaaattttatgcgtaagaatgcttaaatatgtaaacggagggaattccattgttattgatcaaaccactaaaaaaataataaaataatttataatatgaaacggaaagggtaaaagatagcatgaagatggatatcttaaaagtgatacagaaaagttgaacacagccagcaaaatggagtacttgggcgattaggtaataaagccaatataatattagtagatagatagatcatgtccagtactaatacagagcaactaaacattgatgcgaggcagacacactgaattctgaagcagacatggagcaaaataaggcgaaatgggcagcaagcaaatcgaagaacgtccatgcggcatcgataaaaagcactggttgtttcacttcttcttggcgaggaagacgtcggagagcaccgtgtcagagcgcagcgccgccttcagaatgcccagcccctgtcaagaacaagaacagccaagacgatgggtgtgtttagttcacgttaaaattgaaagtttggttgaaattgaatcgatgtgatcaaaaagttagaagtttgtgtgtaggaaagtttccatgtgatggaaaagttgaaagtttaaaaaaaaaagtttggaactaagctcagccgatgatgaacattgaacaagaatgaatgaataattcatcagatgcacaatgctgcactatacctcgtccatggcgatgctgacgtacttctcggcaagctcgacgtctttgccgacgctgaacttgttgatgagagtgatgctggagatggccgacatgggcgtcacctccagcccgtccgtcaccatgtacgtcacgagccccttcacgtacccgctgctctccccgtcgcctcccgacgccgccgccgacgactgcgccggcgacgacgcggacggcagcacgagcgccacctcggtgtccatcgcctgcttgcactgcgggcacgccgccttggcctccatggcggccgtggtgcagtgccccgcgcaggtgtacagcttaaacctggccagcggcgatcccccggcgccgccgctctccggctgcagcagcaggagctcgcgggcgtccgggtggagcaccttgggctggagcaggtcggcgcggtccttgttggggaggaggtaggaggcgttgatgtgctcgacgctctggtacagccgcccgatgctgccctgcatcgtccccgccgagatgagcttcacgacggcgccgaccggcagcgtcaggaggctgaagacgaagtcgacgaactccttgccggcctccgcgaacagcaccttcttcgacttgctgtccaccagcagcttcaggctgatcttgctcctcgaacccatcgtttgtgggttttctcttgctgattcaggattcagtatgtattcagatgttgagaaaatgagattgctttgctgcgtctatatatagttctctcactttttacctgaccattcgattagtggagtgcttaattaatggcattgttaactgaaatctcctagtaggcttcttctcagtaattccgtggtgggaattggaagagccagagcctttttatcttctcaacactctgcttcgggaaggaggaattcaggatcagcagttaattcagcgttaaatcatcctcccaatctctccaacttcaagtttagtaagtttagtaggagtagtagtcattctgaatgatgcttcagaaacagagatccactacattcacatggctttatctgccaaaatggcacatttgagcagatgctatgctactgcttcaaggaggaaaccatatcaaaatgtaaagcaacacatttagagctaaataactgcattgcatcagatcattgttacatatcaattgattgaagctaaacctgaaggaggcgacacaaaaatacactatacctattctatcattatattcagagaaagttctatgtcaatgccctgtactgttccctgttctatgaatattgtcagtaaaactagcaaactactctgttgattttcttcaaccaaaactagcaccatcttttcgggaatacaccagaggtgcattttttcatactttactgaactgatcctcagcaatgatccaagtggtactatttctaaaagaatgaaacaaatcttaatgatgtcacttttgtaggacgtccaagctgtccatccttgctgaagtctactgctactctacgcttccacatcggggtaccgcaacgcactttccgctgaaattcgtcgatatcgagcagaacaacaattagagcaggtacaatatcaggctataagccagctacaaatatattttaagaagataaataaggagagagaaaagcagcgggctacagatttgtagccagctgtagcacggacttcaagacgcagtgtgtatatgacaggtgggaccagatattaatagtgtagtatgtaactattgtatagatgagctattagattggctatagatgaattagagctagtagttggctatactattaaacttgctcttagtgagcaattttgtaataagaacaagtgaacaatcaagtcttaaaacaagtgaactactctactaaaatgaaaattcagtaaccaatgctactgaataagtagtactcccacaacagtgaaaactggagaaaggcccgggtcttcccggctagtaacgcaagctgcgagctagccggtccgggttcgagcctcaccccctttttaattcaaaatcaatctagtccttcctagattggtcccattttatatcagtgaaaactgctactgaaatcagtaatgtcgatcagactacggtatgctcctaaactgaataatcatgcagtgaccaatgataatactctcacaacaatgaacaacgctgctgaagaaagcaagatcaaaattcagcaagcagctggtagaaagaacaaaatgcctgtagctagctactctactactgaccaacccaactatcattacagcagtgatcagtgaacaatactactgaaatcagcaacttcgagcattctacaatatacgccctccgttcctaaatatttgacgccgttgacttttttaaacatgtctgaccattcttcttatttaaaagatttaagtaattattaattctcatcctatcatttgattcattgttaaatatactttatgtatacatatagttttacatatttcataaaagtttttgaataagacgaacggtcaaacatgttttaaaaaatcaacggcgtcaaatatttagggacggagggagtataacttatgctactgaaatgaaaattcagcgaggaaagaaagaaacggcagtgagctgctcgtcagtcacctggtgtcccgtgattgagcacgacgatgtggatggggttgttgcccatgggcaggtcgacgagcagaggggagaggtgggcatagcggccggcgcggacgcagagcgtgatctggccggcgtcgcagttctggcccaagcgctcggccatcgtcagccgcaggtgcgtcaggttgttggtgttcaccctcaccggcgcccactcctgctcgccgtacctcccggcgttgtcggctcggacgtaccggatcacccgcgacaggtcggattccaccggcggattcgtgcggtgcatcagctgttcatcgatcgcacaatgcagtgacaatgaattaatctagcagagtacacattggggacaacagatatctgatagaacagtataagatcatgaaatggaattcagtttggaacaatcgatacacagtttttcaagaaaccagaaattaacaacgctcaagaattttcaagaactcgagaaagatctagctagggattggaaccgatccaagaatgtttgatagattgaatatagcacaggatcatgaaatggagttcggttggaatgatcgctacaccctgt

SEQ ID NO: 57672 - DNA, 735 bp, Oryza sativa
  unsure (1)..(735): unsure at all n locations
ctgcgccaaagtaagacantcgntcgnacccnncaatactngatttaaatttgaattcaaatttaaatatattttatataaaatatttatatacacatagtttatatgaacaaagttagcaatgtatatatgtgtgtgtgtgtgtatatatatatatatatatatatatatatatatatatatatatatatatatatatatatatatatatatataaagtctatgtacatgaatagtttttagtgtaatatattttttatttttttcacacttatttttaaattgattttaaatttacgaagaacccacgactaattgcgtaacgcagcgttgcttttttttacacgaagaaacagcgtgcgggcgtgatttctgatcgctggcctccggcgccagcgatcggtcgcgcagcagccacccctgtagcggagcccactggatgtgtttaaaattttcacgggggaagggagggaggtacccccccccctcatctgttctacaatcacactcccccatcctcatcgataaagagcccttccaagcattccctccgctctcaaacctattagaacgccctctatagggcacgtataccctcacctaactcctgaatccattctgacctatacgtattcttacttataaacatcctactgcccaggataacagctattacgctttatgagctatctgttttccccactccacccgaatcacattcaaattcctcacaac

SEQ ID NO: 57673 - DNA, 2272 bp, Oryza sativa
ctatataatcttatcgttgattttcatttaaattagtggacccgttattttataccattagattagatctattattaaaaaaatatttttcttatgttgacatacaagcgctacacgatgtaaacgctacttcttgtctttccgtacgtacaaatgcacgtgactgaaagcaaaacgataaagctttcctattcttcgctggaaaaaacatacatccatataaaaatcaatggtctttaaaatatgatttctataatataaaaataaaatatataacttcacaaatataaatatatttacttaaatctatctattattatatactaaaagttcgttaaacttcctacaaacgcttctaaaccgccttcggtgctataaaacaaaaaaacgtgaactttcgatttgccttttaatagacgggaaacatctagccctcaattttcatttaaactggtggatccattattttgcaccattagattagattaaaacctcccttcctctcctctccttgcacgttttgtggtccaaattacagaaaaccatacacattttgacacttggtactcaagtacatatattttggtagtgtagtttaacaaaactaaactatcaatgaatggattcacctgtgagacgacgtcatcgttccacctaggatgaggacgtggtatcctgttaacttggaccataaaacgtgtagttttgtgaaatttactcttttttctattcccattcacccacttttattttttttacctagggtacccctaaatatttttatattacttttttcgctattgacttttgagcatatgtttgattattcatcttactaataaaaatacataattaccatttattttattatgattttacattgatgtcttatgttcgctatattttagcacaaaatacattgcggcaaatggcatcgacatgtattaattaactccataacaattttttcaaaaaaaaatcgcatcaaactatatactttatggtatcaaatattacttaacaaatatacaatggtaatttgaactatgtaaaaatgcaaaccatgtaatttagttgtttttttaagtagatccaatttaaattttaatttatgtgagattaacattatcaaatcattttggaatttttcgaaactgtttggttggtatttcaatagtaataaatcctacattatacatatatgtaaagaaaattcaacaaaaaaattttcaacaggtaaagtatatatcattggttttttttcatattttctaataattatttaaatgatatgaaaatagtcagaatataacccaaaaataacatatttatttaagaagttcaaatatagttaataatggtccaaagacataagtcgataaaaaatagctatttattttaaaagattataataaattagggttcctgactaatataggatgaaaacatgagagacagtacattgggagagggcatgaatgaggcgaagggggtggatgttgggcgatggtgtacgtatgtgcatacatacaatgcccctcgggctctatattggcacaatcgatgtttactttatgttttcactcccaatacatatccaaaatgacatatttggttaaggtcggcttttaactctagctaccacaccaattataattttatatccattatttgtgattgatcgaaaaatgcagttctgccagttagaggaaacaatccaatccgagagtgccaatcgatcttctacataagtgctctagaatatattctatggcaccatttaaatgactttattagacagtatttaatgatcttttagtatatagaacatagatatacttgccgatggctttgtacttttatttcataccttccgggtataaaaaagtatgttttttataaatatttatagttttatttataaataaataaataaatcaatcaatcaagatcacattaactatattttactacatagaagttaacatggcaactaaataacaacggaaaattaattgtacatatgtattatgttatactaaatcattcattgtatgtaacaaaagtcaattaaacacgctctagagcgctcataaatcaccgtataatatgtcgtaaagttgtaataaatagtaattacattgacgtatctattatttttaactattagatctattattttttaaaaaatcttaagtcgccatgtgtcacctcctatgaaaacaggaaaaaccatagaaattcttagaaaaaatgaaacaccccatcatcg

SEQ ID NO: 57674 - DNA, 6373 bp, Oryza sativa
  unsure (1)..(6373): unsure at all n locations
aacgggtacgtcgcctcccattgaaagaatttgtcaagtctaggacttgcacccgagtgggcaaatttccaccacagagaacctaaccaattgagctacattcacttcgtaataatgttggatattaaaacaaccataatatttaagctacatttctgaaatactcctatgacttttaaaccggtggaaatattatttctaaccgttagatctatcttatataagaaaaaaaaagcgtgtattcatggtacatcacatttcaaaagtattattgtgcaattatatttcgtcgttatcgtattcacgttagctggcgtggaacctctgacccactctacatgaaatgttcataagatggactggttgtcaaactacatctatcatattaggctatataaacccatacatttagtggaggttcacgtcccacccaattcatcctcgaataaaccatgataatatatatgcaattaaaaaataccttacttttactttacacttacttttcgttgacatgttttctaaaaaaaaataagtctaccttctttttaaatgatgaaaaagattataaataatttgtttatagatagtattacttaaatatgatataatataaagctaataggttaaaaattataaaagcaattaatgccgactaaaacaatttacggagaaatcgtgatagatgttcttcggttaatatttcgctcttacaagtgtctcaaacttagtgtacgacgcatgcccgcgtattcacgcgggctaccttcctagtttgttttaattcccgattaactacgcgtcgtgatcggtggtgcccaatttatttcctttttagttacctccgatttcctacagcgctaaatataaaagggaggctgacccaagactcaatctccccgacaaccaaaccctaaacccgatcaacataggtgctggaggggaaacgtgtgaaaattccgggacaatataggtggcgaccggaaggccgccgctaccccacaagtgatcgccggtgaccccttcgggatcaagccggcgttcttactgctacgactacttcccctatgccgatgatcaccggagctgttcgagggacttcgtcctctacttccactcctgttgacgacattgcagagggaagaaagagaattgcatcaatggttttaaacaacggtcagtaaccctaaaaattccgcattagggtgatcatgtttagactaagcactcatgttagtagattatagtttctacacatgaggtttacctgggccggtaggtcgacgagggaagggcgagaggccatggggggcacgacctccaccctccactgcatcatcgtgctggcgttgtcgccggcgacggagacgttcttgtgccacctgcggaaccttgccgtttgcgccgaaggtaccggccggcgcctttgcggaggacaaaggattcgcgccggcggaacgcctgccacaggtaccccggcggcgttgggcggacgccgaggtcgcgctgctcggcgacgaccccgtcggatggccccctcccggcgccgtagttggtcgccacgaggtaccggccgtacgcgccgcggaggcggacgtagggccccgcgctggctcccggtatgacgccgatcaccggctcgacggcccaaccgcgttgtgcaccccgcggcggccgcacaggaagacgctcgtcccgtcgtcggccgcggcgaggtacctgctgctgcggacggaggagcgcagacgcacgaagtgcgccacctggaacacctccattcgatggccggagatcgcggcggcggnggcngnggcggnaacngagacggagatggaggagaaggggagagnnagnnaggngagggggnnacgcgnnggcggcgccaaaggcgaggctattcgaagcgggagaaacggtctccgtgactcactgacaaggtgggccctgggatctggttggtgggccgcgttggggacaaagcccacggcccacccaaggcttcgtctccctcctcctctccccttcccatttcgccgatcccacccacggcggcgccgccaccgccaccgccaccgcccaccggactttgtgtagagagctcgatgggaatccgcggcggcggaggagaccggccggctcatggaggggaagatgcagggccacgcgtggaggaggccggctcatgcttcttcttctccgtcgatgggtatgtatcttctttttctgaagctttgctatgcaatttcgtcattcggtatgattattcagtttcaccaattttgcatgtattctgttggtataactaggactatcttggttctgattattagtgctacgtaatatacagagatgcgaaaatatagagattgctacgtaacagtgctgccgtagaggcttatggaacaggacgcactttcagattaatagaaaatacaattacattgtagaatgctaggcttggaaaacaaatcactcgtataagtattcacatgctatgttctaaagctggtattatagtactggattctcctgtgccttgttaggttacggactgaaaccaaaaagttgcctacagtttattttgcctcacaaattcaactgtccatcagggtagattcttgatgttcagttctaaactcaaaacttcagtcatttatttgctgattagcagaaatgctctagtgcggatagcatcaatttcctggttttgttttaacgcttcgtattaggattttcatgtggtttgttttgtttctttctgttatattccatttctttaatgatatttcctttatcaatttatgaataaacacaaattaagtggtagttctgccatcatgtcatgagatgctaacaatgttttgtgggacttttggcttttgtcatactgaagaagctgcacacgtttcctcatatggttacagaagtacagaaccgaaggaaatttactgggccgcagtcccacagctgtaggtgcatcaagtattcagaacatgctccccgccaaaaagaagtattcagaatatgctatcgttagagtaataaaacttgcaaacttctgtaaaagcaacttacatgaagcagaatctctttcctgcttccttaggttctgtgagtgccatttatgacgcctaaaggtcctcagagaaggtacaaaggccaaaaaaaatggcagattgacgggtgcacattttgatttatgatttagccgtggccttcaataggaatttaaacatgccttgctcctgtgtaacaggaagatgtcgaatcaatttctaatatttaacatgaagtgaggttcactttgacagctcctggaaattgattaatctagctgatttcatacttctgcttatataaacaaattattcagcagttttgtttcaccttctcactactagcacatcacggatatatgcttccatttgtgcaatgctattggagtttatgttaagctgtttaggatgtagtaccaggcatgcctatgggactagttagcataatgggccaaaaaatatctcaaagtatgaaagtatgtggtctagaaaattatgttacaaactaccttacatcgatgtcaatatgcaagaaataacatgctgcattatgctccgtttgtactcacagggacagcacgtaatggagttggcatgattgaattacaggatgttcctgctcactgaaacaagtaaatgatgacatgaaaggccgaaagcagtgtgtttctacccaggtttgatccaagcttgtgtcggctgaaaattcatcatctcttatcatgtgctagcccgccttgattgattgatgctactggacagtttgggattggtaattttctgggagtgccttatggggaccatctcccatcaattgttacttgcctcctgaattacatttaactgtgctatcttgtttgcaattcaggtaaagtctctgtttaggctgtatcaatcatgcatgtgaactagttaatgcaaaggacctaggaattgatgaaagtattaggcatcagcatcaatggattagcagcagcttctatcatcctgactcaattctgtactcccagggacagcagttgcctgctgatgttgctaggccactagtactatgtagtagtatacattacattggatatctcaatcatttgattaaactgtataatttttcggcgaaagctacctttgaatggtgatgtggttagtttgtagatcatgcactgactaaattaagttttcctctaatgaaaatggtagaaggtttactctgtatgtaatggaacacatgtaatttttgtatgctttaatatgaaaatacccatgcagtttatcagtttgtatccagtgcatttaggaatatctatctctagtctgcaagttattttttggggataaaatccttattgtactctgaactgttttacttgcatgtgattaggagtaggaagtagaaatcccctcttatctgctcatgtgagacctaacaggctaatctaccaggattaattaattaattacaaaggagcagttatggattatcttacactggaaaaagaagtggcctagtcaaggagagttttcttggagtgagctcctttgtgttgaaaaagatgatgttgggacatatgcaatggatttgggtgctcaaagcagttggtcacccatgttctgctccataaatgaaagagatgcatgggaacaagcctcatgtttccaggaagaacaatggcaaaggataacagatttgtctcttctcttttgaacacctgttaattagtttatgaaatcctttccaactgaaatttggcaccttctgtggcagtcactacccattgctgatgaacatggcctaagtttcagtaagtgcaatcccctatattaatgcttgataagtacttcctccgtttcataatgcaagactttctagcattacccacattcatttagatgttaatgaatctaaacacatatatatgtctagattcattaacatctatgggtacataggcaatgttagaaagtcttacattgtgaaacggagggagtagcaactctgaaacttgaagattaaacaaacagtaatttccaatggaagtttttgctaatgttcgtcagaacaccagatttttttttccttttgaattttgcatgattgccttaaatttgtcgtccattgttgctaatttgatcaaaacatgctacattagacatgctgaggatgtatcataaattactctgcaagttgtaacatccaaagtagatggatactagcatacatcaatgtgcagagagcatatcaagaatgaataagctctctaccaaaaggataaataaaattccgattccagccaagccaagggcatgaatgaactcgataaacctaacaatctctttatctcactgcaaagcaagaattactaccatgtcacactatgaacaccctcgatcactcactcacaagttgaaacgtcaaaacaaaaaataaaaaaagagagcaaggaacaggtttaattaaaatttgatactaacttcctatttacatcataattaagcaggatcaactctataataattctatcatgacgactcttaacactaagcagttagcatctactaatgtttttggttcatgcaaatattcgctcgccctcaatggtaatcacatgtcactgacaagtgggccctcaatggcaatcccttgtcactgacaggtgggccacacgaccaccacctaacgaaccaaccggtcgtaagctggacgcacgacagccgtccgatcccgtgcacacgacagcatcggatcggacggtcagtgcagccgatgccgcttggcgctgaacgccgccggcgagcagctggccgccaccgccgccgccgccgccgccatgggcctcttcccgcaggcattggcgccgccgccgtagccgatcaccgccgcggaggaggtgatcccgggcgagagtgacgcgccggggtagacggcgccaccggcccggacgccgacggggagcgtgtcgagcgcgaccggcggcgggttgcgccaccgcgggagaaggccggcgacgagcaggttctgcaggagcggcccggcctccatgacggactggagcagcctgcccctctgcggcagcggcttcttcatggcgagcatgtcgagcaccgcgtcggcgcccgcggcggcggcgtgctgctgcttggcggcgggaggcgggctggcgatggcgcagcagcgcttgtcggaggaggtgacggggtcgaagaaggggttgtcggcggcgggggaggagacgaggctgccgccgtcggagtcggtgacgctggaggtgacgagcggcggcggcttggcggccgcggcggcgaggagacgctgcagctgg

SEQ ID NO: 57675 - DNA, 1999 bp, Oryza sativa
tgtaggtggtgagcggcgggtgaaaaccctgcccggccttggccggaccgacaacgatgaattccccctcctgagggtgttgtcgtgctgtctcacccctcaagggtgattgccgggcgaaagcccagtcttggctcctttgagccctgatggacggcagcggcggtcttccgtcgcttctctttttgaagacgtcgttttggcacccccttgctgtagggcgatctcgtctgtgttcctttgttggtctagcggcggccggtctggtgctaaccttctcctggtcgtgtgtgttggcgctgccggtgtgtgggtggtggtatatttttttctttctcctggttatgaccctccagggttgtaatcttgtaattttttcctgctctatcaatagaatttcgcatcgtctcgtgtgagtcgttcaaaaaaaaagatagaattagttttatttttggatagagaaagtatgcaataacaggtctgccgtgggagcggagtgaggaggcctcgaggcctcactagtcactactgatgctaggactgtgaaagcttcactaacattttctgccgaacatatataaaagaagagattgaagattcgtctagtttgttaaacacaccttactatttcttttgtagatcgatccgtcctggactgcatgtgtatgaaaaatttgagattttggagagagagaaacgttcaattgtgagcatgttacagattgaacgccggatctcaaggttacaaccacatatcccttatcactgcactatcaaccacgtttcaagaaccagcatgtgtactattaattacaagtagccggctggtgtgtggatggttgacatcgttcattagctgagctagcagagagtacatgaatttatatgttgtttgtttgtttcctccatttctttgatgagagagagagagagagagatgagagcggcggaggagacaaaaaaaactttaaatttttgcgtgagaaaaggtcgcaccatccaccatgtgactacctttgaggtatggcatggtgaaccttatagctttaactgcctgcagctgctggtatatgcttcctcctactgaagaagaagacgacgacgatgctagagctggaagacgatgatcgagcattgctaattctagaagagagagatgctattagcggcgccgttaaacccaaacgactaagaacatcatgctatacactacacactaactcttagctagctaattaactcgggtccaacgcggctaagctccgaatttccattaataacttaccggccggcgagagcaattagctagatagatacctttggatcttctctgctgccttctgagcttgatcaacacgtactcctccagtccatataatgatgttaaataggaataatttttgaaagttcgattgaagattaccgcaattaattttataagtttatggtactagaaaaaaatacccgtgcgttgtaacgggtgaagtctattttaatctcattattattatatgatttagttaagataaaattaactatgagagttcacttggatatatatatttttaaaaaatcatgagctgtagttaggagtccgatcgtctcaagttagaatgcgagttttttttaaacagattaaaaagtgaacgatcttaaaaaccgactcaaatacggatatgtattttcaaaagcaaatgaacttaaaaaccgactcatacacggatgacgtaccaaaataccggcaaaaacatttttaatttttataatagtaaagatttgtgaagtatttttcacggaaaatctacgtactccacctccgttttttaatatatgacaccgttgactttttgggatacatttgaccatttgtattattcaaaaaatacatataattattatttattttattgtgacttgatttatcttcaaatattctttaagcatgacttatttttttttatatttgcataaaagaatttgaataagatgaatggacaaa

SEQ ID NO: 57676 - DNA, 985 bp, Oryza sativa
tttggcaagtgtttggacagggaagctcacatacttgagtgcctgaaacaatcaaattatatttggtaaattaataacatgaatcaataccaatgacactagacatgaataaatgggattgaatataacctcatattggcaagttgtagtcagtatgtttgatacagagaccacacagtacttctgaagtggagccacagggtccagggatttcttacttgcctgcatgaatgtacatacaggatttaggggtttagcatattctgttggaggtaatctcacagagagatctgtaccgttagcaccagcgcagacaccgtagacgtggtgatacggttacagaaaacaagaaaaagcgagtatctgaagaactccttttctgctccatatggaactctcatgattttttcctgcataacattacatcaaaatgttaattaataagtgatcatgtccatgtacacagtcgtaggtgtcttttccaagaagacatgtttatgaatacaccgtttaaaaaaaagactgtcggtaagtgcttatttgaaaggaaaaaagagtctagctcttttggataggaaagatgtattgtctttgttggatatggaagaaactagcaggggtttaaggaatgaaaggacgaatgttcagaaatccttttttttggtcctgtttacattgaactttgagccttgtgcagcatccaaacattgataactttccaaccatagattcaggacggaaaatggtgatttgtgtttaattcatgaacaatttagtataatcgagcagaattttgctagtaagttgacccaaaagaacaattaccaatctcagtaccagtgagttgatcaatatctacaaaacattaaaacaaacaaggaagcagtcgaagaaggggactcagtgcgtctcaacttaattgagcttatttgcaagacgagacaagacaatcaatccactgcacagatcaacttgtgaacacacc

SEQ ID NO: 57677 - DNA, 42522 bp, Oryza sativa
  unsure (1)..(42522): unsure at all n locations
aatagtacttactacatcttcctatattttctttaatttgatcagaccgtacaatttgtcgaaaataaaatgtatgtgtatatgaaattaaaagctagcacgccaaataataattttaagagagttttacatacgccattaaaactttgtaaatctttgcatatgccattatataatccaatttttttgtgccgtcgaaacaaaggagattggacctcctataccactagagaattagattgagaaggtgagcatgaaagagttaggggaaaaaacaaaatgccctacattccctacattcccatgtggtcctacatttagcacaaccaatctctcttcttcccaacctgagcctttgatgcatcagcatttacttacctaatgatgatgcaccaatttctcatctccgacaccagcacctgtccagattaactatttacaaatgcatataacaacctcaccactagggcaaggcatgcgcccattacgtgttcctagctagtttgagcgcaatcatcacgttcaactcgcatcagcatttacttacctaatgatgatgcaccaatttctcatctccgacaccaccgcctatacagattaactatttacaaatgcatataacaacctcaccactagggcgaggcgtgcgcccattacgtgttcctagctagtttgagcgcaatcatcaccttcaactcagcctaatagccatgttccattaaccactttatgggagaccaagatcactgaccgatcaccttgagccttaaagccagagcatcacaggcctctctaggcttaaccatgcactatcccctttagcctcctcatagcttgttagtcatcatcgaccttgtagagcattcctgttgccacctaactttgtttgtggacaatatgtcgattctttcctgtaagacctagctgtagatccccaccaaaaagaaaagaaaaactagtacaaataaccttgccattgcccattgcatgttccctaccaagtgaccctgcccatgtggtcatatggacatgaacaagggtagcaatggcaaaaacacgttgtcactaccgttgttaggaacattgtgggtcattgcagtttttatgtttcaagtgtgggatgatttccatgtagacaatgcctagttggtccagtagtgcttaagaattgaatagtcgaataagcatataacaaagataccaattttcagagttagttgttggctggatccaacaagtcaccagtgtcatggataagaacataagctattttgggtggaagcacaaaaatatagttttgaagatggcatgcaaaaaagaaaatgacacagccgctgccacatgcaaaattttctcaaattttagtgtcttacaaaaacataacaataggatgtggccacattctatattccaaactggtgttaaagcttaacttataggcataactgttgcactcccccataaaaatgagcaatcatgtttctcaagttgtcaacaagtattaagaataaatcaactcatgacaaaagttgactagtttatcctgagctgtttgtattttagtgccagttgcatgacacttgcttacaaaatgatagaccaatctgaacgaataacatatgggctaacgaattatgttaaaaaggttagaaaaacatgtgtacaaatggggatttaagttaatgatgaccgatgatcattgtccctttttatgaaaacatagaacttatttgaccatttaaatagccacaatgtcatgctagaaaaaataccttggcaatcatttaccgttccattagggttaaatttccaattattaacaccaatcagaacaacaaaacaagagtcaaacatcaataatcagttctgacctgaaattattattcgttattagacattgcacaccctaagcctgaggaaatgttctagttctgatttgttgttttaaattttaattatattgcctggataatcaagacagttgtattgctctaatagcagaccaggtcctcccaataccctaaagcataggaaaggaacacacagacaataagtctaaagagttacctgtgcagggaacctaaagcataggaaaggaacgcactgacaataagtctaaagagttacctgtgcagggaacctaaagcataggaaaggaacataaaacataggaaaggaacacacagactaaagagttacctgtgcagggaattttccatggaacgcgcctcgcacaagatctaaccctccctttgtcttggccttgtatatcccatagagcagcttcaggtcgaagtcatagaggaacagttttgcccctggctggatcttctccaccacatcgatcttccccttaggcaagccaaacacaccattctggaagcactccggctttgtcttagcactgcacatgaatataaacccagcttcacccttcctctccctcgctttatcgtccttcttttccttcccctttattctccccttcttatcctccttcatctggtccccctctttcatctttgtcttttcctttctgctcatcctctgtcctccattctccttggccaccgctgccgctgggctgacctcagccggcttcagagggggtgccgatgcagtctcagcagtggcggcggcttccgcagctgccaccttctgcatctctggatcggccttggccttcttcttaaacgccttaggcctcacccctctgggcgtggtcttgggtgacggaagaccagaggacgaagctgcggccttgcccttggcattcgggttggccgacgtcttcaccatggctgatcgaaacagccaaatcaaaaaaaaagtatatagaataccaatataccaccacagatgattctactcaaaccaaaccctgtacgggcataaatcgtttaattcgatccaattgaacaacggaaaaaacttgagggaaacccaaatccggacctggataaggggaggggtgcctgcgctttttattacctgaaaaagtaagagacgaccactcgtacgaccgcgcgtcgcgatgatattagcgttgggacttacgagagatgtccccaatctattatactcttattataaatcggattcagcggcgacggggacgactaataagatcggattcagcggcaacggggacgactaataagatcggattcagtggcaacagggacgaccccgagactgtgacagaccagtcaccgaagttttccacgtcgtcggtgcctgatttccgccgtcccgggccccgatgcggcggtcctagcagcgaggcgactacgctacacgagtggagcagttgcgcggcgcctaccagaggagaaggggagggacggagggagcacctggattcctggagttgtgcgcctccccgtccggactccggactcgcgaggggggagatcgagaggcgcccgcctgccgctcctccgagcgctcgaggagaccggttcaactgaccgacggagcggtggctacaaggaggcggatttcttctaggaataaattcatcaaaggtcccttaacttatcaacgaatccgattttcgtccttcaaccgcaaaaccagatacaacgggtcccttaactatcaaaaccggtgcatattaggtccctcggcggtttcgatggcggttttggctgacgtggcgcctgcgtggctaattttgactcggtcttgatctgacgtggtatgacgtggcgcttacgtggcaatttgacccgggaaaataataaaccccgtgggacccacatatcagtttcacataaaaaaattaataataatggtggaacccacgctgccccacatgtcagtctaactcacccctccttttctgcttcctctctctcctctcttcatctctctcttgcgctaggggatgcggccggcgacgacggcggcggaaatggataagagtgaccgctaggggcataggtgtgacatcgccgggggcgcttcgaggtggaagtagactcttacgacgtggccgtcggaggtgagcgaagtcatcatggactcacgggattggcggtgtcgtcggcagcggcggagcaggagttgtagttggagtcctcgtcgtcgacctcgagttcgtcaatgtgctcgagcatcacccaccattagtagtcgccggcagcggaaggtagcgccgccatctcctgttgggtttccatgggccacggcgagcggatcgatatgggttcctcgtcaatccggccggaacggtgttttcttgcccaaaacaatgatcattcattcattcatcaacctcgtcataacacaagcaaatgatgatgacgaagcaaaatatactccagtcaggtagtactagtcgctattgcttctacctttgtatgattaggcacataaacgcggagcggaggtcgtcggctctggtgccccagccaaggccgtggacgaagagcttcctgctcacgggatcggcctccgccgcgcgccgcacggtcgtcatcatcactggggtcgtctttgcagccggccgcctctcccctctcccgccggcgaggtggccccctcacccgcccacgtggacggccgcctccgaggatgcgcgcgtgtgtcggccggtcggcgggacacgttcatcccgccgccgagatgccgaggtcgacgtcgacgtcgtccgcagccacggccgcggcggcactgcctccgccgccgggctggttcccttctctccactagtttccctcccaccagccgccgcgccgcgccccttctcttagccggacaccgtcctctccccaccgcccgtgaaccgaagagaagagagagaggagaggggagagagatgaagacagagaagatggggaagaggagaatcagaatgacccagcgcaagagagagacgaagagggggaggaggagagagaggaagcagaagaggaggggttaattagactgacatgtggggtccgcgtgggtcccaccattattattattattgtgtgtgaaactgacatgtgggtcccacggggtttattatttttcggatcgaattgccacgtaagcgccacatcagtgccacgtcagatcaagaccgagtcaaaattagccacgtaggcgccacgtcagccaaaaccgccatcgaaaccgccgagggacctaatatgcaccggttttgatagttgagggaccaattgtatctggttttgtggttgaagggcgaaaatcggattcgttgacaatttaagagaccttagatgaacttattcctttcttctatacctgacacaggtgggctgcatggaccacttagcaagagtttttcgggcttccgacggtggtgaacgcgcaacgcccaggcccaacaggaatttttgcccatattattgctaaaatttttggaaaaattacaaattacccctcgcatccgatttttaaccctgaactctaataccgattatttttaaccctaaaatttacaaaccggatacatggtagactggcagtctagtcaatcaaaacataagaaatatatgggacccatttgttagccaaaacaaataaacatggtgggacccacttgtcagcctaattccccttcttcccccctcctcttcgccgcttcccctctctccccgtatctggcgcactgaggcgagcggcgggaggccgaggatgagcggcgcgccatgttgcggaggccgaggacgagccgcgcgccagcggtggagcccaaggatgaggtgcccgtcggtggaggccgaagatggcaagcggcggtagtacgtagcagcagcgacaccaaaatcttgtgttcctctaggcgcggctaacaaagcgtgagaaagatcgagaggggcagcagcaacgtgcacagatgccgacggcatcgaggcggaggcgaggacggcacgaccggcggcgggggcgacgcggtcgaaggcgaaggtgcggcggtggagacggccatggtaggggaaatacggtggcggggagacagggcgacgcggcggggcgcctgtagatgccagcggcttggaggcgaagctcctctgcggtggctggcgccgacgagcctagacgacgtcggcgaagctatggaacgtcgatctcgaggccgtttccctgaggcttgagctccgcccccgaccgctagctccaaagtcctcccgctctgactcttcctcctctctttctcgtttgccaaaggaggatgtgctgcttcatgctccgacacgcctggatttgacgcaatcggcacgtcgagccccgtcgcatagctcgtctccatcgccgcctctgcgctaccacgaatcgacgtagcctgctggtcttggatcccaacctcctcgcctccgcctccatgccattggcctctgcaagcgccccgccgcatcgcctcctcttcctgccaccgtatggcccacatcaccggagccatgcctgttgggattgagctgccaggaaggagaggaaatgaagatgcactaacaactgggccccactgtgttttttttcgtttttttttctgactaggctgccatgtatgccatatagaccaaaaaccactccgaattgagttaagggggggtgattcgttcggatttaagagtttagggtttgtaatatccgatattgcagtttaggggtgtaattcgaacgacctcaatagttcagagtatagctgtcaacgagccaaactcgagtgaactcgtctgcccaagctcgagctcaagccgagcctattgcaacttcgagcttttaggcaagctcagttcgagctcgagctcggctataagtagtataatatatattttaatgataatctcttgataagtataattattttctagctaatcacactaataaaagagtagaaaatgattaaaataaatatattgtgctaacacatgctaatttactgtataaatagatactaatatatatttatctattagtttattatattaataaggtaaacatgtaatataaattatatacagtcaagctcacctagactcggtagaagctcgagctcggctgggtaaagctcgcgagcttttgctcaggctcgggttcggcttgtttggagcttgagccgagctcaaatcgagcctaggacgagccaagctcgagctactcggcgagcctcgagcttttttgacagccctatttcagaggggtaattcgtaattttttcaaaaatatatggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaaaatatattgccaagtgggtgcacaacaagactgtgcagggtggtgaacggtgacgccgggtggaagtaatttgtgcagtcttgtaaaaatataacgccattattctatttttttagcacaaccattattctaatttgatttccgttattctctgcatatatggttgctaagtatgaatatgagcaatgttagaaagttttaggtaatacctacaaaatcaaaatgcccacggtaatgaacgggatatcatctactagtaccataatacatgagagatttcttcagttcagacagcctaaatgacaagggggacaaacacaatacagttagcggagcagagccattaactcgtctgcttttgcaagttgcaacaacagcggcaggcagaaacgactgaacctacatctgatcattaccattgaaatcgtagcaaagatcagagtccgaagttgcacaatgtcaggaactccatctcggtgtcgacgtacttggtccagagatgcttgtactggttgaaggcgacgtcgagccacggcttcatgttcccgttgaagtgtatcaccgcggctcccttgatgtcctccggcctgatgtgcgggttgtacccgagtcccatcacgtgccacgacttgtccagcggcctcgtgttgccgtagaacgtcatgagccccgccggcagaacggacgctggatcccacagcgtgccgttctcgttctgcatggcacgaacacgagcaacatcaagctcaaaaaaaccgaaagcgaattgcattttcagccgtatcgagagggatcgcggtgagctagcttaccatttccatgagctggtggaatcgctgggtgcattggtcccggcgccaagcctggagatcgaacacgttgaggccgtaggaccaggcgcacgcgcgcgggttgaaccgctcctgcacggcggggtcggagaagttgatgtgcttgccgtatcggcggaaccctccgaagcaggtctccagcgcggcgttcaccttgccgccgaggtcgacgcgccacagcccggccaggtccctctgcaccaccacgtcgtcctccaggagcaccacccgccgcagcgccgggaacatctccgggaggtagaaccggaggtagtcgagcagcggcacgtccctgttgccgtcctcgatctgcctgatgaccggggaggcggaggcgttcaggaacgggaagtccgagacggcgaggagctgcacgtgcgtgccgagcggcggcggccggcgcgcgaaccagacgcggaaggccgggaggtacatgggcgcggtgaccacgtggaagacgtggcgcgccggctcggcggctgcgcgcgccgcggaggccaccacgacggacacggcgagcacgttgtcggagaagatggcgtagtggtacagcgccgggtcggtgaactgagggggcgggacgggcgggtcgtcggggatggcggaggcgttggcgaggcgtgcctcgaggaggcgcatgacgaggcagtggagcgacttgggcgtggagccggcggcgatgcgggagttgaggaggcccgcgcggcgggcgcggaggagctgctggtcgacggcgaagacggtgtcggagagcttctggatcttggactgcgtgtcgaacgcctccttggcggcgcctgccagggagcgggcgcgcttgatttgcccgcgcgtctccttctccaagagcgcgacggtggacagggagatgcgggacgagagcgagctgagatgcccggagatagacaagaaagactccgtctgggaggcggaggccgcgctgagtttccgcgcctgggccgcgtaggcggcgagaacggcggcgtggtcctcggcgtggcggcgaatggcggccagccggaagggtgcggagttcggggcggaggcggtgcccgtcgccgacaggaggaaagcgagggacgcaagcaagaggagcgtgatcagcgccgcgagcgccgcccgccgctgcgcggaagctctgccgccgccgccgccgcctgccatgggagcgcgtgaagtcggaatcgctcgccgtcgagcaatcccgaggcgaaatgcggaggaaaagggcgcgcaacgctttctaacgccggcgaggtgggtttagttaggttctcgtgggcccttctgccagtgactcatagactgtacatttggggtttcaacggtttgacgtgagaggctggccgtgtcactgacatgtggggcttttctcccaacctccttgtgcgatcggatttgaagtgggttaatggtcagtgtgtccggtagtggcacactgagaggagcagtgagttggtgatgaccagtaaggcgccggatgacgacggccaaccatgttagtgcagaatgcagaataccgtcttctgttttgacaatgtgattgttgggttatcctagcccgatgtcagtgggtgttgcgagggtgcattgacttttttttttgtgtgtcgcaactaaggaaaaaaaggttaaaatattggttttggtttggtcgcactatcatggctagtggtggcatgtcgatgatttgcctaacaatattgttggagttgccgatatcttgacagtgtgaacgagcggactgtcaatctggatgcagataacctattcggatttaggcccaaccatcacgacaggcccagtattctaaccaaactgggcctagtttgagacaaaggtcaacccatttggtccactaataactggacaggaatagatttttatccgggccgattataggtcgaactgtcgaagcgacgaaacgtcagtcctgatgagtctctctctactctctctcctgccgcctcgccaaaacggaaacgagagggctgagggctccatggagatcgcggtttcgatgtcggcgaggcgccgtgaactcgcagccggcggtggcaggccagccgttgggcgtgaaggaacagtagcgggctaatatccggccacaagacggcgaccgccgccgggggagtgccgcttggtggcggtgcgcgccacccgttcggcggaatgcccagcgggacttcgccacggacgggcggctcgccgcacgccgcttcagtcgatcgcgagcacgatccacacctcgaggatttgtaagtgacccaatctgtacgggattccaactaattcagaattcaagtccgacgggggcggagtgcacggggacctcaccatcactgcagcgaggatccctcttgttgcgtctgctatcgattcttcgatttatgaggtgttatgtgcgcaaggtatgtgaaccaaaaaggcaacaactgtcaatgttcagaactaggaaaaacgaagaaatgaagacaatcagctgatcaggggagtatttgctaataccctacgcattttgcagtacatgcaactatggacaaaattggaaccgagctacgattacacatgagacggacgacaaccactcttgcactgcataaggaggtaattagttccatgatgcatcctacattgtggactagtagcatattgcttcctaattctgttagcttcactgttaacagaacgaaattcgaatacctcttcatgctaacagtaatactagcagacagaggtagatgctaatcttcactaccgcattctaaaaccaaacctacattactagaaacctaagtatagcacttggttgactggaaatttgttgagacttctgtcgtgcaagggagtgattcccatggcaaggtcattctccagtcatcagaaagtgttccttgcaggttgaagttgatggaccgtggaccgctgttgatattgttagcaacatcaggcatgtcgaccacacatctgttggtcatgctgctgctgctgttgcacttctgtggttggccaaactctatgtttgcagtcattctatccatgtttgggagtgtgaaggatgatgcattgaaaaccatggatgcaatgtcaatcccagctgtaatatcaagtgggattgctgagaggatacccatggtctgatgctctgcaaccggtgagggtagaggtacagatgcatctggcctgctgttgctgtcaatcatgctgagtgggttgtggcatgaaggaactgttgaaggcaagtagctacttccggtgaactggatggtggaggagatggcatcggtcattactgatgatgtgttatctgaggtatgctgacttctctgtgtggtctgcgagacaggggcagtgtaggcttcatttgtgctggacaagggaggagatacccatgagtgtgagagcgctctttgtgccgtggaattggttttcttgaaaatcctgcagattgcccaggaatcctgctcatgataagaaaaaagaagaataagattagggcagtgttttcaggtaaaaagtgcattcaacttatcttcacaaggaaatggtatatgaaattgttggtgtcatactgaattagctcggaaagcactacatatgctaggccttttgcagtttatattgcaagttttcccattgtaattatgggcagacatgtattgctcagatcatctaccttagtgccagttttggtagctatgcctaagctacttttgtagcatatgtgttaaggtttgaagttttttgttttcaaatgttgcagcatgccagttgcttacatttggtggaatgatcttctcgagtggcttcttctgtggcaatgaagggtcagtgagcgatggcagccggaactcgtgcatcatccagtcagtttgacgcctttagctgctctgcccttgtagaagacaagggacttcttcaagcctatgcactttgatccatcggaggagtagattggcctatcggttccagtggccttccagaaacctgctccagtcaccctgtttggccttgtgctgttccggtacttcctatcccttgggcagtagaaataccattccttctctccagtacttgctaactcttcacggtgaaaaaaggatttgttaagtaaatatgactagaaataagttaaatggtgtctattgtgtaacactgacttaaaacaaaacgtgagctagtcagctaggctaactggtctgactgataaaaggcatatgcatcacatgaaaaataatctatttactatccgcatgcctttttagtcttgagagcccaactgtgatacttgtaaatcaattataccacattaacactactgaaagccaaatctcagaatacatcatgacattaatagcttggtagacttgcaaatcttgctctaaatgttttatgaggcttaaccctaaaactgcatgggcttcgtgatgaatggacattatagtagtagcgcttaagaggcaggttgaaaactcttaggtagttacttttcttatttccttatcaaaacctcagagacaactaaataaagatgcatgcaaaaagtttagagttcgacttcaacatggtggcaaaaagaagaaaaaactattactactaagatacgaagtctcagcatgatggaacatgcaccatgaaagtcataaagtaaaaataggaaacatgatggaacatgcaccatgaaagtcataaagtaaaaataggaaacatataattagtgttatcttgaaagagaaaggcttcatagttctttatttatctgtgcagagaacggaaaaaagaatgaaaatggaagtaacaaatcttacttgggagatcccatggatcatacttgtagatgtccagctgcctgatgagctcaatgggaagagacttctgctggattttccttctaaggtagaatctgacgagctcttcatccgttggatgaaacctgaagccaggtagcatgacttcatcttgcttctctatgtcactactcctcatctcgtccatatcaacacagtacagaaactactggtggatggtaactagctagctcaaacggtgctcactctcacctacttctggttatcaagaccttacgagctaacaaaccctaatggctatacctaaaagattttggtttctgctggttactgaagatagaaaaggaacaattatacataagattacatataactgtagcttcctccagacctgaacaaagctagctcttagcagtacgtgctttcttatcaacaaaagagcgagctatattcttaatctgaactgaaacttgcaagaaaactatgagacagctatcacgtgctgttagaaagaagaagctcgaccttaagtttcagacttcagctaaccctcctcgcttggttgctccctttgtagggtttttatttggcttgtcgttcgcacctttgcctgcactcaggtacagttcttatagcagaattttaaaaccctcacctgttgttgaactcatgcagggtctctttggtctttactccatgacgaggatctcgatgagctgtacaacttcagcagtaattttgggattagcaatctctcttattacactaagttaactgaactgtacttatgcatcattgcttatatagcttagcatctaatctaatagagttctcacatatgcctcatttcttataattagacctttgagagaataatctgactccttagatatttggataattatttttttgtagttgtttccttgggttgtccatagtgaactatgtggaacaattcccaagacatcagagacttccaaattccaagtaagtacagtacagtattatattggaacactaagagcctaattctctctgacaacatctatattttacattggtatcaaaaaatacctatcatcctctaatgatccaaaaatccctttctccattcctttccttttctctcttacctatataattgaagtttactgggaattgttaaacactagcaactgtgtgtctaaaaacatcgcagagaacaatttacatgtttgcttatgttggtcatatttacactctgaggtacattattttaaaattcctccagaaagaaatagagacttttttttatcaacatctctgatttctgttatatggtattaatttaggtcattttctgaagatgtcctttatggtcatgtctggataagttatttatctttctttctcaaagaaaagttatttatctttcatttggaaagatgttaatgtctcttgctgttgtaagcttgcgaatggtcaaacctattataattccaacctaagtcattattttactatctgaatagtgatctattagtcgacgatgaggtgttacagccaagaggtttgtatgtgtaaaggggtgttgagaatttaagaatctgctcatctctagattattatttctctctccttaccgtgcaaagtgctgccaacctaggattgtaattcacactattaactacctttgtcatgtagggacaatgttttgtgcccatctgttcgtcgctattctgagggtccttattttgtcagcccacctggtgtgttcttaggcgcatccctttcttggctattaaccatttaacctgctcagtcagttctagcttcaaggaacggtaacttggcatcctttatgtgttttggttatactgttacacgtctgattttgctagcgtgctaggctgctacagttagttgaaaccagatcaatattttacacactaagttcttgtatggaaataccaagatacaagtatattcataacagtcatagtcatcaagttaccaccatagccacttgccatcacacttttaactaaacgaaaatttcaggcctgcccattcgtgcatatggtgttgcattgggcccatcaacagaacttctacagacattgatgcgaaaatcctgcatggatccaagtgcagccctctcattcgtcccttgcatcaggaaattaaattaggaaaattatgcaacccaaaatcccatgggcccaagttttccttccctgtcgtccaagcacccaacagtgtaagaagcttagaattaaatgagggaagaggtcacttgtagggggtttatagaggggtaattagggtcaaacctctgagttcaaatgctaaaagtcggtccgtggaaacctatgcagttttctattcagatctgaagtgttcataccagttctatttctacgagtattccttcctgcattagtatgatcttgttacaaataactagcggtaaaaatcttgcaaatagatgtgtttttgtgctaatactccctccgtactcgtaaagaaagtcgttttggatagcgacacgatctccaaaacacaactttgacttctcgtttctataaaaatatgtatacttttatgaaagtatttttcaagacaaatctatttatataatttttacattttcaaacttaacaacttaagagttatttatgatttctattcccaaagtttgacttaaacattgttttaaacgattttctttacaagtatggagggagtaccttttaaattattgtgtgctaagcaggtgacatgcactcttgttttacagactttttacggtggagtgttaacatatgtagatacattactaatgcttattgcttcagttgtctgccctttgtagcatggtgtcctggaatggtcgttcgagctggtgactgacctggtgagccaggcgtatctgcctctctcctcgacaggtatggctagttccttgtctcttgcttgcttgacctcgatcttgctgtgcccaatgccaacccactcgtgcggcctccgtttgatgttactactagcaagtgtagtacagtagctagcccctactcgggtgagctgagtcaaacccttccggttcaagttatcctccttctcatgccccttgcaatgcgtggccatgtaataagtttgttagtatccaggatcccatgtttccagggtgcagactccaaatttaattcccttgtacttttgcgcggctaatcgatgtgcttaggccgtgtttgtgcgtgtttacacacgcgcttaaccgcgtggtacgccgagcgtggcacatcggcttttgcccccgtgcacgtgtggtatgggaaagcactctgccctcgaaaggtatagggacagtttcaaaacagctacagcgtagggcgccaataaatagtagtagcagtatgagtgaagaataagcatttatatccaattgttatcgagcaagaaatgctgagattggcgctgcagagctggatgcaggtggcatttcttggagccctgacacccttggtgaaagtctatgttataaatggataggtaaaaatgtgcttgtaatctgtagaccaagttgactttgttggatgatgacaccaaattaacctctggtcgtttaagccttcttcagcttggaatatttaaactggtgaagctccagttttgtcgcttgttttcttctagtcttttgactatattccaagacttaaaccagagttagtacatctgtacatgtctaacataagtcatgctacacgctcccattcccaaactgataaaaccaaagaagacaatgagtgtttcttactccacacttgttctctagaaccacgcgacggaaacacggagtggaaatcaacttgcatcgactaggaacgaggtaaatcacgtccaggagaaaggaaaaaaaaaacagtgatcacgaaacagacacgacgatcaatccgagtagcagcttcccagtttcaccgtttttatcatgtattcatgcatgatggtgcaatggtggaggctagggctgggacttcatggattacttgcaaactaagcgagtgttcctgaaaggtcctgattcacatttctacttgacatgtctatgcagttggttcaggaattctaggtgctgtacttttttgcaaaatttcatgcagtcaaacttccatattactcgactgttcttggtcacaccaccaccacaccagagcccaggtcttgaagagtgttaacatctgaagcccattaaactcattactgtagcaatattgcacagcttaagctcttactaagcaacaaggagaaacatttctcctactgaactgcaaaacagagtctgtaatgctgttccagtgtattgcattgttaattaggagcgcttaatatttttttttgagagaagtacttaatgaaaacagctcaaaaatttcaggcttaatgggctgtcaccacccatctgggccgcaaagagaatcaagtcttcaccgcatatcgttctgattgttgcattcaccgcttcacgggagttcaatcaagtctttcgtgaataataatctaaggtacgtaactggccatcgatatccatcatccatgttttcttgaggggaaaaagttgcctgctttcttttacgtatatctgctaacttttgaaacccataaggatcgatgatgcaagtcactagtgcattgtatccagcacaaaaagtcgctgtgatcatccaaatctaatcgttttatcacatgacaaatttgtcgcaacaggtgataagaacctagttactttagctcgcactactatcacatttcgtgacattgatgttgaattgccatccctcatgaccatccccgctgtcagttactaggattaaacttaaaaaggccaccaggagaacaataattaccaccaaaagaatcctagttcgatatagttcgtcatgtgtcaagcagctgatggagctttttaagggagtcgtggaaatggtgggggttacctgttatagatggatgcgatgcgtaacacaaaagcacctttaggtccgagtcttaggaatcaggcatctgtcgattttactggtgcactataatgcgcgcaggtgattttgccaaatttctttcagttaaaaaatacatcgccacacgtccatccggtaagcagtcccttcaaagttcaaacattcaaggttcgagtcctctttactttccacctcgccaaaactccagtgaaaaaggagatcaaagaaaccgtgtggcgtacatatggttagtgtgccactgtgtcccctgctttgcagagaagatttttagtattatatacaatcccaggatgatagacccagatcgcccacaccaaaggaacgtgaggccgatcgatctccccacccgctgcctgcagcaaaagggccccaaattatttagtgtgattgttctttttattaaaagaagcttatttagtgtgattgtatcacgctcaaaagcgatgcatgatacatttcagtttaatataaacaagcgacgagatgtgcacgagcgcgtagtgcgccagaagctagccagccagccaaatatcccagtcccacgtagccgacgtcgcgtctcgcctccaaagatccgtcaaaagctgccgacggggcgagtatcggatcggtcgagaaaaagatcccgcggatcaaaaggcgcggggcgaccgatcgaacgaccaacacccacccaaccgtgcgcgagtgcgcccgccgcgcggctcgtgtagtcgtgtgtgctcacctcgtccggcaaatcaaccgcgctacgcgacgtacgcgacgcgattgttacgcggatttcgccgtgggtgcggcgtgacgcgcgcgctgccgatcgatcgattgcagcgcgcgccgagccgtacaatagattctctccctcacgcagtcacgcgcgcggttgatcgagcaggcagccgtccgtgaccgtgagatgcatggggtggggtcgggttgggggtacgtcgagatgagcgcgacggcgagcactagcgggcgaggtggtgtgcgtctttcggcgtagtggcggggtgggccggggtgtcagtagtggtcggcgacggtgaggtggcgccgggtggcgggtcgatcgctcgctcgccctgatatatggaaggtaaagatcggcatcaccgagacgccgtccgccgaccggttgaaagcacaccgagactgtgtagcactatgcatgcatgtgaaatgtgataagctaaaggcggtgaggcaaggatgcgtgcttggttttgcaggtgctcactgattgggcgcgcctgaccctgcatgaccgttcagtagagagttgtgcggcgtgcatctgtcgctgattcgacatgtcacgatggccatgcatgcagagaagattcaggagacgctacctagctaccgcttgtcattgtaccgaagacttatttcagtttcagtgcgacttgtgaagttgtgatgcatcggtgatcagtcgtatctatcagtgtgtgaatatgtggctgcatgcatgctcatttgtcatctagtgtgatcgatcaatatcattcagtctcgtggttgtaggcaggtcgatcagttctagaatgtggaggaactgatccgcgtgagtgcgcgtgcttgtccctgatcaggtttgcttttctcgcaaatccagcacccgatcgacgtgatacagttcgattctgcgtgcgtgcgtgcctgtctgcttgcactaaacgcagtatgctgggacgatgtacgcggtgcacgttactgaaagttttattgataagtccgtgtattataacgggttacacccatatataattggggaatggtggagaaagtagattgagacctatatatgattggtgattggctggttaggtggattgaggataaaacacatgacattgtcgtggtagagaaaaaaagtgatagtattaactaacaggttacaaccatacaatgcactttcaaataaatatgtaacacatattactcgcaaatttcaaccaaaacaccaatgaaacatacccacttttgcttcttttttatccctggtttcttctagctatatatatgaagaacaaggaagtggctatataaaattctcttctcttgcaaagcctacatctctagggctcattctagattcttattgcacgacaccagaatatgcttctttctgtccagcagcnnnnnnnnnnnnnnnnnnnnnnnngaccgacggacatatgttcaagccgaccgtgcatggccggcgggtcccggcgccggacgcacgcaaagtcgagcaattaacggccacagcttcatcttacactgatggccgggaggccatccacgacgacatgcggcagcaacagcagacctgacgatcaagcagccattgggcgactgttttgatatgctccggggaccactgcacccatggcgatgcatcggtcgaataacagcgactcctccgggtgattttcagctcccaatgcaagctcgatcgtcctgcgctgtgaggccatgcatgatagcgaaaatggctgtggagcaataggcggcatgctaggctttactggcatgattgtagtactgtattctcatctatcccaagttggttccgcgcgaagaatgtcgtcgccgcccttaattgtgtggaagtgtggtcatcgttgtctcttattccatatatgttcatgggtggcactagctagtagtgataacagtagccagtgttgaacgatcactgtatggtacattggtacagatagcttggtctgtcagctaggtgttttaattggtgcttggcggtggtggagaggaaaaaaaaatcttatgagaccaggtcctatttagactctcaggatatgtttgttcgaaaaaaatatgtagtataaatcacatatgtaatccagtgatcgatctacctccaatatgtttattcgtgaaataaagttttctatttctttctttggtgggaacagaactccatttcactgttggagaaagggtttttaattccggtttataactccatttaatttacccctttatactgaatattgtacatcctaaactctttgaattagagttatttgtttgttagaagagttgaagaaaaaaaaagactggtgtagcatctgaggaggttaattgaacgtaggcagacggtgcaaggaagattaatgtttttcttaattgttcggctggtagtagtattttatacgttggcacgctgttagaaaatggttcagggaacacatcacaaaatcttcttgcgtgagtgagaaacagccttacatagttacatcatcgaattgatggacttcttttgttgattgttgcactggttgcgtcatcatgattgtatattgttgtcttacgaaatgacgtggagcccaccatatgaatttgtgagcctgatcacttgttagagtgaggtaatgattatttagattgcactgcaaatatcatccgcggctcgccgattccaaaatccagaccggggattttctttcgttctatcttttctagagaaagttagtgatccaccgtttccgccgagtcatacaagcagattattattatggattatctatttaatatgagtatatatattaaatatcttgatagttaacaaataacttaaaacaactagtttaaataattagaaattttacgatccttgagagatatcaaaaagtaccagaggcactaaaattttttagtgcagatttttgtatcttctaggatcgaaagtaccgagagatattaaaatttatattagaaaatacggtatctctcgatagcttcgcaagtactataaaatcactcctaaacaataccatagaagttgctttataaaatgtattttttttggaatgtgaagtaaatagtctatttcaatgtacaacctgttaaataattaaaaaaaactaagccttaattaattggcatgtggatgaaaatgactatacgagtacagaatcattagatagctagatatactaaatttaggcacgggaactaaattgcacatatccaagcaaaaggagaaaatgatgaaaaggtagaggagcaaagcacatagtatatgcttgtgctatctattacggatgtagtagtatataagaataagcacgcactttaatccgtttagattagataagaacaatggacagcaccaattattctctttttgctggttttgatcgagcaatctaaaaaaactcgaaagctacagctgaggaccaccttgaagtgataaaaaatgattcattcagtgtctcatacatttcgttagataatatagtttcatgcaaatgttaaaattcaaacctatcaacacgcgcacaatccctatctgcttctatgttatattagttacttaagggaccaccatacactgttatgattttctttaagcttttcacaattatttgcattatatttcactactccacaacatcaaataggatgttgaagagaatatgggagggtaaaatctttataaatttctaaccttataatttgctttacgattcatgctccagtgaacgatgaacctaactccacaactttggtgatcagcaatggcctcatgagtcagggtttagggtatgggttagtgttggggtgagaggaggagataggggggggattgtcgggtttagaggggaggccatgggagatggtggacggtggacacaggcggatgacaacatcggagccaagggaatagaggagggcagtgagccagcattgacctttttttttatatataattagcagcagggagcttccagagacaaggaagacggttggggtaggggcactgtaacgacccgcctctcccaggccggcggatgacaacatcggagccaagggaatagaggagggcagtgagccagcattgaccttttttttatatataattagcagcaggttgcttctagagacgaggaagatggttggggtaggggcactgtaacgacccgcctctcccaggccgggcccacttacatttggcagctttcataggtcatagactgtcctcacataccaacacatgtcttttctgcacattttgtcctcactcgtgtgcacccgggaagaatttcccggttccaggccaagcacgcttaaccctggagttatttggagattggcttccggaaaagaagttgcaacttgttgatatgaatattctattaatcctattaaaccctaggccgggatgttacaggcacttaccgccgccagcttaggaaagagggggcatgggaagggaggaggccagccgactaaggagatgaggggtggcgcgggggggggggggggttgacaccttctggtctgccgagatggcaattaggaggcgagggagcatctgcacgcaatattacggtggtaggagaggctggggaggggatgttgcacaacttcaaaatgattcaacggtttagaattcacaatatttttaggctgtgttcgggaggtgaggttcacctcccgcgtacgcaaaacgtagcgacacattttcttataaataattaagtatttactaattttaaaaaaatatattaaaataatttttaaagtaactttcgtatataaaatttttgtaaaaaacacaccatttagtagtttgaaaaacgagcgcgtggaaaacgagatatgtgagttgtgaaagttgaaaaaagaactcagccttatatatgtattctgtcaaatgccatgtagatagttgaagaaaatggggtgccgaccaatttaccgggaagtacactctgtgtcgataaaaaaaaaaaatctgcaccgactgccgacaattttgagaagtacgccataaaagtgaagttgataaatctaggcagctaggctctaaatgattactccaagcaagcagttcattaattagagcatgaaaaaaaagcagtaaatgtgtcattttaagcttcgccgtatagctttttcttgacgtggagaagaggagaagagaaaactaaggtgccatatcccatgaaaacacactgttttagtgctgtttgtacggttttctcaacaagtgttcatgcccgcgacaggggccgatatcatgacaatactctttccagtgccccacggtattgttcaggtcaaccaagctctatcgatcattagcgacatcatcagttaatcattgacggaatgataacgcacatgcaagacatgcaacccccacaacaatatataaagtcgcagatgttttatataggggagagaacgtgacatccttttaattactttgggggtgaattgaagtggaacaagcaactgctggagagatagtacacctggcacacacgcacaatttgacggcagagactgatgcacaagcggcacacgcacacgcccaaaattagcaggctccagccccggaattaacagagcgagcaatctacgtaccccacacgaaccaccaagcaaccaaagctagcgccactcccccgtgcacgcgcgcgcgttttatgtaactctctccggcgtgtacgaagcagcagtgacacgacacaaaacacacacaaagacgtagctagtgatgacgagaccgagatcgactggtaattttccgagtaagaggacacgatcgacgacatctcgtcgtcctatcacacttggatgttctccatctcgtcgacgtcgtcggcggcgatggactgctggctccgcaagcggcgcagcttgaaggaggagagcttctgggaggagccttccttgggggtgtcctcgaagcggatgaaggtgtaggtccatgctcccgagagcgtgcccatgactgggcccaggaagtagatccacaggccgtcgaacttgttgctcgccagcgccggccccagcgtccttgccgggttcatcgatccacctgaaattgccctgcaaccaccactcgtttttcgctgcgtctcagtctccattgtatattctgctcaactagtttagtttctacgttctgcctgatcaatatgtatgtttccctacatttattaatttggttactgatcgatcaaagataatgttgattagccaggttagtttgacttttcccccccccccctctcacttgtcaggagtcaagtggctacaaattaactaattggtcttgctactagctccaagttaattacttcctaattagctagtactaatcttcttggtcatgaacatgaatgaacgaattgaatagctgattgattaacgggccgtcgatttctagcgtatttaccctgcgaagatggacgtaatgcaaaccgcggaaccaaccgccaacccggccaactcacccacctgcatatggaaaaaaacaccggtcaagagtccatgtattttacggcaaaattcagtcatcatcgatcgacgacaaggaggtgaaagccgtggacgacgcgtaccgctctcgtgtccgtggcgacggcgagcgtgacgaacatcatgttgaacgtcacgatgacctcgacgacgagcgagtgccagtgcggccccacgggcgtggtggttccgatcacatccaccgggtggatcaccgccttgagcacgaacgacgcgcatatcgctccggtgaactgcgccgcccagtagaacggaacctgtgtaagggagaaaaaaaataggttgaaaagatgtttcatttcaacgctttaaccctgcacctctagctggagatcgatctagagcagtcgcagtagtatctaactgcacattgcgagatgtctctgttgaagccgggaacatcgaatcggttccggtcagcctcaccggtgtgtgtgctagtgaatatatagatagatatatagcactatagcagatagcggcaactagcttagccccggattcggtgccgatcgatcggacgacggcgccacaggcgatcgatttccggcggatccctatcgatcgaccgaatatatggcacatgaaccaccacgcacgccaccgcctttacatgaattcttgcgtcgcgaccggttctcctgtactgtatcgctacggacacttgtccctgctagctttacgtgcagtggcaacaaaaaagcctcgaccacgatcatactcttgtcttctactagcagcagcagcagaagtgccctgtggattgcgatgtaaaaatagactatatggaatgtgatccgtggcaactaactcagcgtatcccagcttagtggcttcatctttaatttggctgtgctggggttttgacgcgtgattgctcgtgttcaattagcacgagcctgaattgtttgtggcggtttcatgctagatttcagatgtctgattttttgattgatgtgagcttaattaatctggtgatcgatcgatcacatgctactgcccaacgtgttgtctggctgtactattgtttgtgtgttgctgatatggagtggttgcttgctttcaggctccagctagctagacaaatgtgtagtgaaaaggacctatggattaaggtcgatatatgttgttgacagaagagacgacattaattccttatacaatgcggatgtgtgcatcattatggtatatataagtttaatgaccttgaaagatatgtgattggttggttcggataacaagttacatgagcatataccacctctcgttgccttttgactttctttctggccggcgacataagctagactgaataatttggcatatatgcctaaaatagagatttaatttggcagaatcaaatccatggcaacatcttgacaagaacgcgtgaataaactaagtacttaagtgaggactaaattagccaatgattttgctctcttgagatttaaaaagtttttcagataatgaagagggttgcgtcaaaaattaaaaaaatggagaggatcaaagctgacgaaactctgaaaattgtagctatcggaggtaaatttaacaagattcagataccatcatatgtaaaaagacaaccggaacaagctaaggtcgtttcagaaaaaattcttatgtgactactaatattcaatcagcactcaattggttaggtgtctctgctaacatcttttggcaaagaacagattgaaagaaactaagaaagcatctagctagtatgccgaagtagtgcatggcttaagtcgtacacatagctaactattatattgcatatatattttgatgcaagaagtaatatatatgaagaattggcagtttgaggtagctgtgttgctgcatctgcatacctgaatccaggggaaatgcctgaacacggcgaacgcgagcgtcacggcggggttcatgtgggcgccggagatgtggccgacggcgtagatcatcaccgtcacgatgaggccaccggcgatcgactgtcccagctgcgatatgcgagacaggtcgctgccgctgatccctgccgccccacacgtcatgaacaccagcaggaacgtggccaccacctccgacacgacctgcagccatggcgatccaagcagcgtgcacgcattagctcccccccagctcaatcgatctcgaatcaatcaagcaaccagagaaagacagataaagctctgaaagtctgaagaattaatcattcagctccagactcctcaccttcttgaggaggtgaggagggaagaagtcggcgatggccttctcgccgtagtacatggtaggcatggtgccgttctgcaccgtggagagatcgtggatctcgttggagtagttcgccctggagtttgttctcgagttgttgctggccatttctgacgctctatctagctgagctacttgtgcagcacgcgagtgcaggaggtagaagaagaacaagcagctcaagctctaacactggctggctagctcgctcgctccgtcgatcgcttgctcgttgtggtaatgagcaggagtatttatagggagatcgagctagctaaggttgagaagcctgagcaactgggaggtggcaggtactagtagttacagtcctcactgccttttgattaggcaggcctacttgtcggagcaccactgggtacagtgcttgcatgcatagctcattagccctaattaatcagcataagatcattgtttctggtctaatttttcgacggggattcagattttgtttaatccgttcaaacacgttgtcggatcagcattggccgagaaacagaaacgcatacttgattttgtattctcgtcgagggcataaaaccgcgcgtcatccccccgtgaacgacaacgagagcaacgttgcctctgtctgctgttagactgaaataattgtgggttttcaattcacaaggtgttgtaaactatatgcctggataaagcgcgacgtcgaggtcatgacgccgatatatgggtgacgaacaaattctttttcttttgtagattgggggctcccctgaaagaaatgatactatagggatggatatttttggtcattctacgtacgttttccatgccgaatgttaatacgttttttttgcgaaattcgtcacctgttgtaagttgacatttttcataatctatactcgtagaagagacgaaccatgtgtgccaatgccaactaggataaaccgtaccgaaatttactattggccgaatttgccattgtccctgtcagaggttgccgccattgccagattaatgatggatccgtggcaactgaacaaattttcaattgtaggattgccatctctggtgaccaaattgaaatatccgagcagttaaggatttgcaaaggtgacattacaataaggggttatcctaaccactctattacgcagtgtgcatgcttcggttagcaatgctaagcaatgtcagagcagaggacgttgcacttggatggtcactgtcaaaactgacctgctactattgaaaaatctcatgtcagttggagtacttcagcaatttgcaatcctagcttctctcattgagcttagctcacattcagtttttctttttttgccgtactgtacctgtaggatactccctccagttcgaaatgtttgacaccgttgactttttagcacatgtttaactgttcgtcttattcaaaaacttttgtgagatatgtaaaattatatgtctacataaaaatatatttaataatgaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaagaatgaaagaacccatattttgatcggtacagctcgttgcagatcagccactcgacttggtgaaaatctcaggccttacagagtttgctaggtatttcgttcacgaggtgtttcaatcaggtttctttcgcaaaaatgcagataatttattgatttgagatgccttctgtaatgagcactcatcaatactttgtagatgtatacatgtagaatcaagaactactttacgagcaaagcaaattaaatgaaaataaatggatattggtactgaaaaataccactaaatacacacatgtgcaaacagagagcgctttctggggcacgtttagaaccagcaccttattttgcacgatctacaggatgaaaagacagcttgtgctgcctgagatgagactagcgcattggcatgaggccaggccacaagagggaaaatccacgcttctctgcaaccccttagcttttcatgagaggcatggaaccaagatagctgacgagtgagcgatcagatcagtgaatcaatcacagatgcaccatccatccagaagctggcataattaccttcgctgattattgatcttcttttgtctgcgctcctcaggccactagtgtagttcttgttaatcacttttgtgtgtatgaatctaactacatttcctggcataatgctaggccctaccctgtgatcaagcagtagcaaaagcaccccatgttgaggtcaggtgtaccatccgatatctgctaagttgatatggtgccctgaaccattctctgaagaagcatcgtttagattcagaataaccatggttttactttgcacaagtctagctaatactgtaggtaggttccctgatgcatctgcaatggcgcgcgcctgacctcagaacttgaatcagttattcctatatggcaatcaatcatgtctgtcttcccatcgaatcacctccgttttcacggccttaacaaaagatctgaggaccatatatgttctcgattgttgtcgaaggttctagatcgattcaccactgtcaaaccaagcaattacgtatggaactatgaaacatatcggattttgacgaataatgattacacatatttttaattcttttctcctatattattatgtttcgaaatcagagcagataatgtatggattcatatgtagatattgattgttctggaatcagacagaaaaagacggactcatagtatgtcttctaatttatcagccgtgaccaaaatttaaattttaaaacataattgtagtgttgaacttaagtttcttacttggaatttattttcaatattgacttataaaccgctaagaatacggatataaaaattttacctgtaaattactttttattgggaaagaacatgtaacctagcagttacagtgataagtagcacatctaggttttgagttcgacaccccaagagagtgaattttaagcctaattaaaaaaaatcacttgttggccctgtaagatcgaacaacgagaactaagattaccaaacagagagaggggagggggaggggggttgaatggtagcaacaccaaacacttttagcggaattaaaagttacaccagtgttagatctttggtctgactgtacaagcctcattggtctgaccgcgcaatcaagccaccgcctcttgttgacacctccggtccaaccgccatagatccgattgtatgaccgagtagttgccgttggtctgaccgtcggtattcttccggtgtgactgttgtactccgagcaaatcacaaatcgaaaaccctcaaaagtagattaaagtttatttgcatatattcgtgtttacaaagtgcaataacaacacttctcttatagaattggactaaactcgaaaccctaacttttctttaaacttaacttacacataatcgatcacaagaggcctcaatcccctctctatttatacccgagataagcagcctaaaaccatgaatctaacttgtgcaatatatcctaatccactaggaaacatttctcgtacctaaaataaacttatctctttccaattcaaattccaatcttcctaaatttaaatcgactccttattccatatgtacacaatctcccatcgtatgcctcatggaatctccatcaaccacgtgcattgttttttagcctaagcatctcgcatgatatcccaatcgcccggatgtcatcttctcccaagttgattcctgaccatcatcggcaacgctctcccgatgcatcaaagcacacctacacaggaatcaaacgaagaaacatatctgagcataagttctttctcaactttactcaacattattacacatgtatagaattcatatataagtcataatcacgaataaacaaataaaaaacccgaaaccaacatcgacataaagttggccggtcatgctgtcgttttggccagtttgacagtgcacaccacgccagtatgaccagcttatcctgcccggtctaactggctccacacaaagagcaaaactacttcactaataatcttcaaatatcgaaatcaattatctcatatgccaattgttcatcataaaataacaatcaaaacacactttgatttcacatgcccctcataaaaatgtgttaagaatcaacctatggagcgtgggcctcgtataggaagcatgggcctcaaagaatgagttaaggaacgatccatatgaatgagtttgcgtgtgtgtgtggggggggtgagggtttgtggcttttctcggttggtttgatggagccttcttcttaatgaaaaccatcggacacttattttctcactggtcaagtttttttaattatttttcgttgtttcgtttatttttctacagtttattagctatggagtaaactatgaggttgagagctaggttactcggttaaattagacagaccaccggaaagccatcaaatttcaaaaagtgttattaatgaatgagggtacaaacggtagaaatgacatgagccattacaatttttacggtggtctatactgatgatagaaaatacaccactaatgtagcaaaccatacagctgttacttatctacagatcgaacattcattaattttggcatcaaaccaaactttcagctctaaccaaacttacactaagctttgatggtactaaaattttggcaaaatatcagacctaaccagccttttaccaaaactttggcatggtccaaatattgacattgttaaaatctattatatactaaaagtccattaaactttctacaaacgctctcaagttatcacgtggcgctctaataaattagagaaaatcctagaaattctaaaaaaaaagcaaaacatctacctcttgattttcacttaaattgatgggtccaatattatacaccattagataaaattgatcttaaaacaaaccaaataatatgggtcccacctctcctatttctcccgcgtgcataagtataggtcacgtacgtacatgtgggcctgtagtacgtacgcctccctccatttttttcttttttttcttcttttttccatttatacaatttgatatatatttgtttaaataatcatattttttttaaaaaaagaaaaaacatcatataactctttataaacacaggtaattaactaaattagctatacagactttgaaaataaaatttacaccatattatatgtaaattagctctaaaatcaatagtgtaagataatttactttgtactattattttcatataatgcactattttaaaataaagcttacacaatattatattgtgtacctatcaaataaacaatttaagatctaaattaactaatatatatatatatgtgtacttaaacagatagacccattatttaaatcatcggatctatttttttattactttggactattattctcaaataatgcattgttttaaaataaaatctacaccattaccattatgttgtgtacccattaaattgacaatttaatatatatatatatatatatatatatatatatatatatatatatatatatatatatatataaactaatttacatttgcactaaaaccggtggacccattatttaaatcatcggatctattgttaataatgtctaaagttctctttttggcccactgcacaatgcacgtctgcacctctacctttcgcacatgtgacaaagtgtcgtatttgaggcatcttgggtgatcacgaccgctgcagcgctaccacttttgttaatagcatgaaaaaaatattaaaggtgtgatgcagcgagagaagaattaagtaccgtggaacacttaactctgtttaagatgaaatcgagagtttattaaataataattataatatattgtgttatgttgtatttggattttgtattatttgttcgtacagttgaaagaaatcattatgttataattgtgaacacaatattaacgaatatcaatagaactcttactaggataagagtgttataagggagtttaaggccctattttttccctgattccatcttttgaattttcatttgcacgctccatgctttccaagttactaaatggtgcttttattaaacaactttttaactttttagaagtcaattcattcgtttataatctcaaatagctatcacataaataagataattcatcaatttcagttatcctaacctctaaagtacatattttttttcatgcgagtcatggtgataagtaaattggtgatcaacgcataatcaaaatcgtatgatgaatctgtaagaactactatgaccaattgtaaataggtgtcaaaattaattgctattaattaaacatctaatggcttgctagcgacatatttaatttttctctacatatatataaacatggacgaagctagaacgaatattaacatacatcccatacatatatattacatgttaatattctaattacatgtggtaagtccattaaaatttcttaaaatgccctcaagatgacacgtggtgctctaataaattagagaaaatattagaaattctaagaaaaaaaaaagcaaagtatctattacttgattttcacttgaatcgatgggtccaatagtttataaactattagattaaattgatattagaataaactaaatactacgaggtcccacctctccacctttggtacgcacctactcccctccctttttttattttttcatttcttcttttctccatgaatatgcttccctccctttcttactatatcatgcaccttcatgagacgatttaatctatttactcaagaaaaaaatatatttcaaaagttgtaagtacttaatccatctcccactcaaagtttgtaaatggatttttaagatatcttaacaaaaaatcgaacccttaaattattataaaataacaatatccgaactttagtttgcccttaattatgagatattttttttaacaaacaataaaaatcttacctttcaataatataagtgcccgcgcgtatgcgcgggccaccttcctagttttgataaaggttgcatcagtaataaaccaaacaagcgctttggtggttctacatgatcaaaagcagtactaccaaacagggcctttaacctcaaaatcactgtaactttaactgctctatccagtaatgatagtagaagcatggatgtatcactacatgattcattcatttgagcaaagccgacatgagaagaccagcaatccagcatttgatcgtggtcgtctgatggttgaaaaggcatttgtatcgacttatgctagcccctatcaaggttggttatccgtcagcgtgatcgttgattttgcacggaaaacaacaggaaaacataaggtctactggaacactacgagagtctacgatacggacgaactgaagggcccttgcgtttgacgccgggtttaggtcgccttggctccgttgatgtcaccgtttgggcgtccgtgtaggaggggccagccaagtactgcactgattagttcttgatcactctgctggccagtaatctctcttcatcttaggtcggcttggctactagtagttgaggagtaaggccctgccttttgtagctggcacacgcttgaaactgttgacaatttttgctccatcgaacatcaggttcagactttcagtcatcgttttcgatccccttgcttgttgcagcaatttcattcagagaaagcatgtgtgtcaatggacactcttcagctgcaagaatcaataatgtacttccttagagtaagtttaataacggagccaactataagcttatagtttatattaaagttaacatatatagtaagtgagctacaaggttatctctttttttttctcctcctctctctatctctcacctatgcatttaatgtatttatcttgaagtatgtgaattgctagctcttgtattagagccaatcctctctaattttcaaattctctttcatccacataagcttatagttggcttatagcctactagtatacttgctcttagtattagggtattcccaacccaatgactaggatggtgtccatagcattaaataagttaccacttaggataaaaaatgatgtggcaagtgaataaatgaggaaagagaaggaaaccatatcttgcatgggacatggttttctacacaacatccaagacatcatgtgagataaatagcattaaattggagtatggaatagtggtgtttgcattggaagagtagtatctaggactagtttcttgatgatgtggagtttatggaaactatgtctagtgttatgggttgggactgcccttactgcttctaaatgagacttgtgactgctggtctcctttgatttacttccttacttgcatgagatttttttcatgtgttattgacgtactacctccgtcccaaaataagtacagccgtgaatatccgtgcccaacgtttgaccgtccgtattatttaaaaaatttgtgaaaaatttaaaaatatttagtcacacataaagtgctattcatgttttatcatctaatagcaataaaaatactaatcataaaaaaatttcaaataagatgaatggtcaaacgttgaacgtgaatagtgcaaaactatacttattttgggacggagggagtactgaagtactggaacaaatatctgatgatgttccaatctttctttagttattgcaccggtaaaagattgcaataagaaactggagttagtacgcactttaggctaccctgaagaattttttgcatggtggttagtttattgaaggtgtggtgtcatccttgcgtgtagagattatcacattgtctaatcaagaagagccaggagctaagctaatctagctcggccgcgaacacgacagcaagttatcttgaaggaatcagtcagttgactaagcaggctctcgctctctccagtccagaaaagcttcggcatttagaatcccctgtttgcaacaggcgacaaggcaactttcatatggcaccaaacatgtcggtaacagctgatgaaaccgtctaatttatctgctaatctcgctgttttttcccttgtcaggatggctcacaagtggaccaagttgtagaatgttgcaaaacccgttgtttatcatggccacattcggctagcgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgaggccgtaattgaaagtcttttctgaagaaaatgggaataaagatgaggatttgatacagtaaaaggctgtttggggcgaattgggctatcggctcagtaggattgcttagttgatctaacctccatatgggctgacgctgatcatgggctttacatgggcgagttgccatggcccatgggctgtcttgcgcggaagaggcgtgcgtggcagttgatggcggtgtcgccgtgagagaacggagaagcggagaaaccgacccgtctccgcctcatccaccgctccgccacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggtcgcctcccccgtcgagcacctgctgtctcggttcgaggtttcttgtgtgcgtactgcgtagctaacatcacttcctgcctactcattttaggatttgagcggcggggcgctcgtgccggtcgaggggcctgaggcgccattgtttgcgcttgaggtgagcggtattagtatatgaaaatcttagggcatccatttgctttgagaagctttgggctatgcaacataatcatttagattgtaatgaagtgttagcatatgaacatcgtagagaacatccattttgctttgagaaactttgagctatgcaatataatcatttagcttctacagtaataagctgaaaacctctacctgtgaaattctaggatttgtttggaatcagaatgatttaatttagatcaaccttctgattgacttactctagatcaatatagatagtgcttgagtgtggcatattcgagttttaatgcagataaatcctgagaaagcccgagaagagtttcgtgcagcaagtcagaagaatggagggactggggtaaaggacttcatggatggcatgggactgggagtgcttgctgagcaggtgcaaggctgcatatctgtttactgtcgctctctgtatttcatcacctcccattatgtctgaatgttgtggtccttgtgttcgtgaatttgcctgaattgctttgtttaactttggtattaccatcttattccatatagctgggggagttaaaactgggggagttattggacacaccaccaccaggattggatgaagcaatagcgatttcaaaggtgagaaaaagcaggtcatgggctttacctggttcatcttgttgttcttcttctagcatgtgactcctacttgcatccaggttatgcaattccttgaagcacaagagtatagcatgtttagacgcattgtttttgacactgctccaacggtaactatcctatatatgtgaatccacaattgactccatacgcacattcacattattacctatgatttgtctccctcatcaacagggccatacactccgtttattatccttgccagatttcctggatgcatctattgggaagatcttgaaggtattatttgcttgattgcttctgcaccttttgctatcatgctacgatgtaaggcctgcagtacatacataattgatgaagaaaatgtgtattatcttgtgtaactattatcctgcctatcgtcacacaaaacaaagtcattttagaatgtgtgtagtcaacacaagttaactttgaccataaatatcacttaaaatataggttttggggctatgaaaaatgatatatttaagtttgccataacaagagatttcataatactacacttatgtaaccttcttttaaaaaaaatgctaaagaactaggtagtcaaagttgtataatggtgaccagagagagtagccactacaatcttgttatttttgtggctaaatggtagcgggaagcttattgcatttctgctattattcatttgtgttcgtttgcgcagcttcagattgtgctttttttttgttaacttgtgaaattggaaggctgcctatcttgttgaatatttatctgctcaaatacattgtttacatctttttcatcagagttttttagacacttgttagaagaaaccgcttatccttgttctgcttcatatgatgaaatatcatgtctctggaatttaataaggaattaatgcaaagttattcttcaagtcctgttaccaagagctaggcattccatctaagttgtggtttgtcatactgatttatcatctttttttttccagcttaggagcaagatcgcttctgcaacatcagctattaaatcagtttttggacaagaagttcaacagcaggatgcagtaagtatttgcctaaaattcctctgaacttggtgtttcttcaccatgtctttaaacctttgaatttgttattctcccccttaaggcaaacaaattggagcagctgagagaaaggatggtccaagtgcgagaactttttcgtgacacagaatcaactgaatttataattgtgactattccaacagtaaagattctgtgtatccattcccccaccaccttctgtatgtatttatcagtgtaatagccatctttatatttccttttggcatttttcaggtgatggcaataagtgaatcagcaagactacattcttccctaagaaatgaaagtgttcccgttaagagactcattgttaaccaaattctaccaccttcgtcatcagactgtaaattctgtgctataaaaagaaaggtagagttcataatctgccgaaatgattctctagtaattgtctgctgcttgtagaaactgtgttgcagggccatttaccatcttctttcatccaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctaggaaaaactatcctacggggtaagtttttcaaacagaggtaggggtagtatacacaatggacgttgcagtactgataaaccagtgactggggtagtaatcttcctttctgtctttcgtagtactacaagacggttgaagatcttttccatcctatcgagatgtactactccacttctgttctgtgcaggttgaatatatgtggcccaatcacatcttgccactaaaaatcttacatttatccatatactccacgaacagtagattttactcatccctgattagacccaaaacaatcatgagcacggtagacaacacaagcttagggcgtcttgcacgattaggtattgttcggtttagaggggattgaagaggattagaggggactgaggggtaataatttcacaccataataggtattgaataaatcccctctaatcccttcctcatgagaattaaccgaacaagcccttaccccgctacacccaaaaatgtttccgctggggtgcaatactgctatcgatggcttcttacgtaggaatttcatttttctaatattttttcattaaaaattgtacaaatatgacaaatctcttttataaaacaaaggtttctatagaaattatgcgagcacatatgttcacatatacacatatttcatatttatgactaattatttttttcaacgacaccgacaaatccgtcaataggctttatttttctttcacaaagcccgtaaacttccataggagcctactacatcagtggcttcgtgccgcactaacgaggcatctatagtgattgactttatcatgtaaaatatgacagccaaatattttgatgggaggtgttcatggttatatgtacgtttatactccgtatgagtgagtagcactccctccgttctgagatatttactagtactacgaatctggaaatactctttattcagattc

SEQ ID NO: 57678 - DNA, 1447 bp, Oryza sativa
aaaaaaactaatgttaattaatcacgtgctaatgtactgctccgttcccgttttacgtgcgcaaaaaatatgttcccaccaaggtggaacgaacacatcctaaatcatagggaaaatggaatgaagtctagtggaatatcgaggattttagatatgggtaaccaacttacataatttttttaaataccccaaatataacaagccgatattccatagaaatataaaactgatcaaacgcgcatcatgatatattaataatgtttttcccccgtttcccaagagtttttttccttttttacatacatgggcttttggggtatgtatttctttccgtttcatgttataagacgctttgatttttttctagtcaaacattttaagtttataaaagattcagcaacattttcgacacaaaagagtgttataagatgctttgacttttttctagtcaaacattttaagtttataaaaagatgtatcaacatttcaacacaaaagagacatactatcaaaatatattcaatgaaactaatttggtgctgtggatatttctaaattttctataaacttggttaaactaaaagatttgttactatggaaaaatgtcttatcgaagggagtactttgcaaaattatgagaagactggtcatctcccggagctaattcttttatattttagccctttaaaaaatttattttacaaataaatctctggaaaaacttaacaaacgacactagcatcgaggacccatatgtaactagaattctaaaaagggttaaaatgtaaatgttttataaaaataagcccccaacactagaggggagccctaatgggcgattgatcgcccgctaatgggggtcttgatacgagccgatccgagccacgaatttccagctttttgtccacccttaggcggctcctcacggggtcggcgcatgttacggcggcaggaggcggcgacaccctacgcggtttctgaggcaggaggctgtgtttcttgcggggccggtggctcagagcttctgcatgaggaccaagaggtggctgttcatctgtagaagggcagctagagagggcccaatgaaggagagaaatcgatctgattcctttgaccgctcggcttgactggttttttcaaccaaaaataaaaccgaaccggtttttttggagaaaaaaggggttggttattgtccggctggtgactgtgcaagtttagtcagggggtcaattaaatcagggtagatcaatttaatcagggcgacagctgatcaagttgattatcgttgatggcagcgacggcggtttccaaatttgaggtggtgaagtttccatggcactaggaattttcatctctcgcacatgatgctaaaggatctgttggctcacacagggatatccaatgctcttgatgaacaatgccggaaaagaaggatcatgacaagtgg

SEQ ID NO: 57679 - DNA, 1807 bp, Oryza sativa
ctcacagttgttgttctcaagttccttagtcagcatctgaatctcatgagcttgttctactacagaacggtcatcgaccatcttgtagtcataaaactgctccatgacatacagctcactgccggcgtcggaaactccgaacttggcctcaagtgcatcccacatgtccttcccgaaaggcatgtgcatgtacacgtccactatattgtcagcgagtacactgatcaatgctccacggaacaggcaatccgaagccttgaatttagcctcttcctcaggagaaagaggtggttcacttcgtttgccccgtgaaacatagaagcattgcatcgctgtcaaccacaatagtgcacgtgctttccacctcttatagttagaaccatcaaaagcatgtggtttcagtgcagcagcaaagccactaccgaaaatgacctatcaggtttttggattgttggaaatatggtcatatatcagcatattttaatccaaaatattaagacaataatcataatcatggcatgaacaatgtggggtgatctagtgacaacttatagcataaccagtaacatgcttaaggtatcatgagcatcatgcacatacccataccaaggacgcaattgacttgcgactagcatgactaacagcggtatgaacaaatgaattaacaacaggagaaggacataccccgagaatggccctccgctgaattgtgaggcagaattgcctctgttggtgttgacgttcgcaacggctccggctcctggcgcgtcatctccagaggcagcagcggcgccggcggcagctccggctccaggcgcagacatggtggatgaactgagcagtcgtgcgggaagcactccccaaaaacctgatcacccgcctacccggtgcatatctcaggcgaaggtgtggttctagaggcctgcaccttccgatctctcgtgcgcgcaagtgatcagaagcgaggaagcgagacagcacaggcgcgcgcggaggaggaagaacaccagggagaaaagcaagcgaatcgttctgatcggactagcggcctccttagatagcaggagagatcccgccagttgcaacacacgcgtcgtggaatcgtgggatcgtgcacgcaccgttacggaggcagtcgtgggaacgtgggatcgtgattgcaaaagaatagagacgtgacgtgacgcacgcccgccagccacgccttgccttgttctcggccgggccggcgcgcgcgcgcgtagctttccgactcccacctcaaccggtcaatagggagcctccaataactccctatttaggttgagatactcctcgcttaaattctgaggtggtattattatccttaacacttattatgggcctttgagattttaatagaataaatcgggtctagcccaattattctaacaatccccaccaaatttcaaggctcagaagaaatgttctcaaggttgtgcctgtttgatatagcagtgttttggtggagactgttaagttgaacttccacctagaaaatgagctacatcagaccacaactgaacaatggactatgccttgaattgtcagtcttgtgtgatcaggtttcactcaaacccttatctggtattgggctgccgttcgcatcccctctgtttggagcatataagtcaaactccaggcctttaataagtatttagagatcgcccaaacctcatagattgtgactagcagtcgaactcatataggtgtgttccttctgagatgttctgcacgtccccctctgtgcttggaaaagccactcggaacacattaaggtttgagccat

SEQ ID NO: 57680 - DNA, 2490 bp, Oryza sativa
attatataacatatggattcgttaagcctttcatgcattgtggatgaaacttttaccgttatgtggttgatggcgctgtcgaccgatgttggattttccgccaactcagttgatgcgcaactgctgcgcttttggttgggacttcctaactcttcttgcgcagcagcagcggcggcctgcgggttatgttgctcttctcggatctcttgcctaatcttggccctcatcgactcgagcttctcgtcgaattcagaggtcagctccactctgatcgacgcccggatcttggcttcaaggcgtgcatctttctccgccttgttggaagtccgcttgtctagaaatccatacttccagagaacggtggacctaatgccccatgtccgtccacggtgttccttggtgcccaacgcttttgtgaggaggtcatcctcgtgtttttgagagctgacctcttgcaaggcttgttgctcggcaaccaactccttctgcattacaatttagtagggttaaatcgaaagctcaatgggaaacaatgtgtcacgtcctgataaattcatcccgaaataaaaatcattccataaaaggaataatagaattaattaaaattcgaaaagaaattggcaaacactaaaatacgtacaagaaaaattcgaatgtcgtccggagaatttttgttaaattctccttggtctaaaaggagccctcaaattttacttgaattttcagagcactggaaataattattaagcaacaaaaataattaacaaagtttactaaaaagaaaaactaaaaataatccccctcctccctttgggccaagtttggcccaaagtcctccctctctctctcggcccgcggccaaagtcctctcttcctccctctctttctctccctctccttctctccctccttctcttgggcctccccttcccctcccggcccactccctcttcttctcctccttggccgcctcggcttcgcccggcccaagccgagccgtgcctcccacccgtgccgcgcacgtgcgcgcgcgtgcgcgccgttgccgcgcgttgaccgcgcgcctcccgcgtgggtcccgcctgtcaggcgcatccccgacctctagccgccggcctccttcctctctctcccgtgaaccctagcgttgttcctcctccaaatccaccccattcaagccggctctttccaaattaaatagggggaattaatccccattgattcctctttgatttcccccgttttcccccttgaatcgtgtccccgattgccgggaacggacgcgccaacccccgccgctttccaaggccaccggccgcattcccgcctccgttccggcctctctcgttgccggctccctccccgcgcctataaaaaggaaccccctccttccgttctccagttttagccccctcccgcgctctcccgtggccgccccgcctctccccgccttctccttctctctctccggcgccggccgacctcagcagcacctcccgcctcgcccgtgcgccgtccggctgcgccgtcaccaccctcggcctcacagccgcctcctctcccccggtcagccctccgtttcgcggggaaaccaccagaggcgcgtccccgccggcaaccggtggcattgccaccactcactgcctccagccgcccctgccgcgccgctcaagtgcaggccggccgcgccgtcttctccctcggcgtcgccgcgtcgacctccaccccggcctgccctcggtttcgccggaacgccgtcgcccgcgccggtctcgccctccgcctagccggagttcattcggcaaccccttccgccgtgcccgtgcgccggcagacgtcgccatctcctcctctggcatcgcagcatcaaggttgccctcggcctcgcctcccctccatccgaaccccgccggtgttcgttatcgtcgtctccgttcgtcctcgtcgacgactcctccagtcggtcgttcgtcctcgccggctcgtcgtctcgctgcgctgccaccctcgtcgtcatcgcagcggcgtgttccgcgccgtcctagtctccgtgcagctgctgctggctgccctcatcgcctcctcgccagttccggtcgtcgtcctctcgtcgttcccggtcgtcgtggcgttcgtccctccgtcaagccattctcgtccgtcgtccgcgtccgtcaagtgtgccgctgcagccccgtcgtcgtcttcgtcctcgcctccgcgtcgttaagccttgtgccagccgcgtctcgccttcgtccaaggatcgccgccaaagtcgtcccctcgtcgttcgtctccgtcgttcccggccgcctccgccgcgcccgttcgtcgttgtcgttcccatgcctcgtcgcatggtggtaaggatctctcctctcgctgccccgtcctcgtcctttcggtgttgccccgtacccgttctgcggttgtcgaccccggtacccttgtaccggtgtcggtagtcgttcacgtgtgcgggtggtg

SEQ ID NO: 57681 - DNA, 700 bp, Oryza sativa
aaatttgacggaagttggtccgaccgagatagatctgtcggtctgactgttcggatgccgccggtctgaccagtatagatcaaccggtccgaccaccgaagtcgccttcctgcgcccgctgccgccgccggtctaaccgccggtgtgtcgccggttagaccgccgaaacccggtgaaacacaaatcgaagaattcttaaagtatatgacaattttattgcttctctctgtgtttacaaagtgtaccaacaacactccttacaaaaatctcgactaaactcgaaaccctaactaaactagcaactcaattgctctcaaaagcgatatcgggaagcctcacgctccccctctatttatacatgaggtaggcagcctaaagccacgaaccaaactcatcctaaaagtcctaatcaccatagaaaaccctctagtacaagaaacaaactttacataaccaatcaccaaccacgtgcatcaactctagcctaagtatcccgcatgatatctgtccaccacggacatcgtcttaccaccaagccgactcccggtccatcaccgcaaatactctcccgtggcatcgagtcacctacacatgaaacaaacaaagaaaccatattccgagaccaagctatcaccaacttgactcattgttagcaaacaacagtattacatacgtatagtatccatccagaagccataac

SEQ ID NO: 57682 - DNA, 829 bp, Oryza sativa
  unsure (1)..(829): unsure at all n locations
tgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaattgtcgacgtttgatgtcgcgattccggtatttgcatagtatggggatcgttagtactaggatatatgcgagattgtagtaaaagagatgagggcgaggatttttatacaggttcgggctcctgaattgtcaagtaatagccctacatcctgttggccgaagccggtcgttgctcttattcaccataatcacaccagtacaatatttatggtagcctatctaacggttgtcgacatggcggtctgaaggtctgactcgtagtcgacgacagggtagtcttccttctcgaatccgtgcccgattagatcagagacaacgctttgtctcttctgacagtttncgtagaccc

SEQ ID NO: 57683 - DNA, 792 bp, Oryza sativa
tttttgacaaacaggttaaacaacggaaatgaaaaaaatggtatcatgcctagaaatagggctgtcaacgagccgagctcgagcgagctcgtctgcctaggctcgagctcgatacaagctcgagccgagcctataaaatgttcaagctttctgacaggctcggctcgagcttgaccaagctcgagctcgactaccgagcttgattttttttacgtaatacagtatatatttgaaagattatcttaaaaaaataattaatttctagttcatcatattaatagaaaaggcaaaaaataataaaataaatatatgatgtcaatataaggcatacaaataacatattggatatcctaatttattaaataacaacaaaaatcatatattactaggctcgttggaagcttgacctcggcttgacaaagctcgcgagcttagggagaggctcgggctcggctcgtctggagctcgagctttttttgacagccgtacacagaaacatacatcattttccacataggcgtagccaagaaatgatcacacctaggacagaggagggcttagttgatgtgttcttagcaatattttaagggaaatgctaaacactggtataccgtctcgacgggataggatagacaccaaccaatccactcttcttctacctagctattctttctacaacatctctctcacgtgtgctgctgcaactaagtcaacgacgagctccggtgttgcatgggtgtggatgacggaggtcgcggtcgccggcgacgagctccgatgcggccacccccg

SEQ ID NO: 57684 - DNA, 7383 bp, Oryza sativa
tgttggaaatatggtcatatatcagcatattttaatccaaaatattaagacaataatcataatcatggcatgaacaatgtggggtgatctagtgacaacttatagcataaccagtaacatgcttaaggtatcatgagcatcatgcacatacccataccaaggacgcaattgacttgcgactagcatgactaacagcggtatgaacaaatgaattaataacaggagaaggacataccccgagaatggccctccgctggattgtgaggcagaattgcctccgttggagttgacgttcgcaacgcctccggctcccggcgtgccatctccagaggcagcaacggcgccagcggcagctccggctcgaacggctccggctcccggcgcgccatctccagaggcagcagcggcgccggcggcagctccggctccaggcgcagacatggtggacgaacagagcagtcgtgcgggaagcagtccccaaaaacttgatcacccgcctacccggtgcagatctcaggcgaaggtgtggttccggaggccctgctccttccgatctctcgtgcgcgcaagcgatcagaagcgagacagcacaggcgcgcgcggaggaagaacaccagggagaaaagcaagcgaatcgttctgatcggactagtggcctccttagatagcaggagagattccgctagttgcaacacacgcgtcgtgggatcgtgggccgttacggaggcagtcgtgggaatgtggttgcaaaagaatagagacgtgatgtacgcacgcacgcacgcacgccagccacgccctcggcctcggcccggcccggcgcgcgcgcgcgtgtggctttccgactcccacctcaactggtcaacagggagcctccaataactccctatttaggttgagatactcctcgcttaaatcctaaggtggtattattatccttaacacttattatgggcctttgagattttaatagaataaatcgggcctagcccaattattctaataggaactctgggataggaccctctccggctatcctgagaaatctcgggagagcttggaggttgttcatgctaagatcatggtgcctcagatgctgcaaggagagcaaggagctactaaccttgccggacatagctgcctctccaccatccgtgttgcggaggtggagcttaaggacatggccggtgaggttgctgcacctgacacctctccaatggcggaagcagtcttctccggtacgccacgaagcgaggcggcccacggggtcgccgacgacaccttccttgaaggccagcagcgcgtccctctcgtgcggcacgcaggtcgcgccggcaatatttggccgcccatgatgatgctcatgtagtgcatcggcgacgaggaataagctgccggtgcaggctgctatgacgacgagaagcagccatgaagacttggtagctgatgaggggtattgcatagtggcgatatgggtaacgagcagtgatccaagctatctgcctatgcaactcgatcgcccgtggttatttgtgcttgagcatatatttctttcatcgatctacctttgtattaatacattataaagacaaggcctagaaatttactaggtaatactaaaagataaagaaaaaagcattagacaaatcgtttcggttggtagtgtatattctttgcaccataagccttatagataaaactaagagatttgcttcggtctagcaaaaagtacatcgagatactggtacttcacggtaccaaatcgttttcgatcgttggatatagctgagcaaaattgttattgttagatccaacgatcggaaacgatttggtaccactactagaaaaaccatttttcctagcattgtcctattattttcattggtggaaaaatgtgaaaaccgccagcaaagtcgtaatagataatcttcgctggtggtcgaattttactggcggtcacttgggtgcgccgctggtgaaaatagataatcttcgctggtggtcgaatttttcctgccggccattaaacgaaaccgccagtgaaaacccaggtcagtgatccaaaaatatcttgtcacattaaaaccacccacctacctcatcctcttctccttctctccacatcccctcctcttttttccatatctggtcacattatccactcctcactctcttcctccctcctggcctccccaccggcgacggcggcggcggctctggcggcggtgaccggcggcgatgaccagtggctccccatgccgcccctgccctcccatcccgtctcccagatctgtccgaggggaggaggccgccggcggcggcgcaacagaggtggcggcggggaggacggatctgccccgctggcggcgcgggcggcagatgtgcatgcatgcagcagcggagctgacgacgacgatgacgacgacgctgcctgacgggtggcgccactgccctccccttccgtacccacccctttcctcccctaccctcttccagatctggctggaggagaggcagccgacagatgacggcggtagcggcggctcgtccccgatggcttcagcggctagggttctcttgtgtgttttggtttgtaaggatgttaagttaatctgtgtgttgttaatctgttctgttgatgatgccaatgtgttgtatttgaattgatgccaatattatgtgtttgtgatgctctggatttggattgatgcttgaatgatgtttatatccagtttcaatagttgctaggcccctaacgagctttaatcccggttgatgataccaaccgggaataaatatctctattcccgtgtcatctccatctctcgcgcgctctctctttccttatctcctagtatagcgcgcgctcagcctactctcttatcttctttctattccacccctcccctccacactctccttcgtcgatccctatatcatttggaattccacctgttaactggttgagtgacaaggcaacgataaccatataagaaatttcagctgcaccatactttagttcttgatgcttcattacttgagaaaaaatttccatgggtacatattttcctatgacatcttggtaccaactaacctccgttaatatcatgtgacgttttggtgtcattgatgttaattttatcaaatgttgaggatgaccctgatatgttgttgcctgttaaattcaagaatcgaatgctgtcaagatttgtaatactgtttggaatatccccatagaacatgttataacttaactgcagatattgcaagttcaccaagtctccaatccatactggtaatgctccatagaacttgttccttgaaagatctaggaaagttagtaatgatatactttggaggcataacgggaattctcctgaaattctgttgttacttaagagtaggagaaataagtttggcattctaaaacagagggggaagttctccgtcaattaaattatttgactagtccaatatatacaagttttacaacttgcaaacagtaatatgattgcaggacagtattagatctttaatacatggagaaccaaatttttatggcaaattccctgacaagaagttcatggagacatccaatttccggagtcttctcggcagctctggtatctgcccagttagtttgtttgaattgagaaataatgaatccaaccaagtcagattctgtatacctactgctataggtccactaatgctgttgtttttaagattgagaaagcttatgctctttaagtgagatatctcatttggcaacattccagtcatgttgttgccttgcaaactcaagtatttcaatgggcttaaataacatcgtggcaacttctcaacaagctccgttatgttcccagatgatagccccccatcaagtaacagtgttgtcaattcacaaagattttgcaagtctactgtcattgtggctctgttaccgttatcgaaaaaatatagctcttggagggacctcattcctcctagtgcctcaggaaagggaccatcaagataggtttgagagaggtcaaggatcttaaggcttgttactttctgttggcggatggcatgaggcccttcgactaaatctgccgaaacccgtggcgaaggctatggagcaagaacggcgtgaggcgaagagtcgtacgagtgccttgccaggccagaggcgtctcaggcgaagggtgcaaggcgaagactatctgccgaaggaagacgacttcgccatagcaagttcgcccccacgagggccgaggaagcctttccggcccatcaagcctaaggcctacagggccggcgatcaccagatggcccatcaggggcccatgagcccctataacattatgtacccctgtaaatgtcccttttgtgagggtaatcatgtaaattcccctgtacaacctaaagcctagtagtaagaacctgtaatggggctataaatagtcccctagggccatgtaatggggggatccaagaagaagaattcaaaaattcaatacactttgtttccttccaaccactgttgagtaaccacgtccttcgacatatgcagttatcatttcgacaacactttccaaaaccaacctgatgcgattgatggccaaagtggttcccagagagatcaagcttctcaagttttgtctggtttatgtgtgtgaaagtctggtttgcacttgaaagtgaggaacccgaaagaataagaacctcaagggatggaattgtgttcaccacaagaggtgatcaatatatcatttactgcgcttaggtttacgctgctcatgtcaaggtacttaagttgatgtagattggttaaccatgagatatctactgagtacatatcagtatccatgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgacgaaaatccggtaaccgcaactatacgcaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaaggaattattaattcccttgaaaaagataatggaggagggaccggaatcagacttttaggccaagcgtgaggcgcagcccaaggaatttgcgtgcgcggtcgaggcgagtgggtcggcgcgcgggagtgacggcccacggccgagcgaggcgcggcccaaacggacaagacgcgcggcaggaagccagtggacctcggtccacgacgcggggtcccaggatggggcccacctgtcggtggccaggttcaccgaggagaggttttatgcggcgctgcgctagggttttggtgggtgcggtttgcgcgaggtgcaccgagaaggccaaatggcggtgggcccacttgcagccgcacggctcttgtggaccgcgtgcaccaaagaaaagggacggagggggcgctgaccaatcttgctgacccggttgcgaccaatgtggcgccgacgtggcacctatgtggcagctacgtggactggcgagaggagaacgaaggaggctggccggggaacggacggcgggaggcggcggagttcaccggagctcgacctcgacgagacgtcttcggccaaagggagcacactggtgtgaagagggatacgagaggaatcaatccgaaggctctaattcgccggaaggagtttgacggcggaggatttccacggtgatcgtcggcggtgagcaaaggggatacagcggaggggagacgaggattcaatccaaggcgacgaaagcatctccagggttcgagggactcgttcccgggctcggatggagcgaggggactacgagggaggctggcgaccagcggcgacctccgggagcgggcggcgacggcggccatgccgatcggtggcgccgctaggaattagctcctacgcgatcggggcgacaatgccgagctatctagcgagctaggagaggtcaagggatgggaacggagggactaccgtgtcgggaagaggcgccggaagatggccgacggcacggggcgtcggcctcaggccggggaaaaggaaggagatcgagggcgcccggagtcctcgtctcgcattcacgcatgcaccggcctccgacgcgtgcgacgggcgaagagacgaagacaagaggtgggagcggcggcaaggcgtcaacaatggcgcgacgggtgtgaggcgagcgaaaacgagagaggaaggggtttggggtggcctgggttttacactgtttcaattaagagcgaaatgcaaaagttctatcttgttagtattgcaagtttatgcagcagatgttgcagtcatggcatagaacaaataaatgtatatatgactatatgagcacagagctcttctagacttatggtaatatacactgttagcctcttgcctttagttcaggaagctcagaaaaaacaaatcaagaggataaccttatctggaacaagaaaacaatatatgctagctctgatcacggctgattattacaaattatccagtaatattgcgtgcattacagctgggttcttttttagggaaaacaacaacatcatgagcaggttcaaaggagccctgacaagaaatcctatcttactactataaagttatcctcactaactccttaagcttagcatacaaagataccatatcatcatccactaataagatgccacatcatcatccactaatccactaattaacaagatgacacatcatcatccactaacaattatcacatttaaacatcatgcaaacatgttatatctttatagtttttataataaaacagcttttcaaatacaaacatgttaaaatatgatccaacattattaaaa

SEQ ID NO: 57685 - DNA, 655 bp, Oryza sativa
agtgtcaattgttggcactatccaatttcccttcactcccaaatgaatgccaattagacaataatgtaaattgagtaccgcttctaaaaactgccatagactatgcaattcacagatagtttcaatttacatgtagtaagtatgcataatcctcaagacattactagacgaagcaagttttgctctgtactctataagaagacaatgaatggaatagtacctcacacagcgtcacaagcatcgggtagcaggaaagttctcttgccttggtctggatgctgctaataagatacacctgtcgattctcatcaaggcccttacttttcacggcataaacatgaagaggtgcttttggatactgcaattcgaagaataaaaaatctaatgcattaacactgagctagaacataaccagctataaagtgctctaataaagtgtgtaaccaaagtgaatgacagaagcatacaaaatggggaaggataggtaagttacaaaccagcaccagttctaatacaaatattgaaaatggaaaaggtttgtaggtacaacataaaagtgggtgggaaaattacggttggcatgaattaaaaaaaaaatgatttacaagttgccttgctggtttgctgcaaaaagaggtgcctcttgtccttcaaa

SEQ ID NO: 57686 - DNA, 893 bp, Oryza sativa
ttcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaagatcactacaataaaatcctttattcgtgatggatgataacctacataatgtatgcctcgtcggtgatcactagtaataagaaaaatatcaactgttacaagtgcggacctgtcagagatgactatatctcaaaacagtccaaaagttgtgatccgttgatgatgactataacccaacatttcctcacatctcggatcgatctgcgtttacgaatattcgagcaagaacgaatttgtcgttcattcgtttcttaccgaacacacacacggtatacccatgtgtataaggtcaagcaattcacgaatttttgctacacatcatcacatcagagttctcccaacctcttcgcgcattccacactgcaatccagcgtctcctccaccccatacttatacttgaaccctaaatctacaagcttcttggtgtcagcttgcaccctcaccccctccccaatgaccctgagagaga

SEQ ID NO: 57687 - DNA, 11971 bp, Oryza sativa
ccagtagtttctgtactgtgttgatatggacgagatgaggagtagtgacatagagaagcaagatgaagtcatgctacctggcttcaggtttcatccaacggatgaagagctcgtcagattctaccttagaaggaaaatccagcagaagtctcttcccattgagctcatcaggcagctggacatctacaagtatgatccatgggatctcccaagtaagatttgttacttccattttcattcttttttccgttctctgcacagataaataaagaactatgaagcctttctctttcaagataacactaattatatgtttcctatttttactttatgactttcatggtgcatgttccatcatgtttcctatttttactttatgactttcatggtgcatgttccatcatgctgagacttcgtatcttagtagtaatagttttttcttctttttgccaccatgttgaagtcgaactctaaactttttgcatgcatctttatttagttgtctctgaggttttgataaggaaataagaaaagtaactacctaagagttttcaacctgcctcttaagcgctactactataatgtccattcatcacgaagcccatgcagttttagggttaagcctcataaaacatttagagcaagatttgcaagtctaccaagctattaatgtcatgatgtattctgagatttggctttcagtagtgttaatgtggtataattgatttacaagtatcacagttgggctctcaagactaaaaaggcatgcggatagtaaatagattatttttcatgtgatgcatatgccttttatcagtcagaccagttagcctagctgactagctcacgttttgttttaagtcagtgttacacaatagacaccatttaacttatttctagtcatatttacttaacaaatccttttttcaccgtgaagagttagcaagtactggagagaaggaatggtatttctactgcccaagggataggaagtaccggaacagcacaaggccaaacagggtgactggagcaggtttctggaaggccactggaaccgataggccaatctactcctccgatggatcaaagtgcataggcttgaagaagtcccttgtcttctacaagggcagagcagctaaaggcgtcaaaactgactggatgatgcacgagttccggctgccatcgctcactgacccttcattgccacagaagaagccactcgagaagatcattccaccaaatgtaagcaactggcatgctgcaacatttgaaaacaaaaaacttcaaaccttaacacatatgctacaaaagtagcttaggcatagctaccaaaactggcactaaggtagatgatctgagcaatacatgtctgcccataattacaatgggaaaacttgcaatataaactgcaaaaggcctagcatatgtagtgctttccgagctaattcagtatgacaccaacaatttcatataccatttccttgtgaagataagttgaatgcactttttacctgaaaacactgccctaatcttattcttcttttttcttatcatgagcaggattcctgggcaatctgcaggattttcaagaaaaccaattccacggcacaaagagcgctctcacactcatgggtatctcctcccttgtccagcacaaatgaagcctacactgcccctgtctcgcagaccacacagagaagtcagcatacctcagataacacatcatcagtaatgaccgatgccatctcctccaccatccagttcaccggaagtagctacttgccttcaacagttccttcatgccacaacccactcagcatgattgacagcaacagcaggccagatgcatctgtacctctaccctcaccggttgcagagcatcagaccatgggtatcctctcagcaatcccacttgatattacagctgggattgacattgcatccatggttttcaatgcatcatccttcacactcccaaacatggatagaatgactgcaaacatagagtttggccaaccacagaagtgcaacagcagcagcagcatgaccaacagatgtgtggtcgacatgcctgatgttgctaacaatatcaacagcggtccacggtccatcaacttcaacctgcaaggaacactttctgatgactggagaatgaccttgccatgggaatcactcccttgcacgacagaagtctcaacaaatttccagtcaaccaagtgctatacttaggtttctagtaatgtaggtttggttttagaatgcggtagtgaagattagcatctacctctgtctgctagtattactgttagcatgaagaggtattcgaatttcgttctgttaacagtgaagctaacagaattaggaagcaatatgctactagtccacaatgtaggatgcatcatggaactaattacctccttatgcagtgcaagagtggttgtcgtccgtctcatgtgtaatcgtagctcggttccaattttgtccatagttgcatgtactgcaaaatgcgtagggtattagcaaatactcccctgatcagctgattgtcttcatttcttcgtttttcctagttctgaacattgacagttgttgcctttttggttcacataccttgcgcacataacacctcataaatcgaagaatcgatagcagacgcaacaagagggatcctcgctgcagtgatggtgaggtccccgtgcactccgcccccgtcggacttgaattctgaattagttggaatcccgtacagattgggtcacttacaaatcctcgaggtgtggatcgtgctcgcgatcgactgaagcggcgtgcggcgagccgcccgtccgtggcgaagtcccgctgggcattccgccgaacgggtggcgcgcaccgccaccaagcggcactcccccggcggcggtcgccgtcttgtggccggatattagcccgctactgttccttcacgcccaacggctggcctgccaccgccggctgcgagttcacggcgcctcgccgacatcgaaaccgcgatctccatggagccctcagccctctcgtttccgttttggcgaggcggcaggagagagagtagagagagactcatcaggactgacgtttcgtcgcttcgacagttcgacctataatcggcccggataaaaatctattcctgtccagttattagtggaccaaatgggttgacctttgtctcaaactaggcccagtttggttagaatactgggcctgtcgtgatggttgggcctaaatccgaataggttatctgcatccagattgacagtccgctcgttcacactgtcaagatatcggcaactccaacaatattgttaggcaaatcatcgacatgccaccactagccatgatagtgcgaccaaaccaaaaccaatattttaacctttttttccttagttgcgacacacaaaaaaaaaagtcaatgcaccctcgcaacacccactgacatcgggctaggataacccaacaatcacattgtcaaaacagaagacggtattctgcattctgcactaacatggttggccgtcgtcatccggcgccttactggtcatcaccaactcactgctcctctcagtgtgccactaccggacacactgaccattaacccacttcaaatccgatcgcacaaggaggttgggagaaaagccccacatgtcagtgacacggccagcctctcacgtcaaaccgttgaaaccccaaatgtacagtctatgagtcactggcagaagggcccacgagaacctaactaaacccacctcgccggcgttagaaagcgttgcgcgcccttttcctccgcatttcgcctcgggattgctcgacggcgagcgattccgacttcacgcgctcccatggcaggcggcggcggcggcggcagagcttccgcgcagcggcgggcggcgctcgcggcgctgatcacgctcctcttgcttgcgtccctcgctttcctcctgtcggcgacgggcaccgcctccgccccgaactccgcacccttccggctggccgccattcgccgccacgccgaggaccacgccgccgttctcgccgcctacgcggcccaggcgcggaaactcagcgcggcctccgcctcccagacggagtctttcttgtctatctccgggcatctcagctcgctctcgtcccgcatctccctgtccaccgtcgcgctcttggagaaggagacgcgcgggcaaatcaagcgcgcccgctccctggcaggcgccgccaaggaggcgttcgacacgcagtccaagatccagaagctctccgacaccgtcttcgccgtcgaccagcagctcctccgcgcccgccgcgcgggcctcctcaactcccgcatcgccgccggctccacgcccaagtcgctccactgcctcgtcatgcgcctcctcgaggcacgcctcgccaacgcctccgccatccccgacgacccgcccgtcccgccccctcagttcaccgacccggcgctgtaccactacgccatcttctccgacaacgtgctcgccgtgtccgtcgtggtggcctccgcggcgcgcgcagccgccgagccggcgcgccacgtcttccacgtggtcaccgcgcccatgtacctcccggccttccgcgtctggttcgcgcgccggccgccgccgctcggcacgcacgtgcagctcctcgccgtctcggacttcccgttcctgaacgcctccgcctccccggtcatcaggcagatcgaggacggcaacagggacgtgccgctgctcgactacctccggttctacctcccggagatgttcccggcgctgcggcgggtggtgctcctggaggacgacgtggtggtgcagagggacctggccgggctgtggcgcgtcgacctcggcggcaaggtgaacgccgcgctggagacctgcttcggagggttccgccgatacggcaagcacatcaacttctccgaccccgccgtgcaggagcggttcaacccgcgcgcgtgcgcctggtcctacggcctcaacgtgttcgatctccaggcttggcgccgggaccaatgcacccagcgattccaccagctcatggaaatggtaagctagctcaccgcgatccctctcgatacggctgaaaatgcaattcgctttcggtttttttgagcttgatgttgctcgtgttcgtgccatgcagaacgagaacggcacgctgtgggatccagcgtccgttctgccggcggggctcatgacgttctacggcaacacgaggccgctggacaagtcgtggcacgtgatgggactcgggtacaacccgcacatcaggccggaggacatcaagggagccgcggtgatacacttcaacgggaacatgaagccgtggctcgacgtcgccttcaaccagtacaagcatctctggaccaagtacgtcgacaccgagatggagttcctgacattgtgcaacttcggactctgatctttgctacgatttcaatggtaatgatcagatgtaggttcagtcgtttctgcctgccgctgttgttgcaacttgcaaaagcagacgagttaatggctctgctccgctaactgtattgtgtttgtcccccttgtcatttaggctgtctgaactgaagaaatctctcatgtattatggtactagtagatgatatcccgttcattaccgtgggcattttgattttgtaggtattacctaaaactttctaacattgctcatattcatacttagcaaccatatatgcagagaataacggaaatcaaattagaataatggttgtgctaaaaaaatagaataatggcgttatatttttacaagactgcacaaattacttccacccggcgtcaccgttcaccaccctgcacagtcttgttgtgcacccacttggcaatatattttggggcatttgcaaatttgccaccggttttttgaatattgcaaggataccactcgaatgacagttctagtggcatttttgcaattttctagtggcagttttgcaataacgattcaaagtagtggtaaatttgcaattgccccatatatttttgaaaaaattacgaattacccctctgaaatagggctgtcaaaaaagctcgaggctcgccgagtagctcgagcttggctcgtcctaggctcgatttgagctcggctcaagctccaaacaagccgaacccgagcctgagcaaaagctcgcgagctttacccagccgagctcgagcttctaccgagtctaggtgagcttgactgtatataatttatattacatgtttaccttattaatataataaactaatagataaatatatattagtatctatttatacagtaaattagcatgtgttagcacaatatatttattttaatcattttctactcttttattagtgtgattagctagaaaataattatacttatcaagagattatcattaaaatatatattatactacttatagccgagctcgagctcgaactgagcttgcctaaaagctcgaagttgcaataggctcggcttgagctcgagcttgggcagacgagttcactcgagtttggctcgttgacagctatactctgaactattgaggtcgttcgaattacacccctaaactgcaatatcggatattacaaaccctaaactcttaaatccgaacgaatcacccccccttaactcaattcggagtggtttttggtctatatggcatacatggcagcctagtcagaaaaaaaaacgaaaaaaaacacagtggggcccagttgttagtgcatcttcatttcctctccttcctggcagctcaatcccaacaggcatggctccggtgatgtgggccatacggtggcaggaagaggaggcgatgcggcggggcgcttgcagaggccaatggcatggaggcggaggcgaggaggttgggatccaagaccagcaggctacgtcgattcgtggtagcgcagaggcggcgatggagacgagctatgcgacggggctcgacgtgccgattgcgtcaaatccaggcgtgtcggagcatgaagcagcacatcctcctttggcaaacgagaaagagaggaggaagagtcagagcgggaggactttggagctagcggtcgggggcggagctcaagcctcagggaaacggcctcgagatcgacgttccatagcttcgccgacgtcgtctaggctcgtcggcgccagccaccgcagaggagcttcgcctccaagccgctggcatctacaggcgccccgccgcgtcgccctgtctccccgccaccgtatttcccctaccatggccgtctccaccgccgcaccttcgccttcgaccgcgtcgcccccgccgccggtcgtgccgtcctcgcctccgcctcgatgccgtcggcatctgtgcacgttgctgctgcccctctcgatctttctcacgctttgttagccgcgcctagaggaacacaagattttggtgtcgctgctgctacgtactaccgccgcttgccatcttcggcctccaccgacgggcacctcatccttgggctccaccgctggcgcgcggctcgtcctcggcctccgcaacatggcgcgccgctcatcctcggcctcccgccgctcgcctcagtgcgccagatacggggagagaggggaagcggcgaagaggaggggggaagaaggggaattaggctgacaagtgggtcccaccatgtttatttgttttggctaacaaatgggtcccatatatttcttatgttttgattgactagactgccagtctaccatgtatccggtttgtaaattttagggttaaaaataatcggtattagagttcagggttaaaaatcggatgcgaggggtaatttgtaatttttccaaaaattttagcaataatatgggcaaaaattcctgttgggcctgggcgttgcgcgttcaccaccgtcggaagcccgaaaaactcttgctaagtggtccatgcagcccacctgtgtcaggtatagaagaaaggaataagttcatctaaggtctcttaaattgtcaacgaatccgattttcgcccttcaaccacaaaaccagatacaattggtccctcaactatcaaaaccggtgcatattaggtccctcggcggtttcgatggcggttttggctgacgtggcgcctacgtggctaattttgactcggtcttgatctgacgtggcactgatgtggcgcttacgtggcaattcgatccgaaaaataataaaccccgtgggacccacatgtcagtttcacacacaataataataataatggtgggacccacgcggaccccacatgtcagtctaattaacccctcctcttctgcttcctctctctcctcctccccctcttcgtctctctcttgcgctgggtcattctgattctcctcttccccatcttctctgtcttcatctctctcccctctcctctctctcttctcttcggttcacgggcggtggggagaggacggtgtccggctaagagaaggggcgcggcgcggcggctggtgggagggaaactagtggagagaagggaaccagcccggcggcggaggcagtgccgccgcggccgtggctgcggacgacgtcgacgtcgacctcggcatctcggcggcgggatgaacgtgtcccgccgaccggccgacacacgcgcgcatcctcggaggcggccgtccacgtgggcgggtgagggggccacctcgccggcgggagaggggagaggcggccggctgcaaagacgaccccagtgatgatgacgaccgtgcggcgcgcggcggaggccgatcccgtgagcaggaagctcttcgtccacggccttggctggggcaccagagccgacgacctccgctccgcgtttatgtgcctaatcatacaaaggtagaagcaatagcgactagtactacctgactggagtatattttgcttcgtcatcatcatttgcttgtgttatgacgaggttgatgaatgaatgaatgatcattgttttgggcaagaaaacaccgttccggccggattgacgaggaacccatatcgatccgctcgccgtggcccatggaaacccaacaggagatggcggcgctaccttccgctgccggcgactactaatggtgggtgatgctcgagcacattgacgaactcgaggtcgacgacgaggactccaactacaactcctgctccgccgctgccgacgacaccgccaatcccgtgagtccatgatgacttcgctcacctccgacggccacgtcgtaagagtctacttccacctcgaagcgcccccggcgatgtcacacctatgcccctagcggtcactcttatccatttccgccgccgtcgtcgccggccgcatcccctagcgcaagagagagatgaagagaggagagagaggaagcagaaaaggaggggtgagttagactgacatgtggggcagcgtgggttccaccattattattaatttttttatgtgaaactgatatgtgggtcccacggggtttattattttcccgggtcaaattgccacgtaagcgccacgtcataccacgtcagatcaagaccgagtcaaaattagccacgcaggcgccacgtcagccaaaaccgccatcgaaaccgccgagggacctaatatgcaccggttttgatagttaagggacccgttgtatctggttttgcggttgaaggacgaaaatcggattcgttgataagttaagggacctttgatgaatttattcctagaagaaatccgcctccttgtagccaccgctccgtcggtcagttgaaccggtctcctcgagcgctcggaggagcggcaggcgggcgcctctcgatctcccccctcgcgagtccggagtccggacggggaggcgcacaactccaggaatccaggtgctccctccgtccctccccttctcctctggtaggcgccgcgcaactgctccactcgtgtagcgtagtcgcctcgctgctaggaccgccgcatcggggcccgggacggcggaaatcaggcaccgacgacgtggaaaacttcggtgactggtctgtcacagtctcggggtcgtccctgttgccactgaatccgatcttattagtcgtccccgttgccgctgaatccgatcttattagtcgtccccgtcgccgctgaatccgatttataataagagtataatagattggggacatctctcgtaagtcccaacgctaatatcatcgcgacgcgcggtcgtacgagtggtcgtctcttactttttcaggtaataaaaagcgcaggcacccctccccttatccaggtccggatttgggtttccctcaagttttttccgttgttcaattggatcgaattaaacgatttatgcccgtacagggtttggtttgagtagaatcatctgtggtggtatattggtattctatatactttttttttgatttggctgtttcgatcagccatggtgaagacgtcggccaacccgaatgccaagggcaaggccgcagcttcgtcctctggtcttccgtcacccaagaccacgcccagaggggtgaggcctaaggcgtttaagaagaaggccaaggccgatccagagatgcagaaggtggcagctgcggaagccgccgccactgctgagactgcatcggcaccccctctgaagccggctgaggtcagcccagcggcagcggtggccaaggagaatggaggacagaggatgagcagaaaggaaaagacaaagatgaaagagggggaccagatgaaggaggataagaaggggagaataaaggggaaggaaaagaaggacgataaagcgagggagaggaagggtgaagctgggtttatattcatgtgcagtgctaagacaaagccggagtgcttccagaatggtgtgtttggcttgcctaaggggaagatcgatgtggtggagaagatccagccaggggcaaaactgttcctctatgacttcgacctgaagctgctctatgggatatacaaggccaagacaaagggagggttagatcttgtgcgaggcgcgttccatggaaaattccctgcacaggtaactctttagtctgtgtgttcctttcctatgttttatgttcctttcctatgctttaggttccctgcacaggtaactctttagacttattgtcagtgcgttcctttcctatgctttaggttccctgcacaggtaactctttagacttattgtctgtgtgttcctttcctatgctttagggtattgggaggacctggtctgctattagagcaatacaactgtcttgattatccaggcaatataattaaaatttaaaacaacaaatcagaactagaaacatttcctcaggcttaggggtgtgcaatgtctaataacgaataataatttcaggtcagaactgattattgatgtttgactcttgttttgttgttctgattggtgttaataattggaaatttaaccctaatggaacggtaaatgattgccaaggtattttttctagcatgacattgtggctatttaaatggtcaaataagttctatgttttcaaaaaaagggacaatgatcatcggtcatcattaacttaaatccccatttgtacacatgtttttctaacctttttaacataattcgttagcccatatgttattcgttcagattggtctatcatttttgtaagcaagtgtcatgcaactggcactaaaatacaaacagctcaggataaactagtcaacttttgtcatgagttgatttattcttaatacttgttgacaacttgagaaacatgattgctcatttttatgggggagtgcaacagttatgcctataagttaagctttaacaccagtttggaatatagaatgtggccacatcctattgttatgtttttgtaagacactaaaatttgagaaaattttgcatgtggcagcggctgtgtcattttcttttttgcatgccatcttcaaaactatatttttgtgcttccacccaaaatagcttatgttcttatccatgacactggtgacttg

SEQ ID NO: 57688 - DNA, 8315 bp, Oryza sativa
  unsure (1)..(8315): unsure at all n locations
aatcatttagaagttgtgcaacatcccctccacagcctctccaaccaccgtaatattgcgtgcagatgttccctcgcctccaagtgccatctgggcagaccanaaggtgtnaccccccccccccccccgcgccacccctcatctccttagtcggctggcctcctcccttcccatgccccctctttcctaagctggcggcggtaagtgcctgtaacatcccggcctagggtttaataggattaatagaatattcatatcaacaagttgcaacttcttttccggaagccaatctccaaataactccagggttaagcgtgcttggcctggaaccgggaaattcttcccgggtgcacacgagtgaggacaaaatgtgcagaaaagacatgtgttggtatgtgaggacagtctatgacctatgaaagctgccaaatgtaagtgggcccggcctgggagaggcgggtcgttacagtgcccctaccccaaccatcttcctcgtctctagaagcaacctgctgctaattatatataaaaaaaaggtcaatgctggctcactgccctcctctattcccttggctccgatgttgtcatccgccggcctgggagaggcgggtcgttacagtgcccctaccccaaccgtcttccttgtctctggaagctccctgctgctaattatatataaaaaaaaaggtcaatgctggctcactgccctcctctattcccttgggtccgatgttgtcatccgcctgtgtccaccgtccaccatctcccatggcctcccctctaaacccgacaatcccccccctatttcctcctttcaccccaacactaacccataccctaaaccctgactcatgaggccattgctgatcaccaaagttgtggagttaggttcatcgttcactggagcatgaatcgtaaagcaaattataaggttagaaatttataaagattttaccctcccatattctcttcaacatcctatttgatgttgtggagtagtgaaatataatgcaaataattgtgaaaagcttaaagaaaatcataacagtgtatggtggtcccttaagtaactaatataacatagaagcagatagggattgtgcgcgtgttgataggtttgaattttaacatttgcatgaaactatattatctaacgaaatgtatgagacactgaatgaatcattttttatcacttcaaggtggtcctcagctgtagctttcgagtttttttagattgctcgatcaaaaccagcaaaaagagaataattggtgctgtccattgttcttatctaatctaaacggattaaagtgcgtgcttattcttatatactactacatccgtaatagatagcacaagcatatactatgtgctttgctcctctaccttttcatcattttctccttttgcttggatatgtgcaatttagttcccgtgcctaaatttagtatatctagctatctaatgattctgtactcgtatagtcattttcatccacatgccaattaattaaggcttagttttttttaattatttaacaggttgtacattgaaatagactatttacttcacattccaaaaaaaatacattttataaagcaacttctatggtattgtttaggagtgattttatagtacttgcgaagctatcgagagataccgtattttctaatataaattttaatatctctcggtactttcgatcctagaagatacaaaaatctgcactaaaaaattttagtgcctctggtactttttgatatctctcaaggatcgtaaaatttctaattatttaaactagttgttttaagttatttgttaactatcaagatatttaatatatatactcatattaaatagataatccataataataatctgcttgtatgactcggcggaaacggtggatcactaactttctctagaaaagatagaacgaaagaaaatccccggtctggattttggaatcggcgacccgcggatgatatttgcagtgcaatctaaataatcattacctcactctaacaagtgatcaggctcacaaattcatatggtgggctccacgtcatttcgtaagacaacaatatacaatcatgatgacgcaaccagtgcaacaatcaacaaaagaagtccatcaattcgatgatgtaactatgtaaggctgtttctcactcacgcaagaagattttgtgatgtgttccctgaaccattttctaacagcgtgccaacgtataaaatactactaccagccgaacaattaagaaaaacattaatcttccttgcaccgtctgcctacgttcaattaacctcctcagatgctacaccagtctttttttttcttcaactcttctaacaaacaaataactctaattcaaagagtttaggatgtacaatattcagtataaaggggtaaattaaatggagttataaaccggaattaaaaaccctttctccaacagtgaaatggagttctgttcccaccaaagaaagaaatagaaaactttatttcacgaataaacatattggaggtagatcgatcactggattacatatgtgatttatactacatatttttttcgaacaaacatatcctgagagtctaaataggacctggtctcataagatttttttttcctctccaccaccgccaagcaccaattaaaacacctagctgacagaccaagctatctgtaccaatgtaccatacagtgatcgttcaacactggctactgttatcactactagctagtgccacccatgaacatatatggaataagagacaacgatgaccacacttccacacaattaagggcggcgacgacattcttcgcgcggaaccaacttgggatagatgagaatacagtactacaatcatgccagtaaagcctagcatgccgcctattgctccacagccattttcgctatcatgcatggcctcacagcgcaggacgatcgagcttgcattgggagctgaaaatcacccggaggagtcgctgttattcgaccgatgcatcgccatgggtgcagtggtccccggagcatatcaaaacagtcgcccaatggctgcttgatcgtcaggtctgctgttgctgccgcatgtcgtcgtggatggcctcccggccatcagtgtaagatgaagctgtggccgttaattgctcgactttgcgtgcgtccggcgccgggacccgccggccatgcacggtcggcttgaacatatgtccgtcggtcnnnnnnnnnnnnnnnnnnnnnnnngctgctggacagaaagaagcatattctggtgtcgtgcaataagaatctagaatgagccctagagatgtaggctttgcaagagaagagaattttatatagccacttccttgttcttcatatatatagctagaagaaaccagggataaaaaagaagcaaaagtgggtatgtttcattggtgttttggttgaaatttgcgagtaatatgtgttacatatttatttgaaagtgcattgtatggttgtaacctgttagttaatactatcactttttttctctaccacgacaatgtcatgtgttttatcctcaatccacctaaccagccaatcaccaatcatatataggtctcaatctactttctccaccattccccaattatatatgggtgtaacccgttataatacacggacttatcaataaaactttcagtaacgtgcaccgcgtacatcgtcccagcatactgcgtttagtgcaagcagacaggcacgcacgcacgcagaatcgaactgtatcacgtcgatcgggtgctggatttgcgagaaaagcaaacctgatcagggacaagcacgcgcactcacgcggatcagttcctccacattctagaactgatcgacctgcctacaaccacgagactgaatgatattgatcgatcacactagatgacaaatgagcatgcatgcagccacatattcacacactgatagatacgactgatcaccgatgcatcacaacttcacaagtcgcactgaaactgaaataagtcttcggtacaatgacaagcggtagctaggtagcgtctcctgaatcttctctgcatgcatggccatcgtgacatgtcgaatcagcgacagatgcacgccgcacaactctctactgaacggtcatgcagggtcaggcgcgcccaatcagtgagcacctgcaaaaccaagcacgcatccttgcctcaccgcctttagcttatcacatttcacatgcatgcatagtgctacacagtctcggtgtgctttcaaccggtcggcggacggcgtctcggtgatgccgatctttaccttccatatatcagggcgagcgagcgatcgacccgccacccggcgccacctcaccgtcgccgaccactactgacaccccggcccaccccgccactacgccgaaagacgcacaccacctcgcccgctagtgctcgccgtcgcgctcatctcgacgtacccccaacccgaccccaccccatgcatctcacggtcacggacggctgcctgctcgatcaaccgcgcgcgtgactgcgtgagggagagaatctattgtacggctcggcgcgcgctgcaatcgatcgatcggcagcgcgcgcgtcacgccgcacccacggcgaaatccgcgtaacaatcgcgtcgcgtacgtcgcgtagcgcggttgatttgccggacgaggtgagcacacacgactacacgagccgcgcggcgggcgcactcgcgcacggttgggtgggtgttggtcgttcgatcggtcgccccgcgccttttgatccgcgggatctttttctcgaccgatccgatactcgccccgtcggcagcttttgacggatctttggaggcgagacgcgacgtcggctacgtgggactgggatatttggctggctggctagcttctggcgcactacgcgctcgtgcacatctcgtcgcttgtttatattaaactgaaatgtatcatgcatcgcttttgagcgtgatacaatcacactaaataagcttcttttaataaaaagaacaatcacactaaataatttggggcccttttgctgcaggcagcgggtggggagatcgatcggcctcacgttcctttggtgtgggcgatctgggtctatcatcctgggattgtatataatactaaaaatcttctctgcaaagcaggggacacagtggcacactaaccatatgtacgccacacggtttctttgatctcctttttcactggagttttggcgaggtggaaagtaaagaggactcgaaccttgaatgtttgaactttgaagggactgcttaccggatggacgtgtggcgatgtattttttaactgaaagaaatttggcaaaatcacctgcgcgcattatagtgcaccagtaaaatcgacagatgcctgattcctaagactcggacctaaaggtgcttttgtgttacgcatcgcatccatctataacaggtaacccccaccatttccacgactcccttaaaaagctccatcagctgcttgacacatgacgaactatatcgaactaggattcttttggtggtaattattgttctcctggtggcctttttaagtttaatcctagtaactgacagcggggatggtcatgagggatggcaattcaacatcaatgtcacgaaatgtgatagtagtgcgagctaaagtaactaggttcttatcacctgttgcgacaaatttgtcatgtgataaaacgattagatttggatgatcacagcgactttttgtgctggatacaatgcactagtgacttgcatcatcgatccttatgggtttcaaaagttagcagatatacgtaaaagaaagcaggcaactttttcccctcaagaaaacatggatgatggatatcgatggccagttacgtaccttagattattattcacgaaagacttgattgaactcccgtgaagcggtgaatgcaacaatcagaacgatatgcggtgaagacttgattctctttgcggcccagatgggtggtgacagcccattaagcctgaaatttttgagctgttttcattaagtacttctctcaaaaaaaaatattaagcgctcctaattaacaatgcaatacactggaacagcattacagactctgttttgcagttcagtaggagaaatgtttctccttgttgcttagtaagagcttaagctgtgcaatattgctacagtaatgagtttaatgggcttcagatgttaacactcttcaagacctgggctctggtgtggtggtggtgtgaccaagaacagtcgagtaatatggaagtttgactgcatgaaattttgcaaaaaagtacagcacctagaattcctgaaccaactgcatagacatgtcaagtagaaatgtgaatcaggacctttcaggaacactcgcttagtttgcaagtaatccatgaagtcccagccctagcctccaccattgcaccatcatgcatgaatacatgataaaaacggtgaaactgggaagctgctactcggattgatcgtcgtgtctgtttcgtgatcactgttttttttttcctttctcctggacgtgatttacctcgttcctagtcgatgcaagttgatttccactccgtgtttccgtcgcgtggttctagagaacaagtgtggagtaagaaacactcattgtcttctttggttttatcagtttgggaatgggagcgtgtagcatgacttatgttagacatgtacagatgtactaactctggtttaagtcttggaatatagtcaaaagactagaagaaaacaagcgacaaaactggagcttcaccagtttaaatattccaagctgaagaaggcttaaacgaccagaggttaatttggtgtcatcatccaacaaagtcaacttggtctacagattacaagcacatttttacctatccatttataacatagactttcaccaagggtgtcagggctccaagaaatgccacctgcatccagctctgcagcgccaatctcagcatttcttgctcgataacaattggatataaatgcttattcttcactcatactgctactactatttattggcgccctacgctgtagctgttttgaaactgtccctatacctttcgagggcagagtgctttcccataccacacgtgcacgggggcaaaagccgatgtgccacgctcggcgtaccacgcggttaagcgcgtgtgtaaacacgcacaaacacggcctaagcacatcgattagccgcgcaaaagtacaagggaattaaatttggagtctgcaccctggaaacatgggatcctggatactaacaaacttattacatggccacgcattgcaaggggcatgagaaggaggataacttgaaccggaagggtttgactcagctcacccgagtaggggctagctactgtactacacttgctagtagtaacatcaaacggaggccgcacgagtgggttggcattgggcacagcaagatcgaggtcaagcaagcaagagacaaggaactagccatacctgtcgaggagagaggcagatacgcctggctcaccaggtcagtcaccagctcgaacgaccattccaggacaccatgctacaaagggcagacaactgaagcaataagcattagtaatgtatctacatatgttaacactccaccgtaaaaagtctgtaaaacaagagtgcatgtcacctgcttagcacacaataatttaaaaggtactccctccatacttgtaaagaaaatcgtttaaaacaatgtttaagtcaaactttgggaatagaaatcataaataactcttaagttgttaagtttgaaaatgtaaaaattatataaatagatttgtcttgaaaaatactttcataaaagtatacatatttttatagaaacgagaagtcaaagttgtgttttggagatcgtgtcgctatccaaaacgactttctttacgagtacggagggagtattagcacaaaaacacatctatttgcaagatttttaccgctagttatttgtaacaagatcatactaatgcaggaaggaatactcgtagaaatagaactggtatgaacacttcagatctgaatagaaaactgcataggttttccacggaccgactttaggcatttgaactcagaggtttgaccctaattacccctctataaaccccctacaagtgacctcttccctcatttaattctaagcttcttacactgttgggtgcttggacgacagggaaggaaaacttgggcccatgggattttgggttgcataattttcctaatttaatttcctgatgcaagggacaaatgagagggctgcacttggatccatgcaggattttcgcatca

SEQ ID NO: 57689 - DNA, 972 bp, Oryza sativa
tcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaactgttcgtcttattcaaaaacttttgtgagatatgtaaaattatatgtctacataaaaatatatttaataataaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaaga

SEQ ID NO: 57690 - DNA, 759 bp, Oryza sativa
  unsure (1)..(759): unsure at all n locations
cgtgacgtcctagatcgctcngnccntncnaannnnnnntntgnncccctaaactttgggaattttctcatcacctggacactatggaatggtttgattattgtggaattgaattcaccccgccccctctattcaaaatccccaaaatggttttaggctgggctcggggtgcatggttttgatagtagcacctcggccatataaggaccggtcttcgggcctctgttgtaaagcactaccgtacttccacatgtctagtgggtaaggctttgtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagccctgcctacctgtcccgggggtcccggccgtaggtgggattgggtcggtactcttgtctatggctaggatgggttggaaactatgtcacgtctttcgtctgtataccgaggtggtatgtggcacgtggctacacgtgaggaagatgtgtcttgtgggtaaagatgtacacctctgatcagagtataatctattcgaatagtcgagccctcggatatgggcaagcctagcaatgtacccaagtcagtgttataattcttaaaatttgcttaacaactaaaatgtggaatggttggcctcgggtgccttgngatgagcttggacccacg

SEQ ID NO: 57691 - DNA, 759 bp, Oryza sativa
  unsure (1)..(759): unsure at all n locations
agatgcgatgcgatcntcatngacnnnncnaannnagntcggaccactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgac

SEQ ID NO: 57692 - DNA, 762 bp, Oryza sativa
  unsure (1)..(762): unsure at all n locations
cccgagttttgagtnaccgaccctcgatagggcgcctgtcgagctcggtacccccagaagaacggatctggatatattatgctaagatcgacaaccaattatcaagttggtgtgctagaagactaactgatgcagcagggtaggaaaatatggtttcgatcaacgcaggttcaatagcgtttgagaataattttctagcatgcatgttgctaaagcaacaagcatagcctggttagaaatgttgatctgcaggcatttacagactgaaaaccacatttgttttcctttgtttctagttgatcaaattaccttaaactgtgcctatatggggaggacgagtagaggacggctaggggagagttctcaccacaatcacgatgcggtgagggattaacagtggcaatcgttgatgagcttgctgtggcggcgatgaacggagaagattgatgaggagacggctctgacgatcttcgggcctggtgaagaggtagacaacgatgcgcatggaggtgctgacttgatggagagtacgatgaccacgggtggcgcttcgacgaggtaggaatgacagacggaggaagatgacgacaacagggtggcgttcctaaggtctttggtctgcgaggaggttaccgtgatggagtaggaaagatagccggcttgggttgatggcgaagatgaagctccggtgctgtgcgagcttggttgaagcatatactatggagaacttaacagagaaagaccggcgacagcgatggtgct

SEQ ID NO: 57693 - DNA, 7341 bp, Oryza sativa
ctactgcccaacgtgttgtctggctgtactattgtttgtgtgttgctgatatggagtggttgcttgctttcaggctccagctagctagacaaatgtgtagtgaaaaggacctatggattaaggtcgatatatgttgttgacagaagagacgacattaattccttatacaatgcggatgtgtgcatcattatggtatatataagtttaatgaccttgaaagatatgtgattggttggttcggataacaagttacatgagcatataccacctctcgttgccttttgactttctttctggccggcgacataagctagactgaataatttggcatatatgcctaaaatagagatttaatttggcagaatcaaatccatggcaacatcttgacaagaacgcgtgaataaactaagtacttaagtgaggactaaattagccaatgattttgctctcttgagatttaaaaagtttttcagataatgaagagggttgcgtcaaaaattaaaaaaatggagaggatcaaagctgacgaaactctgaaaattgtagctatcggaggtaaatttaacaagattcagataccatcatatgtaaaaagacaaccggaacaagctaaggtcgtttcagaaaaaattcttatgtgactactaatattcaatcagcactcaattggttaggtgtctctgctaacatcttttggcaaagaacagattgaaagaaactaagaaagcatctagctagtatgccgaagtagtgcatggcttaagtcgtacacatagctaactattatattgcatatatattttgatgcaagaagtaatatatatgaagaattggcagtttgaggtagctgtgttgctgcatctgcatacctgaatccaggggaaatgcctgaacacggcgaacgcgagcgtcacggcggggttcatgtgggcgccggagatgtggccgacggcgtagatcatcaccgtcacgatgaggccaccggcgatcgactgtcccagctgcgatatgcgagacaggtcgctgccgctgatccctgccgccccacacgtcatgaacaccagcaggaacgtggccaccacctccgacacgacctgcagccatggcgatccaagcagcgtgcacgcattagctcccccccagctcaatcgatctcgaatcaatcaagcaaccagagaaagacagataaagctctgaaagtctgaagaattaatcattcagctccagactcctcaccttcttgaggaggtgaggagggaagaagtcggcgatggccttctcgccgtagtacatggtaggcatggtgccgttctgcaccgtggagagatcgtggatctcgttggagtagttcgccctggagtttgttctcgagttgttgctggccatttctgacgctctatctagctgagctacttgtgcagcacgcgagtgcaggaggtagaagaagaacaagcagctcaagctctaacactggctggctagctcgctcgctccgtcgatcgcttgctcgttgtggtaatgagcaggagtatttatagggagatcgagctagctaaggttgagaagcctgagcaactgggaggtggcaggtactagtagttacagtcctcactgccttttgattaggcaggcctacttgtcggagcaccactgggtacagtgcttgcatgcatagctcattagccctaattaatcagcataagatcattgtttctggtctaatttttcgacggggattcagattttgtttaatccgttcaaacacgttgtcggatcagcattggccgagaaacagaaacgcatacttgattttgtattctcgtcgagggcataaaaccgcgcgtcatccccccgtgaacgacaacgagagcaacgttgcctctgtctgctgttagactgaaataattgtgggttttcaattcacaaggtgttgtaaactatatgcctggataaagcgcgacgtcgaggtcatgacgccgatatatgggtgacgaacaaattctttttcttttgtagattgggggctcccctgaaagaaatgatactatagggatggatatttttggtcattctacgtacgttttccatgccgaatgttaatacgttttttttgcgaaattcgtcacctgttgtaagttgacatttttcataatctatactcgtagaagagacgaaccatgtgtgccaatgccaactaggataaaccgtaccgaaatttactattggccgaatttgccattgtccctgtcagaggttgccgccattgccagattaatgatggatccgtggcaactgaacaaattttcaattgtaggattgccatctctggtgaccaaattgaaatatccgagcagttaaggatttgcaaaggtgacattacaataaggggttatcctaaccactctattacgcagtgtgcatgcttcggttagcaatgctaagcaatgtcagagcagaggacgttgcacttggatggtcactgtcaaaactgacctgctactattgaaaaatctcatgtcagttggagtacttcagcaatttgcaatcctagcttctctcattgagcttagctcacattcagtttttctttttttgccgtactgtacctgtaggatactccctccagttcgaaatgtttgacaccgttgactttttagcacatgtttaactgttcgtcttattcaaaaacttttgtgagatatgtaaaattatatgtctacataaaaatatatttaataatgaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaagaatgaaagaacccatattttgatcggtacagctcgttgcagatcagccactcgacttggtgaaaatctcaggccttacagagtttgctaggtatttcgttcacgaggtgtttcaatcaggtttctttcgcaaaaatgcagataatttattgatttgagatgccttctgtaatgagcactcatcaatactttgtagatgtatacatgtagaatcaagaactactttacgagcaaagcaaattaaatgaaaataaatggatattggtactgaaaaataccactaaatacacacatgtgcaaacagagagcgctttctggggcacgtttagaaccagcaccttattttgcacgatctacaggatgaaaagacagcttgtgctgctgaaaaaggaccaatggcttttggttgctctccctgagatgagactagcgcattggcatgaggccaggccacaagagggaaaatccacgcttctctgcaaccccttagcttttcatgagaggcatggaaccaagatagctgacgagtgagcgatcagatcagtgaatcaatcacagatgcaccatccatccagaagctggcataattaccttcgctgattattgatcttcttttgtctgcgctcctcaggccactagtgtagttcttgttaatcacttttgtgtgtatgaatctaactacatttcctggcataatgctaggccctaccctgtgatcaagcagtagcaaaagcaccccatgttgaggtcaggtgtaccatccgatatctgctaagttgatatggtgccctgaaccattctctgaagaagcatcgtttagattcagaataaccatggttttactttgcacaagtctagctaatactgtaggtaggttccctgatgcatctgcaatggcgcgcgcctgacctcagaacttgaatcagttattcctatatggcaatcaatcatgtctgtcttcccatcgaatcacctccgttttcacggccttaacaaaagatctgaggaccatatatgttctcgattgttgtcgaaggttctagatcgattcaccactgtcaaaccaagcaattacgtatggaactatgaaacatatcggattttgacgaataatgattacacatatttttaattcttttctcctatattattatgtttcgaaatcagagcagataatgtatggattcatatgtagatattgattgttctggaatcagacagaaaaagacggactcatagtatgtcttctaatttatcagccgtgaccaaaatttaaattttaaaacataattgtagtgttgaacttaagtttcttacttggaatttattttcaatattgacttataaaccgctaagaatacggatataaaaattttacctgtaaattactttttattgggaaagaacatgtaacctagcagttacagtgataagtagcacatctaggttttgagttcgacaccccaagagagtgaattttaagcctaattaaaaaaaatcacttgttggccctgtaagatcgaacaacgagaactaagattaccaaacagagagaggggagggggaggggggttgaatggtagcaacaccaaacacttttagcggaattaaaagttacaccagtgttagatctttggtctgactgtacaagcctcattggtctgaccgcgcaatcaagccaccgcctcttgttgacacctccggtccaaccgccatagatccgattgtatgaccgagtagttgccgttggtctgaccgtcggtattcttccggtgtgactgttgtactccgagcaaatcacaaatcgaaaaccctcaaaagtagattaaagtttatttgcatatattcgtgtttacaaagtgcaataacaacacttctcttatagaattggactaaactcgaaaccctaacttttctttaaacttaacttacacataatcgatcacaagaggcctcaatcccctctctatttatacccgagataagcagcctaaaaccatgaatctaacttgtgcaatatatcctaatccactaggaaacatttctcgtacctaaaataaacttatctctttccaattcaaattccaatcttcctaaatttaaatcgactccttattccatatgtacacaatctcccatcgtatgcctcatggaatctccatcaaccacgtgcattgttttttagcctaagcatcacgcatgatatcccaatcgcccggatgtcatcttctctcaagttgattcctgaccatcatcggcaacgctctcccgatgcatcaaagcacacctacacaggaatcaaacgaagaaacatatctgagcataagttcttctcaactttactcaacattattacacatgtatagaattcatatataagtcataatcacgaataaacaaataaaaaacccgaaaccaacatcgacataaagttggccggtcatgctgtcgttttggccagtttgacagtgcacaccacgccagtatgaccagcttatcctgcccggtctaactggctccacacaaagagcaaaactacttcactaataatcttcaaatatcgaaatcaattatctcatatgccaattgttcatcataaaataacaatcaaaacacactttgatttcacatgcccctcataaaaatgtgttaagaatcaacctatggagcgtgggcctcgtataggaagcatgggcctcaaagaatgagttaaggaacgatccatatgaatgagtttgcgtgtgtgtgtggggggggtgagggtttgtggcttttctcggttggtttgatggagccttcttcttaatgaaaaccatcggacacttattttctcactggtcaagtttttttaattatttttcgttgtttcgtttatttttctacagtttattagctatgagtaaactatgaggttgagagctaggttactcggttaaattagacagaccaccggaaagccatcaaatttcaaaaagtgttattaatgaatgagggtacaaacggtagaaatgacatgagccattacaatttttacggtggtctatactgatgatagaaaatacaccactaatgtagcaaaccatacagctgttacttatctacagatcgaacattcattaattttggcatcaaaccaaactttcagctctaaccaaacttacactaagctttgatggtactaaaattttggcaaaatatcagacctaaccagccttttaccaaaactttggcatggtccaaatattgacattgttaaaatctattatatactaaaagtccattaaactttctacaaacgctctcaagttatcacgtggcgctctaataaattagagaaaatcctagaaattctaaaaaaaaagcaaaacatctacctcttgattttcacttaaattgatgggtccaatattatacaccattagataaaattgatcttaaaacaaaccaaataatatgggtcccacctctcctatttctcccgcgtgcataagtataggtcacgtacgtacatgtgggcctgtagtacgtacgcctccctccatttttttcttttttttcttcttttttccatttatacaatttgatatatatttgtttaaataatcatattttttttaaaaaaagaaaaaacatcatataactctttataaacacaggtaattaactaaattagctatacagactttgaaaataaaatttacaccatattatatgtaaattagctctaaaatcaatagtgtaagataatttactttgtactattattttcatataatgcactattttaaaataaagcttacacaatattatattgtgtacctatcaaataaacaatttaagatctaaattaactaatatatatatatatgtgtacttaaacagatagacccattatttaaatcatcggatctatttttttattactttggactattattctcaaataatgcattgttttaaaataaaatctacaccattaccattatgttgtgtacccattaaattgacaatttaatatatatatatatatatatatatatatatatatatatatatatatatatatata

SEQ ID NO: 57694 - DNA, 1896 bp, Oryza sativa
cggcatcattatgtacttcctcttcatgcatagccagggggggaggttgtagatacacatcgtaacgagccaagtgctatggccgctgctcatctctccaaaaggattcatgccatccgtactcaaaccaaaccgtatgtttcgtgcgtcctttccaaattctttaaattttctgtcgatgtttcgccattgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcaaactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacagtgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaactattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcttcttcctcctccagctgcccgagcaagcttcaaaattttttcaaaaaagaggggaggtcatgccaaaatttctattgaatttattttggtgattacatacaaatcggaggggcctaaaaggtttgcaacttcatcctccaaagtggtttttggcatactacatttgcacctatgttttgcacac

SEQ ID NO: 57695 - DNA, 1072 bp, Oryza sativa
cttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtcatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagtctacaatagtcaattgctacttgtcgcaccaattccgtagtcaataattacatactaagtctaattacaaataaagtaatcttatattaaaactcaaataatattacttgctaagactaaaatagtcatctatgctaagtgtttcgtgcgtatatgctaa

SEQ ID NO: 57696 - DNA, 17647 bp, Oryza sativa
cggttggtaacacaaaccgggactaaagatcaaatatgcccgttacccttttgaaccgggactaaagattatctttagccccggtttttattgcatccgggactattgtggaaatcggccgaccgacgaaagatggtttctccaccagtgagacattggcctgaaacatgaacctacctgcatttaaacgttggcacggagaacaatcatatagcatggacaacactgggtcgcgcgcagtgtgcctcccaaatataaaacggttttaattagaaatatagtaaaaaaaatgtcattcagagtaaggtaagcatgccaccgcccccgccgacggcgtcggcgctccagccaacgccgcccacgcgcatccttctccgccggcctgcccccgtctccgcagcatcgtggccctcgcccacggcgcgtcgcacccccagtgccccgtcgccgttcccagcaccggccccgccatcgcctccgacgtccctgcttccgtcgccgccgccgcggctgctggccgggggtggccgcaccagcgcaagatccatctcggtggtcctggagacgctagatccgtcgcacaccggcctgcgtcgctcgttcgcagaagttgtcagaggagcggcatcacatttttcaaattcaaaacaggttgtttgggcgcgttcctcagctagctccggcttaaactcgccatttacttctcccgtccggaacaaccaccgctccactcgccgggtcacttcaccacggagagccgccccctacgatgctagcctacctcaacgtcgcatcgccgagcaggatgatgggcatggactgcaagatcctggctggatccgggtgcagcggaggagctcgcggagacgcgaggcgcattcaagcggcgtctgcctaccacaacgctcacctcaatcaagcaatgcgcttcggccgtcttcaagttgacgggacgctgtacggccaagccgagactacctctccgcctcacatcgagagttcttggctcagaccagtggaaggtgtttcatttgcctctctcgtggacaccgagcagcccagtgcaggacccaatctgctgcttcctctgtcagcgctccggtcaccgcgtgcgcgactgtcgtcgccgcggctcggcgggtcgtgcgcgctcgtcggctcgtcttcgcgacgtgtcccgtacgctccactcatactacggggctcgcactcgcacgccgccaccaccgctgcttcgccaccaccttgccgacacgcgcccgccgcctctgcttcgtcgccgctccggcttacctcacacctccgctcgacgcgagcgttcgccagtcctctcaccctgcaagcgcgcctcccccacagctcagccagcgctcctgtcacgcccggaaattcactaataatttccgaactaatttgtgcataaaatcctcatccaggaatcagccgaggtacacaaactgacaatttaatatacaaatccatcataataataacgttacatacttacaaaagaaaagaaaaacagcaggcacggctattcgaatagttttactctggccagaggtgtaccactgtacccacaagacacagcctcaacatcatgtctaccatgcgtcgtgatactggaaagtacccgaatagaggctgtgacaatacactctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattagccatcgtgagctaccattaaatataaccataaataataatgtagtatatatgattcatcccattagtgagctaatgtttctaagcattgcaaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgctctcacaaaccttcgaaacgacggaaacgacaagctaacacgcaaaacaaggaaaacactaagaaactccaaataaacaataaatataaagtaaaaaaacatgtagatcataattttagatgtattatgagacttgaacggcctcattctgacttcatatgaatttattacgaattttacaagatttaatctaattaaagcctatttaaaaagaattaaataaatttaattctatttatggataattttaatatgtagatctttattttatacaactttagagacttgaaccaactaaacccgagctaagatgaattagttatgaatttttaaagattaaaccggattaaaacatttatatggattttaattgaattatgacgcaataaagaattatttttgaaaaggaaaagaggattattgcgtcagcgggctcggctcacggtggaccgggtgcacagcggcggtctacggaacggacggccgagatctaccctatccaaaacgaacggccaagatcaacttgatctaccgcggttcacgggacatggcgacgatgacgtcagcggtgacgtcatcaccggcggcgactcgggagcacgtgctcgacggcgaacggcggcgagacggcgcaaacggagggtaccaacgggtagagctcgactcggcgaactcaccagtggcttggacggtggcggacgacgacggatgacgacggcggcgaggctgaggcggcgacggccttcgggtcggcggtgacggcggtgcttcggtgggaaacgtcggcaacagagaggtggacaagatgctgctcctcctcgcgatcccgatggtggcgacggtgaccgaagacaacggctgcaacagcggcacggcacggctggaccgacggcggcggtggagagcttcggggcgacggagtcagcggcgctccgacggtcttcggcggcggcgaagcggtggacggaaacagcgacgacctcacgatgctgatgaaggagacagcgatcgacggcgatgaccgaagcgacgacggcgaccgactagacacccgccggcggcggcgacgcagagagcaacgcggaggcggcgctagagaaggcgacaagctagggcgaaggtggcggcggaaagaggaggtcccggggatgcttataaaggggctagcgagcggtgacggaggcccacggcgatcggcggcgagatggaaagcaagggttggagggagaaaagtcgatccgaatcgagctcaaatccgtcggtttccaaacgaaattagccgaagtttctaaaagagaaggaagaggagatcgaggagattatttcccctcaaatgatttggctggagaaggaatggggcggccggatttggaaggagacggtggcgcggctcggctagggttcggccgggcgacggcgcgaggttgacgacgggtccgacaggtgggctccacctgtcagcggaagggagcgcgcgcgcagacggctgctggctgactgggccgactgggccggggagagagagaggaaggttttgggccgactttcggcccaaagccaaaagaggggtttaaaaacatttttctatttaaattattcatgaaatggaattccatttattaaaaatactttcttggctcaaataaatcccagaaaaatctaggaactaaagattcaagagaagtatttaacaaaattttatctagccaaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatagttaatcatggagaatttaataaaaattaaatccatccaagctttatatttaggaaattttatttcccacatttaacttcacttgtaaattaatgaacatttaatataaattctattaataatttattagataatttctaaatcctaaaacgaaaatcaggctgtgacagtttcccaagcaagaacgcacccggctgccgccgccaccgccccggtcgacccagagcaagatgtcgcagctcggtgacccggccacgcgccccgaggaggacacgtgcttcatccccacctcttacgccattgacgaggagctgcgcgagtggagcgagactgcggctgtctcctgggcggcccacgcgccgtcgaccactacaccgcgcgacgtcgagcaggccttcctagatgagttccagcttcgtcggggcgaggtggctgtctcgctctaccatccacaggccttcctcatcaagttccaacatcgtcgccattgtgaggaggccctggtcaaagggtacgtcaagcgtcgcggcatcgagattcatttcatcaagtggcgcagcctgcagagtgcgctcggcgtcgcgcttatgttccgcgttcggctgtgcctcgacggcgtccccatgcacgcctgggctgccgacatcgccgagcggatcatcggccgcacctgcgcactggagcagatcgagaccgacgttgtccatccggtggagtccggcaacacgcgctccatcgacctctgggcgtggacggcgaaccccagcaccatcccgaagaggatgtggctcagcttcaccaacagggcgaaagatcccaagctggcacccctgctcgcggtggaaagcccgccggagcactggcagagaggggtgcgccatccggtcctcttccatctggaagaaatccacgactacacagcggcaacaattgacctggaggagcaaggtagcttccagccgaccaagcgtcggctgccgccttggagcctgggagtgctcgacggcgagcaggtcccaggacgggtgttcgaggattttccgcatcacccaccgccgccccgctcggttcacgaccgtctcggcggcactgagcgggaagtcgatcgccacgaggacgatcgccgcgatcaccacgacgaccgccggtccggccgcggcaccagggacggccacactcgccgtgggcgcgcggcgcggggcgggcgccctcgcgacgacgacgaccgtgatgactttgatgacgaccaggacgaagatcgtgaggaacgtgaccgggacgatgaccgcggtcgaggcgacgatcgcaaggaccgtgaccggggcgggcgaggcaggcgacgggggtccagcaacgaccacccgcgaccctggcgccgcattgatcgggacgatgatcgcgacaaccgagactgcgatcttggccacgactgtggcgagcagcgggcaagcgacaatgactaccgccgcgagcgcacgcgctccctgcggcggcgggacaggggggctctagccgctacggcggcggtagacggagaccggctgacactatctacgactcgagcaagcagctctcctcgacggacgcctttgctctgcacggcagtgcgctccaagcagaggtaggtgagttccacttattgcacgccctgcacaattcccccttctcgctgcaggagccccaattgccatcgtcagtggaccagctacaacggctctccttcatcgcgaacaaggctctggcggggatgccgccactcccggagcacgctctcccggcggacccaaggaatgaagcctggttcagcatgcagcctggaagccgatcccggtggagagcgtcttcgcgcgcatcaagtcgaacctgccaccgccgactgcggcgaccacatgccaacaagttgaagaagcgctgttgcggctcgagctggcggcgacggcagcgatagactgcccagtgggggacgtgtcgcctttgcaggccgcctcaccgccacctcatgcttcgccgactctgcttcctctcgaaagccaagtcagcctcatgcacgatctgagggaggtggtggcggaagggggcaacaaggatggcaatggcagccatctggcgccgctcccacctactccgtcccccatccagtcttctcaggtggcggtcccggcatcgccgaactcaacgggcatcctcgatgcctgtttgcatcaccgccgcgagcaatcctcgcctcgccaccagcgtcgccgccaagatcaccgtgcgtgcatccgatccagctaacacggcggctcaagatccagccaaggaaatgcggtcaggccacccggcgcaacaaacgcattgccaagcagacttcaaggccgacgatggagcggtgccagcgagttctcttcaagaggctcgggatcctcaacgacgaaggcggcacatcgatcgagcaggtccttgcccaatacatcgccatgttcaatgggctgctgccaccccacatcatcgccgccctcactgcgatatttggcatcgacgacgacgagcaggacgccatggacgcggcactgatatctctggtaggtgaaggagttgcggaagtggccgatgaggtagagaagaacgccgcctaatgtgtcctggtattgaccggacctggaatgggagccttcctttctccatgtatcgtcgtcttttgttgggtggatggagtgctggtggcctgcgagctatcctctccgtgtcaatcccctctgtgtcaagctggatcgccggcggcctcgcaagaacctcttcatttatgttgtcaagaacctcgtttatttcccctgcagtgtggcgtcttctgtgaacatcttgtctacgcatcgtctttacctgcatcggcgctagcttcggcggacttcaccgccaaattttcggccgcacattacgtcgaacaccttcgggccactgtgaacctgtcgaaccagtccagccgcttcctgggcctctccagcgaaccaggccagacacgatgtgggccgcctaatgggcctctctccgatcgtcaagccacccccctccgcttgtttctccctgaaccggccgatgggcctcaggccgccccctccttagcatttcccgggcctctatgtgccctcctgcgcaggcccagcggctgggatggccatggccagcgcctgctgactgtttgggccgccgcccctacacaagaccaagcagcccacccccttcgtgggccacgaatacggagaacaattttactaaaatgatgcaaatcctagatattatttcctagaacgtgagggagctcaattcggctgcgcgctgtaacacgatccatgagcttatggcagacacgaagtgcagcttggcatgcttccaagagacaaagctacagaatatagacgatggtctcgcccgctttttaggaggctacaaactcgacaaatttgcctttaagccggcaagaggcacgagaggggggatcctcctcttatggaatagcgcagtctttgacgtccaagaggtccgagtcagtcgcttctcgatttctgcgcaagtgacggtcatactcacaggggccacatttctgctcaccggagtttatgggcccacaaggcaccacctcaaaagcgccttccttcggcacataagaagaataaggcccggccccgaggacggatggcttatccttggagattttaacatgatctatcgagcaagggacaaaaacaacagcaacatcaaccttgcacgcatgagacgctttcgctcaacaatcgatcgatgtgaactgcatgagattcccttgcaaaataggaagttcacctggagcaacgaacgacgaagggctacacttgtcaagttagatcgctacttttgcaacgagacttgggacttggccttccctaaccatgtccttcacgccctacccacagggccttctgaccactgccctctagtcctctccgacccccaatgtccacgtaggccgagagccttcaagtttgagaacttctggacaagaattccaggattcaaagacaaggtcaaggatgcctggtgtcagccttcgtcacacacagagcctatgcaccgcctaaatgaaaagcttcatcgcaccgcgacctgtcttagagaatgggcaaaaggaatctacaccgaggccaaactgcagtttcacatggcgctcgacgtcattaaaagactagatgtggcacaagaacatagagacctctctgcccaggaaacaagactaagagcagccctcaagcgtaagatccttggcctcgcttccattgagcgggcaaggaaaaagcaggcctccagagtaacacatatctgtgagggagatgcgaacacaaagttttttcatctcaaaatgaatgcgcgaagaagaaagaacaccattcatcggctgaaaaaagacaatggttgcgctgtgacacataaggagaaggaagcaacgatccatgaccattttgcgagcataatgggacggccggcgccaagaccaaataagctaaattgggatgcccttgacatctcaccgattgacctagccaccctaggggagcccttctctgaacaggaagtacatcaagcaatcaagaaaatgccaagtgacaaagctccagggccagacggcttcaccgggattttctttaaagtctgctgggaaatcataaaggaggacgtctttctggtcttcaactccatttacaatctcagatgtgcacacctgaatctgatcaactctgcgaacatcgtcctaattccaaaaaaagagggggccgagggcgtttcagacttcaggccaatcagcctaatccatagtatcgctaagatcttctccaagatgcttgcattgcgactaaggcctcatatgcacagcttgatttcgatcaaccaaagtgccttcataaaagggagaagcatacatgacaacttcctcttcgtgagaaacatgactagaagataccatcgattgaggcgggcgatgctgctattcaagttagacataactaaggcctttgattcagttcgctgggattacctgctagccttgctgcagcgaaggggtttcccaacaaagtggatagattggttgggggctctgctatcaacttccacctcccaagtacttctcaacggcttgccagggcagcggatcaagcacggaagaggccttaggcaggggaaccccctatcgccactccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgacggcgtccctgtggtgagggcaagtttccccatcaagtacttgggcctccccctagctctgggaagactgcggaaggtggacttgcaacctgtctttaacaaaatttccggaagggtagcaagctggagaggaaaaaacatggcagcggctggaagaactacgctcgtcaaatctgtgctaacggcgcaaccaatctaccttctgaccgctctgaaaatcacaaaggaatccctcgagcagctagacaagcagcgacgccacttcctctgggcaggcacgggtgatattaccagagggaaatgcaaggtcaattggacaaagacgtgcatgccaaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataggggacagaaacacggtgcgattttgggagtccgcgtggattggtgggcgaagacccaaagacctcatgccgcttgtctatgcgatctcaaaaaacagaggaaaatcccttcggcaaggaaaggaggaggacgcctgagtgcaagatttgaagcttgattcacaatcatctatcacagtcgacctcgtcgaacagctagtcgcactgtgggaagcggtccgaaatgtgcacttagacgttggagaacaggatcagattaattggaagttcacaaacaatgggcattacacggcctccttggcttaccatgcgcagtgctgcggggcgccgagtacaatcttcaattccttgatttggaaagtgtcacaccccaatctgataccgccgtacaacggcacctgacaggagcgtgtcgtagggaaacggtgcgaaccgcttcctacgaaaccgcgatctcggtaccagtcccaggacatagtgctggtactcacggtgacaaatatgaatcatagcaatccttaaaataaatagaggacttatttaccttaacttaggttgcagctcagaacaacccgagaatacaaccgacgacgcggacgagaaaacaccaacagcagcagcagcagcggaaccaacggaccaacacccaacaccacaggcgacggctgggaaccaggacgaaaccctaatcttcacttcactttatcttctcttcagggcggaggaactatatataaatatttatatagagcaagggtgagtactttcgtactcagcaagtcacgggaacttaggtgtttaatgcaagcttgaaagagaggcaaggttgttttgcaaatcttttgtttgaaatcattttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcaaagcaatccgcctccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcatatccgcccatgaccgtgggcacggctgttcgaacagttagttaacctctgcagaggggtacactttacccacaagatacgaacttattccgaacacccgtcggtatcggaggttcgcaacaaagcttttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaatggtgtttgtgggatatttggtatacgcgctcaaagagcacgaataccgaggtaccacaagggtggagcgacaaggaatcagggtattacgacctacgaaaattagtgcgactactgggtaggtccgtcggtttggcacgcaaaccgaggccaagcaagttaagtgtgtgattctactaatgcatgttgcaaacaaaataataatgactttgcaattataggggcaattggtcaaagggtgacttgccttgctcaaggtcttcacgaagcttcacgaatcttcgagaaaacccgcgatcgacgaaaatccggtaaccgcaactatacacaaacaatcgaaaacctaaacaaaagaccaagaaaaggatcctatttagactaaataatagtgccattaaatagatctcgattttacgggaatactggaagtggaacggggtcaatcggaattacggatcgggagatatgaattttggaagtttaattggagtttctagaataggagaaatggtttatggaatttatagaaataatattctcaagaatattattgacagtcacggacgtgcgggaccaagggaaatgattcatggaaattttggaataaggaattgatttatgggacaaaggaaaaaaggatttattaaatccctgaaaaaaagaaaggatggagggatgttaattggacttgggccgaacgaaggggcgcggcccgaagagatgcgcgggcgcggccgaggcgagcgggccggcgcacgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcagtggaccgggagacctttgaccggtctccgcggggccgggcggctgaggtggcatccacgtggatgccacgtcggatggggaagggagaggaggccgggcacgctgatccgatggccggcgatgagcgacgtgaaccggcgaacggcggcgaggtggattggggggttagcaccagaagagagaggaggccaagggggatcgattcaacggagcggattagccgggggaaaaacgacagcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggctcacgcacggcggcgttaggcggcggcggaagcggtgacacggcgcggagacaagggagaaggccgacggccttggggcagccagggggaggtcaaggggatccccgggagcatggcggcgagaggaatcgacgcgagaggagccgacgacggtggattgcggcggcggcaatcaccggagatcaaaaggggaaaacacgacgagacgatgagggttcgattcaaaggggtgggagcatctccggggttcaaggaatccgtttccggcgtcggattggacggagcggcaccgagattggctggcgatgagaggcggcctccgggacagagcaagagcttgtggcaagctatgccgaggggcggcgggcgcggcgcatcgtgcggcaggaggaggatcatggtagggagctcaccaacgaagaggaggcagcgttggcggcgcggtcggtgtcgcggcgaggtggtcgcgacgccgaggcggcacggcaccgagagggcgcggccggggaagaagggagggagaggtggtgcccggagctcctcgtcacgcgtccacgcacgcaccggctcctccggtgctcggcaacggacggcaacggcgagagcgggacaagcagcaacaaggcggcgacggtggttcggcggcaatggcgcggtgggtgtgaggactgaggcgagtgaaaacgagagaggaggggtttggggtggcttggttttatagtggaggaatgtcggtttgggagggggaaccgacatagagcggtcgagcgctcggctggcggtcacaggcgatgcaagagcggcggatgccgaggatgcaaggagcggcgaaggcgatggatcgggcggctgaaatcgaaccgctggagcgcaggctggcgcggtcaaggtgggggcggcgagctggcggtcgcgcccgtggcccaggcggtggcaggcggtgacaccgatggtggtcgggcaaaaggaaaaaggaagagggaaaggagggcttgacccttgccgaaacgggaaaaggaggagggagaggggtgtgagacagggggaggagagggagagcagctgcttctcctactcttggatgggtgcggcgtggagtggcggagcggcagcgcacgacgcaggcgacgccagggcttaacgcggcggcaaccgggcggctgcgcggcgcaggcgcggcagggctgacggcggcaacgaccggccggtcggccacgcgcgagcgcgggagagagtgaaggcggtggcgggttttgggcggcgacggcgggaagcggcgtcggcgcgagagagagaaagagaacgagagagcgagagaacgcccgagagagggaagggagagagagacagcgctctctctctctctctcggtggtcacgtgcggcgcacgtggagatggagagagctgagaagagatgggccagcggcaggtttcggcccaaatcatcacgagggaggtaaagtagacttttactgagaaagctgatttggatagaattggagagatttagggtttggattcgaattcaaatttgatattcgaactcgagggtttagggatgtatcaaggggaattcaaggagaagtcatgggaaagattcaaaaggaatacttgggtatttgttctcgggaacatagggtggagtcaaggaaggaaacaaaacgggggtttggacattttgggatttagaaatgtatttggcgaggattcaaaggaagggattgactttcggatttagatttcggagacttgaattggaagaggaaatttgaggcggaggattttgatttcgatgagagggaacaacgggatttgatatgagatctcggcacgacttagactcgcacacaaagaacgaaaattttcgcaattaggattttgccgaattagtttttaacgactcgcgaaaggcggagcgttacagaaagcctgggcgccagggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacatcaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggctgcgtgagttaatcccgcactctgtatagtgtacagctatagtggctctcagttttccttttacccctaggggtttgtattttctcctgctctattcaatgaaaaggcactctagtgctgctttccgttaaaaaaaattagaaatatagtgtcgcgagcagtatatagttataccactgctatcttgtgttgttgtggcgtgtgtccctactggctccaaggctggcccgttgatgactgatgtcgtgcgtgccatgcaccagctcgatcgtgtcgtccgtgcatgcatgcgggctaaccacaaaggggaacagcaaacctgcggcacggacacgcacataaagcagatcacgaggagcaatacggataggccactcctgatcaccttgtctttgattgagagagaaagaaaagggcgcttagatcgatcgatcgatcagacggctggggtttggatttgtgggctgcaaattgcgatccgagagaggggccggccagccaggcttgcgctgctgctaataccagggaggcaaaacgggcagaggtcgacggtgacatctgcacgcaggcatgcatgcagatgtagtagtagaggcctctgcttcctctgctgcctgtggctcatgtggtgtttggttggagaaactaaagtggggctaaaatttagtctctctcacaaaaatatatagggacttatgttttttagaaagcccctctctcccaaacaccctctcaatgatctttgctttgccatttgctctgtgcctctgcaggcctctcttctctgtgagctgtgtgtagactacggtttatctgtgagctgtgtgtagactacggtctacggctcgaccgggtaaaaaatttacagtaagtttggttagctagttcacgggtccccggccggtgggccccataggtatatacctctctgcagccgtacgttggcagcagcatgcagcgcatatggaatagcagcagttaacatatccacaacgccacctgcagcgtagtgcatgacaggaccgatacatacatatgctgatagatcatatgcacgtactcagtctgtactgccatcgcgtacgtagcgttaaaacgtatggacaggcgagtagtacatgcggacgagggcccaagagatttcacgagtacatgcgcctctctggcccccaagtccccaattggtccaaatccaactaccagttttagatttcaggagccagctgcatacgcagctctcccggccagttggtccaattaacttgtgtgagcgtgcatgcatgcgggttgcagtcacttgcagagcctctgctcctgctcgcgtcgcatgcatggcaccgctgggcttgttcgctcgctcgctagctagctagctcattcgccagtgcgtgcgaagcagatgatgagatgatggagcagtagtggagtattaataagaccacaggttcagggctgagatgatgacgatgatctatctgcttcctctcttactagttttgaaccacctgaactggccggtcgcgagtgcgcatgcatgcatgcatgcaactggacggccggcggcggattggcggcggctcgccagtttgccggggtgggagagtcaaagagcgcatgattgttttgcatgcgccggcccgcggccggatcgtgcgtggattgcaggatgcggtacggtgcgtccgtgcgtgccatgcatggcccatcacctgttcatgtggaagaggagagcccactggccagtttgggagtaggaacgcgtcatttttccatccatctctctttttttttaatggaatttttccaaccatctcgtttggtaagagaaaaatttgaaggaatttttagtactcctttggaccgaaggatgcatg

SEQ ID NO: 57697 - DNA, 25972 bp, Oryza sativa
tgattgtaagatcaaatcagctggcacccccttgacacactcgaggctagccttggacctgcactggagttaagcaaatcttccaggccgtcatgtttcaacacgcttttagcacgcctagtgggacactcgaggctagccttagacctacactggagttaagaagatctctcaggccgccgtgtttttacatcaacaagatgatagctcgcttgttatttatttctacactttcgcactctctcttactttgtcctgtggtttgcggtgtgtttgttgtgttgcgttcacctttgcagagttggctgatggacgatgctccacttcatgcatccctaggaaatagtaggaggagcagacggatgttagggagaccacggcttcggcaatgacttttgtggaggtcgttcactatagtcgaggagtcctcgacggatgctacgcctctaggtcatgtgattcttgagttgggggggtgctctgtcgctggtgcagctgacacaatggaattaattggtcgggaggcaacgactggatctagaggtcgtgttgtggcatgctaggcctccaccgctgcacccatttttctctttcattttacaacaacaaaaaaaaattgcccaatcattttatgtaacctgacaacttgtaaaagttgatgatttatataggccttttgttagatgtaggcacttgaactgtaagtggaaatcaaggaatttatacaactagtgatttatttagaggtttgttaacagtattatgtaatttactctctatgaagacatgtgagggtgcctattagacgcagttacgctagggagacgaaacatgatattttataataaaaataaaataataggggttgaaagttttagatttggagatgtaagtttcaaaagtttaggtagagattttaaatgctgagttgaaagtgttagatttgaggtggaagttttaaattttgatttaaagttttgaaatttggttaatattttttaagaaaaattgagctcgttgttttattcagactcttattttttttcaaatttaattttcgttaaaaaaaatcacgtatgctatatagaggctggcgttttcagcgttcagtgcacatccctacatgactcggaatcacgtaccacacttatcgcgtccacttgcaaccccgccccctcccaaatgatattattcctagatgaaaacctatgtcatgttctttgttgattaaatcatggtaacttcaatacgtaagtgtatcattttctttatggccgttatttttggagaatctcaatacaaaatagtccatgtcattctaaaatataacaatgttttcatctacatttattttctcaaccaattatattttttcactatttaaattccctagctacctacattatcttctcaatcaattacaagattttcttatttaatttcctcaactttcttaattcatgtcgaaccttctaaactttttttatattttgggaaaggaggcaatacgatgggaatgggaaagaaaccttccgatcgaaaatcaacagctagctacctagcgctagctgtacgtgcaactgtagtaaaggaagaggaaacagcagctgcagaattgcagatgctaatggccgggcgtgcaggcaaaggacatcgcgagaataaacagcgagtactatactcctaccgagaagcaatagtaaagccagcaaaatatgcgcgccatcgctatcatccgtcgcctagcttttgcgggctcgcgcgccggtagctacgcagttgcccttcaatggttagccgccggcagaggccggatggacgaagggccggcggcgctcgcggccagtattgatcatcgtgatatcgaatccggtgatctctgcatgtatgcgtgtattgagggcttgtttgtttcgttgccaccacgttaaccctgtcaaatattggtaatgtaacaaattaaatgtgtacttaggaatgctatttaacaaaactttgatattgtagaaattttcactcttgatttttttctaaattttagtaaaactgtaaactgaacacatctaataaaagttggtaatctaataatgtggtggttatgttgggaagtacctacttcatctatcctaatatatatagcaacctagaatgagatgagacacctagaatgagatgagactcattctagaactataaatttcgacatcgtttctgctaggctgctagctagttgtcgacaggtttttcaggactgaaaacattcaatttgtttggccgtcgatcccgcgctaagatttgtgctgagatattttgctattggatttgaactctcttttcataagctagtgacactagccagtcccaccatcgcatatttataacagatttgttcaagttacatcctagttgcatgtagttaaactatagttacactatagttacataactacattgttatctctatataaattagatataaagttgcatatattattttaatacatatatacaagttattattattgttatagtcaagttattattattgttatagtgtagttttagtgaaattatatactatagttaaatttgaaagttttttttttaaaaaaaacttgtgatagttttttttaaggtaatctctttggacacgcccaatatttagatttatagctttaggatgagtctcgttcgatctaagattactatatactggaaggaagggaagggagtacaaaataatgaacaagccctaaaggcacccgcggaaaggcgataatactagcatatgtacgtgctccggtcgatcttaaaaacgctcaattaatgcattaagatggtcaggtcgataattaaagactgagactctgagaatagcgcaggcacacgatcactcgtatgcagttgttcgcacttgcgaaatctctgacgtggttatcattatgcatcccaattattggcatatctctcgtgggagttgcggtattgcagatttgcactagttatgtactactactactacacttttagatactccagagtactagtcgtgtgtgtcagacatggagcggtagcgctgcaatggcaaacatgcgatgttgggcgagttaaatggaggcactgcacaggccatagatgggggtgatacgatcggcagagctagctgcatgcatgtctagctagctctagctggatagtatcatctcgtcagagcgctggctgacagtgcaaattaatatacagatcgatcgacttcatcgccgtaacggctgcagggcaggtacgtaccacgtacgtcgtcattaaggttgtattcaaattaatttgtagatatatccatgcatgcatgcgcaggcagaaagcgtactaactatagtaatcccggatcccgatctatacagtatatgctaatatgcagtgatcgatctatatatatactcctacatttgcacgcagctgtttaaattagccagaagatgtcgcagcatgcagtggcaataattcgtagtttcgtactagtgttgctagctctctgcatgcacatatgcaaacagcaagcggtggcgcgcggggtacgtacgctgctctttacaggccaaaaggggtaggccgccttttggagctaagcagcgagctagctaccgatccgcgtcggatgaacagtgaggcagtacgcgcccccgccaccgcggaccgcgcgcgcgcgtcgcgtctcgtctcgtctcgtctcatggatcgatctgtctgcgtgcgtgtgtgccccagatcgatggttcgatcgcatcatatcggtccagctaactgatcgatcgaggacttgtgcatgcgcgcgaaatttaattaagctatggaccgatgcatctatggcgctagctcgctcgctggctctgtggctaaggcgactgtggctccgtcacgtgaaggcttgtgccgatcgattcggtgcagtatggtatggtctcatttggccttgtgggtgtgtgaatgtgatcgaccagagcggcagaaagtaacagggtcttcttacaaccgttggcaaagcagtggatcgatcgatgatgttcaacgctggtaagaatgttgggccatacgagctgtggttggccttacgttttgggccgaaaacccaatcttgtagccggccggtcccttaaaattcgctcaagacagaaaaaaaaggaaaagtatcagagccaggtttcgatcctgggacctgtgggttatgggcccaccacgcttccgctgcgccactctgatttggtgattggattaagaataaatatataaataatacttggtctcttatgtctacaactccaaaggaggcctagagtctagagatgctgtgaactgatgagtaatcgtgcggacaaggcagcagattgggcagggaccatcgacttgtgagaaatcagcaatcactaagtcggaattttatacggttttacataaaaaacctttctacatgtgcaatcatgctactagccacacaataatcgagcttacctaatccttctttcttaccggtacttttagtacctaatccttatcatgggaaatgccgtgctgtacctctgcaagctgcaacagcgagacaagattctccggaaaagctcaaaaagaaaaatatgcaagaatcatgtcgagagaaacgattctacatccctttcctggtgtttggataaggtggatgtgataatgtgaggcttttgttttaaaagctacttcctccaccctaaagaaaatacaattatagcattcaaaagataataaatcagcagggtaaaaataatctatatgtccctcataaatgagggtgattgatagcgggactgcgggagggttgttaggtacgatgaacaaaaatgaatgaaaggtagttagagggaatttttttttagaattgcattttttttaaaaaaataaagtttcaatgctagaatcgcgttattatggcaaaagtgcagctttatacttatttttccaatttttagaattattttatgaagaaaaaaaattagaatccacaacctataactttatatttgttaattccgaatttctgaatataactaacaggataagaaagtaatgaaaaatgtaagtagattctatacatagttttatagttattaattaattacaagcactacacgaaggaagatatcataccaactacaaatatcagcgaaaatttggtactttcaatagtattatagtattatgcttatctgtagagtgttagcctcaaattcaacccgtatcaagaaaaaaaaaactttgatagttttatgagtataaacatgtcatattttttatatatagatataatattattgaaaatatatgggacaatttcatttttcccccactttgacctctaatattgattttgcctactctttagagttttcgtttttacctccacttttttaaccgaaagaggcgtttacccctggtttggatggaagttagtgggaccaggtttatggcaataaaaatgagaaataaaggaaataaagattttttgaattagttatttactcttttacccctgtgaaagagttaaaactaatctctcctctcctcacctctcgctgcacatggtcaaactgagacctagccggcggcggcgagcgggtggtggcggcggcggcgaagagcatgcgtcggctaggcgcagctcctcccggcgcgagcaggaggcgagcgtgccaggcggcggggagagggcgacgcggcggtgagcggccggcggccaagcagcagcggcgagcgggccaggcgcagcccctcccgccagtggcggcggctcgacgctgggaggatgcggtggtggcaactcggctggggaggaggcgacggtgatggctcggccagggggcgacggtggcggctcaacatggggaggaggtggcggtggcgactcagcttggaaaggaggcggcggcccggctaggggtgacagcggcggtggcccactggcccggccaggaggcggagaggaggaggcggcggcggtggcccgtcgacccggccaggaggcggcgacttgtagaatatgaccttttttttttccaaattttgtccttttttttcaatatttgtctatatttatcacatttgtatatcaaattttgaaacaaattggtttacgaaaattgcaagatgcaaacagaactaatgaacaaaataggggaaaatcagcacagtgagggtaggatgtcttttcgtcaaagatttaacgccgttaacatgtccatcaaaaataggggtaaagcttaatttcgttttaaaaaaataggggccaaaacaaaaaccctaaaaaatagaggcaaaaccaatattaaacatgaaagtaggggtaagaatgaaattgccccatatatagattcaaagaaatatatatagatataatattactgaaaatatatgtatagtttttttctaagaacttttagtgacatttatcaactagtgtgaatggtgtgtgcacgtgaaaacttgtatatataggatacattcatatcatacaaatattacataataaagtagaggacttccccatacaaaatagctagttaaatattggatttgtgataatactctttgcgcatatgtccatatatgcaattatattttgtatagaatagatcgatatttgaatctaggattagatttaatgtacaaacttatgtttatatttgtgtatacaattgcatctttatacaactatattgccatcgctctatatcattatggtttggtttcatcacgatctaacggcttaatattttttattctatgtggcgaacatgatatatcatttccgagatatattgtatatttaggttgtgttcttcaatgtgttggaaattaacccttcacacacgtaaaatgaagtaatggattaccgcatgattaattaaataatagtgaaatgagcgtggctcaactggttaggttccttgtggtggaaccaactcacccaggttcaaattcaagattgacacaggtgcttgcatttacggctaattattcttttagtgataggcgacgtacctgtcgatagtgaagtgacaacccaatcttccggaagtgtttatagggggtagggtagatatgcgacatacctctgttgacagcgaggtgctagcacaatcttttagaggtgctcatagggggtagggtagatatgtcccaatcttccggaagtgcttatagggggtagggtagatatgtgacgtaactgttgataacgaggtgctattttccgaaggagcttatagagggtagggaaaattaagtaatagcttaaaaatcctggaaaatggattaatatgatttttaaagcaacttcccaattttctgtatgtgctcatagggggtaaggtagatatgtcgttcagttttccagaggtgctcttagagggtagggtatttatttattacatatattatagtaaaaaaagtcaaagatatattttgttattcaaaacatcaagaaatatctactattatttattggttagtgttgttaaaggggtatttggtttgtggcaacacaattattagtttgctccctgagcgaaaagcaggcaaacgccttcgtaattagagagagagaaaaaaaaaaagcaggcgacgccagcactgcagggaagaagaggaactgaagcctttctcttctgtccgccgctgcgccctccccctctctgtccacgttcccccaccccacctcggcctaaaaccctagccgccggcggagcgggacctcaccggcggcggcgatgagcgggggcgggccgccgaagaaacgcaacttcaagatcgagctgttcaagcaccgcgtggagctcgaccccaagtacgcggagcggacatggaaggtcctggagcacgccatccacgagatctacaaccacaacgccagtggcctctccttcgaggagctctacaggttggtacaaccccccgaggccccgcactcccatgatcctcccgcctcctgccgtcgccgtcgcgtttcccgcttggcgacctagatcctaccgccccggccctaacatgtggttaattagaaaatttcagtgtgccaattctaataagtttgctcctcttgagatgattaatgattatgattactagccgaacattcctgtcgcatatgttgatggttgaaagtgatttctttcgagagaattctcttttagtatttgtgatcctacaaattttcgttaaaatacagaatttttatagtcaacgatcagtattagggagattgggcggatgttaggtgttggatattgatgggttactccatctagtcatctgtagtattgacttagttgttggaagccatgcttgtcggcctctttggtcgtcacagcaacttggtgataaataactattctgaacctcacttgattgtaatttgcaatatttcctttcatctgtgcaggagtgcctacaacatggtgctccacaagtatggtgagaagctatatgatggcctggagagaactatgacatggcgcttgaaggaaatatcaaaatcaatagaggctgcacagggtggtttgtttctggaggagctgaatgccaagtggatggatcacaataaggcattgcagatgatccgagatattctaatgtacatggatcgaacatatgtcccgcaatcccgtagaacacctgttcatgagcttggtttgaatttgtggagggatcacataattcactctcccatgattcatagtcggctgcttgatacccttctggatcttattcacagggagagaatgggtgaaatgattaacagaggcctgatgaggagcataacgaaaatgttaatggatcttggtgctgctgtatatcaagatgactttgagaagccgtttttggatgttacagctagcttctacagtggagagtctcaggagttcattgagtgctgtgactgtgggaactatcttaagaagtccgagagacgtctcaatgaggaaatggaacgtgtctcacactacttggattctggcactgaggcaaagataactagtgtggttgagaaagaaatgattgccaatcacatgcatagattggttcatatggaaaactcaggccttgtaaatatgcttgtagatgacaaatatgacgacttggctaggatgtacaacttattccgaagggtttttgatgggctatcgacaatcagagatgtgatgacttcatacctaagggaaacagggaagcagttagtgacagatcctgagaggttgaaagacccagtggaatttgttcagcgcttgttaaatgagaaggacaagcatgataagatcatcaacgttgcttttggcaatgacaaaactttccagaatgctctaaattcatcctttgagtacttcatcaactaaacaacaggtcacctgaattcatatcgttgtatgttgatgataaacttcggaaaggattgaaaggagccacagaagaggatgtggaggttattctggacaaagtcatgatgctgtttcggtacctccaggagaaggatgtatttgagaagtactacaagcagcatttggcgaaaagactattgtctggcaaaactgtttctgatgatgctgagaggagtatgatagttaaactcaagacagaatgtgggtaccagttcacttccaaattagagggcatgttcactgacatgaagacctctcaggacactatgatagacttttatgccaagaagtctgaggaacttggcgatggcccaacacttgatgtccacattcttacaactggttcttggccaacacagccctgccctccctgcaaccttccaactgaaatccttgcaatatgtgataagttccggacatactaccttggaactcacagtggccggagattgacatggcaaacaaacatgggaacagctgacataaaagccacatttgggaaaggtcagaagcatgaactaaatgtatccacttatcagatgtgtgttctcatgctgtttaattctaccgatgggttaacctacaaagacatcgaacaagatactgcgatacctgcctcggatctaaagagatgccttcaatctcttgcttgtgtcaaggggaagaatgttctccgcaaggaacccatgagcaaagatatatcggaggatgacacattctacttcaacgacaagttcacaagcaagcttgttaaggtcaagattgggacagtagtggcgcaaaaggaatctgagccagagaaacaagagactcgtcaacgggttgaggaggacaggaaacctcaaattgaggctgctatcgtcaggattatgaaatccaggagggtcttggatcataacagcattgtagctgaggttaccaagcaattgcaagcccgattcatgccgaatcctgttgtcataaagaaacgcatagaatctctaattgagcgtgaattcttagagagggacaaagcagataggaagttatatcgctatcttgcatagaaggtcattatgtgattattgatgagcaaatggcttgtattcatgtaaaacggtttccatgacgtttgagttcagttttattcgttccactttgtccactgaatcatagctacttctcgtttcccgtaggcaagctggtgttcagagttttccagctaatactgatgtcatgttacgagttgctgctatcttaatataatggagatggatcgtcaaattcacagccaacatgaagatgattcccggccggctgcttcctgatcttgcatgagacagtaatcgtcacattggcagacaattatctttgccgtcgatcccaaaatctagtattgataatttcacaatgtaagtcattctattatttcccacattcatattgatgttctagattcattaacatcaatagaaatgtggaaaatgctagaacgacttatattatgaaacgaaggtagtagtatatttttatacgaatatgttttctcttgcccctgtcatgcagctggctcgctacaataacagatggtctcactctcaccccctggagtttgcactttgcagcaagtctcgcagaaaatgttgtgtgccaacttgaactgctctatgttagtcactcaatccagactccatttagtactaattatgtgccattgttgtgaatatgtattaattaattataaattatgcagagagcgcggaatgagactcatccgccaccatatatgtccggttgtccccgtttaaatacgagcgttctgcggttctcaacttgtacgtgaccgaatcaaagttaacaacgtaatagtgttacctttgtctacgtatctgaatacaactttgtctcgttggttaattaattactcctagctagttataatctcgtttgcatcaggatcgtttcgagagcggcaatcgagacatggagccgccgacccaggcacaattagaagccgaggtcgagggcaactactgccgctcaggagtgcccgaagggagacgcgcgttcgcgatgaagcggcacttgtacacgtacgcccacgcgagcaacatgatcgtccagaaccgattcggcgtgtggtcgcatcgagaccaggggtacatggcgtacatcaggaggacccgctacttcaagttcgtcaagatcggctgggggctctcgaggctgaggcgggtgtgccagcagcacggcgtgttcgcgtggtaccagtgcacgccgcggcgggaggagttggaggccgcggaggccggcgtgcggaggcttttcagccgccacacgcctgcttggatgaagaagcagaagcggctgcagagacgcgagcgagagcgagatgagcggcgtctcaacaagcagaagcggcctctcgcattgaagcagcagcagcttaaggcgcaggcgcccatgacccgtgcagtactactgtttgcttatgtatatgcatgtgtagttaaactttgttgttatttaagaagaattattcgtgcgtagcgtgtagatgttgttctatctggataaaatgaagacaatgtgtgtttctttctttgaagacaaaatggaagtgatctacatcttcgttattcagccttgacaaaccatcatattcctcttacaaaagataaactactataactttcatcgctaggtcgtcacattatcaacgcgagaatatgctcaagttcttggtttcctttttccttttctttcttttttccttctttttctccccgatccctccctttcttctttgtttggccacccgtatagattttattcctcttaatataaaagtgtacaatctttttacgtattccaaaaaaaaaaatttctataactttctaaagtcacatagattctatcccgtaactctatatgtactactacgataacttacttggctttgtttctgagactcccatctgctaggtaggctgctctgatttgatcatttgagtctcctgattcatttgaaccgctgtatatgtacgtataaaagtacgtccgcagcacgtgtggggtaatcaactcctgtccgggctgaacaaattgcgctcaactcggcataactgcataaggctatgttcgattaatcctaaagaggaagggatttattttacattgtggtgtgaaattattccccctcaaacccctctaatctccttcaagccccttcaaaccgaacaaggaagaggggaggggtaatccctttcgggcggaacaaattgtgctcaactcggttgaacaactttaaattgtgctttaaactccgcataaggaaaaaggcatgcatggtgcccaggtttagaactagtactagaaaatggagtatatgtaagaactatgaagtcgtttcagcttagcaattacagaccagagatcgacagaagcaaaaacaaacgacacatggtctatgccttaacttcctccaaaaaaaaagagagagcattatcttctgagagctcgaggaagaggctgctggtaagagccatctgtctgctgctgttgatttgggagctccccaccaaattgctgcatcgtcggcaatgcccagacgtgcactatcaaatccataaagcccccacaaatatgactctaaagaagagagcccacgatgcccctgcaagctaaacgagaaagaagaagccgacatgctctgcgtgagctgaagtggtagattgggtaaaccagtctggccagcagtagggaaccctgatcaagaatactcccttcacctggcaatgaaggaccagcagcttgggataggacatactgaacaaatgaagaactcctgagcaatgccctactagtagagagcgatgcactactagtggtagtagcagcagcggcttgagtagcagaagtaacacccaaatgaaggcatttccctgatattggtaagtgaatcttaaatcaaggattagctggaggtggatctgcagtctcgttagctcggtgatggaacagtttagttatcgctcttcgttcacaatcctgcttattgatgtacatcttattaaacggtgattaaactattctttaaaattgttcataaaaaaataaagagatttttatggagtttcatgttgggacataaaagtgtaaatgcatggactcctatgttttgtcattacaaactaattcaaaccacagcagcagaaattcagcaaggaaaagaaatgctttaccagaaattttattaccttaaacatattgaggtgaaaaggttttccagtgttcattctccttagcttcaggtaagtatatgcaaaactcaactgatctcgtgaggtgaaccggttaacctcattaaaccaaaggcatgaaaacagattagacattggtgtatgggcacgtacaatgaaagatccttcaggcacatctgcacaattgtgatgtaaaagatcaatactgaagaaatattcatactgggtaatttatcagatcataaggtaatgatacgaacaacttggaagaacaggctctctgccagattcattgaacttcacaagaccatcagattggtaaaagtaaaattgctcatcaatagcagtgtggttgtacttgttcagtcgcttgttttgaagcacttcctccgagacacaagtacgatcatagtgcactgaaatggcatattctgctttatttctccataagaaatactcaacgataagcattggatcagcattaaggcgcagtttactatccaaccaaatagagtacctaatgaagtacaaatcttttgttaaccaagtagaggaaacacggatcatggatatataggagattgatatgtaggaaacagttgaaagaattcacaaaaatcctaaacagcatagggagtagttaggacttaggaacttaggatgctttttatcaacttgttacatggtaagtaaacagtaactattgttgatttagaatttataacatgtcttttattatagaaatgttcaactgcaaataggacaatttagctttagccaattaataaattcctcatgcacctaaacaaatcctacatcactaacaccaaacatattctccatgaaactaggcaagatacatattgcacaaacaaaaacttacattgcaaaggggaagagtctgtgagccagaaattttggcacctttcctgctctccgcatatctttgtacggtaatttttcaactacaacaattctccacaggccaatgaatccagtttcatcagggccagttccttcagaggacagagttcccagtgttagctcatccaggaacatgacgaagcatacattcttcttagagtatggaccaatctgtgggagttcaaaccggtaatgtttaagtacagtctaaccctgcctattgttgaacttataaaatatcagcaaaacatacaatagtcatggaagttaaaaaaaatacagagagatttaaaaggagccaaagatagtaattaatgtactagcatgagggagataaaactccaaaagaacccattactcgcaaattaggtactctcagataaggtacttgctataatacatgtatacaagtatgccatgcacctaaaaaaaaattaccttgctcttagttggtctccttaagtaatcagagcttccaaaaatgcatgatgaaacaacaacacggcaggaagccatataaatcttgtcattttcatccagatcaaatccagtattagggtaatcctctggtccttgcacaaaaccacagtggagggtttggtttcttgcgtagtatgtctcttctcgttcctgaaggctctggtgtccaccaaacaatggttcaaaaataccattactagatgatacattctccttcgagatatagttcaaagaaaaccctgtaaagttgttgtagataccaggctccactagatcatcaactgatggcaaaaactcaatttgacatggtacatctgcaaaaattcatttgataaattaaagcagtatgcacgatggaagaaagcaatagcaaatttaataaacaaaaaagaacagcattcatgtctgcatttagcatatgagtagaattgactagaaaatctcttatatgagtcgtaagaaccagaactgatgctaacttgtactatacatctgttcagaaatataaagaaaatgtgtggtcaaccttgtctaattttgactaccaatatataaaaaactatttgaattggtatgtgaaaaatgatactatcatattttcataaaatatattacagtaatacatatttttttacattttttatagaatatactcaacatgtcataacccaggagtaacaagaaacattaatcaaagtagtagatattctgatccattaggtagtactactacaaccaacttgccgctggctaggcatttggcagatacaagagaacaaaagatatgctatctagtctgtttagaacaaagtgcatctaggataaagttggataagatatgttttattgtatttgattaaaaagtaccatattttaggaaactcaatatgtagagaatatagtagagaagatctcttacaatgcttgcgagatttctttcgtcttttgaagggttccgactcaactttagtcctgacatgagaagttaatcctatgactgttgttccatggtagccaaaggaatgtaaatacacacagatagatattatttacatatgaaaaaaaatgacgaactcacatagacaaatttgccttaaccttagcatcgagagtttgtctttgatccattctctccttaacatcctttatactagccatatcatgatgttttgctgtagagcatagcatcaaacttcattccagagaagtatgagaacattatcgacgaaagaatctgtttgtcgtcatttaaagttggtgagtttcctaagggcctacataattgtcgtcacagtccattcccttttctagtactgttgcatacaaacattacaccgcttctccttcccctaacaaatcaaaagttcactcccaaacctatcttataatgcaaatgtgtcacatgcttaaatttgacatgatgacaacagaaaaacatatttttggatttttcatttctgccacgcttaacttcctacacacttcaggtgagaatgcttctcggcctattccacccaatcccacgaattattgaaaacgatgaggagaaaacattctagtgttacgacacaaacccactatcaccccgcttttcaattactacattgcaagcaaaacgatagttcttgccctaaaactacggatctctagcagggtgatttgcgcagcttaccatggaaggggagattggggtgggaagagaaggagaggtaggcgagggagacaagcgcgagggcgaaggccgggaggacgagtaggcggcagtgacgccgctgccgtcgggggtgacggcggggtccggccgccgccggagtggatattggtaggcggcgctccggcatgccaccggcgcgctctccggcgacgcgtagaggtggcggttttccccccttctggtggtgccctctcttctcttgctttgctctcttccggtaaaattcagatagccattggcctcgtcacgtgtagacgtgtagagtgtagtgcaaacctttacccaaaaaaaaaaagaagaaagaaacaaatattgtcatctggttaaggcctcctttgtgaaataaatttcgcgggaatttcgtagaattccaatttgtaagaaacttttctatttggcattttgaaacaaaggtttagagctttttaaatcatatagaattctctggtaatggctaaatacatgtaaattttagaggatagttagcaagtgctccaacttgtattttcctttttgagtttatatttcatcttattcatgcatttcttttgcattctatctgttgacattttttttttactccgacgtatcgaaatggtcattcctatgtgttttccatgtgttttaatcttttgtttttgttttgtatatgtattctatcaaaatcatgtgttttttttatttttaatgttttaccattcctgcctgcgtttcaaaagggcctcaaagtgttgtatagatcgttgcccttcgccaatggtcctgactcctaagggtgtgtttgagaagaaggggattgaggagattgagaagatacacaaaacgaggtgagccattagctcatgattaattgagtattaattattttaaattttaaaaatggattaatatgaatttttaaagcaacttttctatagaaaatttttacaaaaaacgcaccgtttagtagtttggaaagcgtgcgtgcggaaaacgaggtgctttctccctcaatgtcctccaaacgaacgctgcctaagtgttgcatgctgaacaattttggaaaagggatctacagggataaagcatgctgaagtatgtattcccttatgttcccaactcttctccctcatttttcgcgtgcacgtttttcaaactgctaaacggtacgtgttttgtaaaaaatttatatagtaaagttgctttaaaaaaatcatattaatttatttttcaagtttttttacagctaaatagctaatacctaattaatcatgtgataatctatcgctccgttttccatgtggaggggaggggttcccagcccttccaaaagaacacagccttagataccagtagtactaaaagttttggtattgactattgacaactgattactctttttttccctaatgtgtggatcaaattttgaacttgattgtgtcaacattgctacagttttcgcaactacttttcgtgatactacaagtggaattacaagtgtgtgagctgccttgcacgaaagatttcgtatataaaaacttgagttagggtgtgtttagttccacgccaaaattaaaagtttgactaaaattaaaagtttgaagaaaaaagttgaaagtttatgtgtaggaaagttttgatgtgatgtaaaagttggaaatatgaagaaaaaagttgaaaactaaacaagggcttagaagcagtactgtgaaaacaacgcggttcatctgggtagtttactaatctagcattctgattgtaagccagtgaataaactagtagtacaaaagaatactcaaggcaaaccagtgacacagataatactgcatctgtgcactacggcaaaggaacgatcgaatgcaccacaaaagttactggcttactgcatagctgcatacagtgtaaatatcatcttctcttgttaacattggcatgcatgtaagctcaatacatgcagccaatctccaggaaacagatccaagtggatcttagtgctttagtattctttgatatagtacactaatttactcactataccttggtacaaggagaacccctcccaaaaggtaacagaagaagaatatagagaacaagaaaaacatcactatacgaacaaggtgataatttcacaccaacagtgtagttagaagatcagggtaccacagagccgagagtagtggaccgagaatacactaatcagtcttggtctgctctgctatgttgagtttaactggccgtgactcaaaccctcctccttttctgtgctcgatagagtaaggcatgtaagttccaagtatcttgtcccaaatgacaaaaaatggttgtgaaaagttgtacttgtttccatagagctgatgatgaatgtcatgataagcgctgttgttgttgaacagcgcatggaggatgttaccaggaagccacagaccacaatgatcatccactgtcttgatggttgcgaacgagaaaaagaatatggatgtccgtggtgtcataccagagacgaggaatgagagagcaccaccaatggtgtccaaaataagaccctcaagaggatggttgtaaagagctccaaaggaataagggactacaagagtgtggtgcttggagtggatatgtttatataggaacttgttgatgtgcatgtatctgtgcatgaagtactgccatgtatccataacgaacattgcaatggcaaattgcagcaatatcacaagggcagaaggttgcttctgttcaatatcactttcatcaccaataacctgcagttcgatagaagttcaacagtttgagaaccatacaagtaaagctattaggtaaactccaaaagaaatgtcaagatacaatattggttcaagacacataagcattcgtacaactggacattcatgcatatcagtttattttccatggacaccattttgatatacttcaatcagcatagagcagctgccatctcataaatatatttttctacttagtcagaaagcaacaaagcacggattttcttgataagcaacgcagaagcaaaatcaacacaagtatcataactttgctccctactcattatattcaaatgacttcttcttttagttatgtgcagcttccttccatacgaagtgaatacaaaaaatgtattttaagtagcaccaaagctatcctaccaaacaacacacctacagaccaaaacttaatacatgatgcgattagctcctatcctccgcatgttagcacagatgctgaggtttaaagattgatttattgagtgctacacggtgatggtgggccaaaacaatctaatcgaaatgcgtgtgaagcaatttttacttcattgttctccaaaacaatctaatcaagacgcatgtacaacaatttgcctattttacttcaaaattcaccccaagtatttgcatctctgcttctgcacttctgaaggaaaataataataaaaaaaaagcgattctgcatgtttcgcatcagattaccacaaagctaaaaaatgaaacaattcatccaaccaataactcgggtgcccgcatgctggaagagataaccggcggcgaggaggattaccgcgaagagggtgagcgagacggcgacctggaaggcctgctggacgaggacgcccctgacgacggtgcccctggagacgacgttcttggcggcctcctcctccctggggtgcagccggtacacgtccagccgctccacgccgtccagcgcgaggtacagccccgagtagagccagtacacggcgatcggcacgaacgtgcccagcagctcgtccgacgccccaatccccatccccccgccaacccaccaatcctcgggcgcaaaacacgccccccacaacgaacgtcgagccgggaaggccgggagagagatgggcttaccacggcgcagcgcggatccccccggcggcggcggaggaggaggaggagatgttggaattggattcgtggaggtggctggtggccacggcggaggggaggtatggataatttaggcggccgtcgccgtcggtccgaacgaggagaggagacgagggaggagaaggtggggaggggagggggacgggcgttggttgcaaaggggagcgtgtggtccgggttcgtgcgacgaaccgggcacatgtgcctgtttctacttctcgtgcaaaaaatctaaggaaatttcgtacgagttgaaaagaacagctaaacataacttggctaatttttcttctctgatttggactgtgtgatctatggtttgattgcattttttaaaatagtttataataaatttactggtgccagtaagcgcatgaattactgtacattttttaaaatagtttataataaatttactggtgccagtaagcgcatgaattactgtacattttttaaaatagtttataataaatttactggtgccactaagcgcatgaattactgatgctaatcttgaagggacgtatacagagctcaatccacaccatctcgtattttccaagacctggcttggaacaccagtaaacacatgtcgattctaaagtttctctttgcctacgcaagacatgaaaagctagacaacgcttcaggaggcaaaatcaatcgaaacagaatgtttctaagcgaagtgagcgaatcctggattccttcgcataaccactttagcagaccaggttagagccaaacaactgaagaacgatctcaggatcatttagctaagacaagacgtaccacatataaaaaatgaaagggcaggacgataatgaattccctttcacgacacaaactaaatactaggcagacagctaaataccgcacattttattttgttcattaaatctgatgaaataaaacccatgatccagtataaaggaatctatgttacaattgggataaaaaggaatcgatactctgcagcaacaagtacgattaacttgtagcctgactttcaagagagcaggagtatagtaccaggatgccagtacctacaccatcaccaactgacaataaggttgtctggggccaatttcagtgcactgggccactggggtgatcatcgatatgctggtgcaccagcaaaggaatacagggaggagaccggcgcaccaggcacgttaggccttgtagaagaaacaggcatctgatggatgctttcactgtaggcaggtcctgggttctcataggcagctgtcacataggacggaccctgatggagatccattgcacgagtggcaagtctataagaacggtagagctcatccacatgatccgagcgtgcgacaatctcttctggcactctgtaatctcttgcgaggaaggcctccctgtcagtagcctcaactatagctctgggggcagaactgaaattcaaaaggttacaaattcattaaacttaaaacagatcaaaagacttacaaataagtaaataacttcaaagaaaactaactcaacgaacgctattagaagccaaaattagcagccaaaattagcacgacaaagttagctataacaggaaggcacaattttctagcacatcactaaaacaatcatcagcactctgacagataaagctatgctcccttatatgtcaatagtaagaccctactcattaggcaacaactttcctcagcctccttaagataatacaccacagtcaattcttccttccttttatagatattgtcttgtacagctaatgagctaattgctgaaaattctagaattaaacatggacaggttttgagacaatgaattccagcagtagaaaactgagatccataaacttgccatcctgtggtaccttggaattgaaacttgaaaaaaaaactacttagttgattgctaaacttgcaataatttgttttttcagttagctaaaagtattgatgtgccttcaaaacatgtggagagtgcaagtagaacaagggtagaaagttccgtgtgaattgcgaagtgaatctgagttgcagtattgaatctcctatctacacggttactattagttcaacgcctctatacttttttatcgagctggaaagtcccaaaattcaatgactgcatcaacaatctctctaaattatccaaattagttttacacctccattcactctcatgtcaacgaatttaggtaataaaaaagttgtttgactgacgcaattataatttgaatgtttggaaaaacctaaaatatttctcaattatgttgctaagcggaagctaaaaggagccaccacatttttcctgttggcatggaaattactatattaatcgaggaaaaagagaaatatctattttctcaaccatggttggtccaaattacaattgtgtagattaatcaatatagttgtatacaaaatacagtgtacattccaaataaattttaatctagtccatgtgtaattgtgcggaaattgagcttgtttttcaagttacaagacataactggcatcattatatagtttacagatctctagcatagaggccaacaaatcatgaagatggtgaggagcaaatttagatagtttgctaataaaccaactagaaagctagagtactaaaatagcaaatctgccatagtgtcatcttgtgtcaactaacacaaagcacaatcgcatagtgaacaaaatatattaagaaacttttagatttctactcacaattcaattaagaaatattaagaatcacccaaaactaggattggacccaagtataagttgcatgcactagcctacaaagcttaatttgatgaggaaaggtgagcaatccaatatactttcaacatacaccctcatatgtaggatccacgcatgcattgagtggagtagaagtaagttgcactttgtaacttactgtgcttacttggaataactttaagacgtgttggccctaatatcaaattaagttgcatatatagcctattcatccaaaaagctcaagctaacaagaaaggacgcggagtcaactcatcatatagattgttttcaataatgagtgagatttatttaaccaagtttgccaaaaaatcaattagcacttagcttagaaaattcaagagatgactaaggccctgcttgattcagcttaggattattataatctggattattaggagtaagctgaaacaaacaagtagattattatgctagattattataatatataagccagattactataatccaataatctcctctagagaagctttttccagattattgagtggctaaagacccactacccttagatgcctctaataatccagagaaacaaacaactcgtagcttattttatgttagcttattataatccagcttaaagtaatctgatttaataatctagattacaataatcttaagctgaaacaaacagggcctaaagcactcaccgttcatacacgatatcaacttgaggttgatggtaccgttcgtcaaaagtatgagcaacatgatgatagtatgtgggaggagcatgttgaagctctggtaaatgagtcacatgccgagatcgaaatggatcatgcagagagtcggttatagcatgtctttctttaagaaattgtggatgacgaatatcttcaacatatcgtggtcgtcttctttcttcatggtcatacggtaatcttctttcttcatggtcatatggcaatctcctttcttcaacatgtcgtaaatgatgcatttcctcgacatgtcgtggcagtctccttccttcaacatagtgtggtaggcgaccctcaaagacatccaatcgtcgatgcctttctttaacatattgaatagatgattgaggcaagctaataggcttgaatagttctaacaacctatgaacctacaagatagcaccatagcttatgacatcagcacacaacttgatgtttacaatttaattttcttttggcactcttttaaaactacatagaagaatctccacaactcacttgtttaaggctgagttcctgggtgaactttccctttgaattgtagttctccttaatggcatgcttgaaactactctccggaagaggaaggcaatctttgtcaaccttaaatttgacctatatcacgtacacaagttagttggactacaatagtgtcacccttaaacattatccgattttatctactccctccgtcccaaaatataagattttttttgactctgacacagtctccgagatgctactttgaccaacaatatctataaaagtaagatgttttaaataaaaaaaagttgcatattatgatagtttgtttaataataaatctagtaacatcatttttacatgtttgatcttttttttatttttttgctattaatagtaagttgaaaatgtttaacttatcactatactaaaaatgcttatattttgggacggagggagtagtgtctatcatcgatgaaaaatatattagtatgattgttaaagaaagactctatattacctaaaatatagtaattcccacaaatagttgaaaaagggagaatgacctaccactctggtaggccatattattatattgatgtagattgatataagaaatgaagaacttcatggtagaattacatagagaactctaatgtagattgtaaagcaaaaggtacataatatttagcaaccactttagaaaataataatatattcatggatgcgctctagtaaaacacaaaaaacaccactatattgaatcaggataacccgaagttcgtgtgcaacttaacttggttccccgattctcatatgtatcatccatacgtactccttacatggaatttcttgcaaagaatatcattacaaacatattaaaagagtttctttctaggactgtatggacatactaagatgtttattataaatcaaaaggcccaaatggttataatactacatatagtttatgctcctgaaggttggagaaaaattaccaaactaattgttggtaaaattaaggtttggaacttacaactaaggcaattaactagttagtttctatttaacccaaggagaaatttgatcaaattttgagaaaataaactcaattgagagattagtttggtaggaaatgaactcgattaagatagtcctttctagcattatgaagtagggaatgagttaactcaataaacaaacttcgtcgcttactcttcaactaacataattagaacttcaaacaatgcctataaggaataaaaata

SEQ ID NO: 57698 - DNA, 758 bp, Oryza sativa
  unsure (1)..(758): unsure at all n locations
cgcgctatgaatatccttcccgtgaatccntnccanangcccaatnnnagctcggnacccagatggcggcaaatctgatcacatgctgttcaattataccataatttcaattctaccattttttaatccactgttctgttttcttaatggggtaacttaaagaggtttggtggtgtgccatggactcatgggaaccttttttgattagtggaggtttggtggcctcttggccaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctcaatgctggtcttgtcg

SEQ ID NO: 57699 - DNA, 685 bp, Oryza sativa
tttcacacttatttttaaattgattttaaatttacgaagaacccacgactaattgcgtaacgcagcgttgcttttttttacacgaggaaaccgcgtgcgggcgtgatttctgatcgctggcctccggcgccagcgatcggtcgcgcagcagccacccctgtagcggagcccactggatgtgtttaaaattttcaggggggaagggagggagggaccaccccctttcccctgaaaacccatcatcatcttcccttgatgggaactctagaaggcttccttccttgcttaatgctacaataccccgcttgaagtgccccatagaggttattcactctttccaaatcaccaaaggcattctattcggtagcgtagttgcacgcattggaaatctacttgtctgatgattactgcaactttgtctacagttcggaattttggtatttactttctcaaggttcgtcttattgtctttattactccccttaattttgttactttttcttgtattaaaaataaaaaattatgggttaacattgccttaatgaatattgtttgggggttttccaaaccttgcatgattaaccgtgtgtttacctttttttttagaaaagccgttataagaaagaggtaacgtggaagagaaacatattttaactcattcgttcgagtgttatctacggtattt

SEQ ID NO: 57700 - DNA, 84550 bp, Oryza sativa
tatatatatatagatatatatatatatatatatatatatatatatatatatatatatatatatatatatatatatatatatatatatatatatatatatatataaactaatttacatttgcactaaaaccggtggacccattatttaaatcatcggatctattgttaataatgtctaaagttctctttttggcccactgcacaatgcacgtctgcacctctacctttcgcacatgtgacaaagtgtcgtatttgaggcatcttgggtgatcacgaccgctgcagcgctaccacttttgttaatagcatgaaaaaaatattaaaggtgtgatgcagcgagagaagaattaagtaccgtggaacacttaactctgtttaagatgaaatcgagagtttattaaataataattataatatattgtgttatgttgtatttggattttgtattatttgttcgtacagttgaaagaaatcattatgttataattgtgaacacaatattaacgaatatcaatagaactcttactaggataagagtgttataagggagtttaaggccctattttttccctgattccatcttttgaattttcatttgcacgctccatgctttccaagttactaaatggtgcttttattaaacaactttttaactttttagaagtcaattcattcgtttataatctcaaatagctatcacataaataagataattcatcaatttcagttatcctaacctctaaagtacatattttttttcatgcgagtcatggtgataagtaaattggtgatcaacgcataatcaaaatcgtatgatgaatctgtaagaactactatgaccaattgtaaataggtgtcaaaattaattgctattaattaaacatctaatggcttgctagcgacatatttaatttttctctacatatatataaacatggacgaagctagaacgaatattaacatacatcccatacatatatattacatgttaatattctaattacatgtggtaagtccattaaaatttcttaaaatgccctcaagatgacacgtggtgctctaataaattagagaaaatattagaaattctaagaaaaaaaaaagcaaagtatctattacttgattttcacttgaatcgatgggtccaatagtttataaactattagattaaattgatattagaataaactaaatactacgaggtcccacctctccacctttggtacgcacctactcccctccctttttttattttttcatttcttcttttctccatgaatatgcttccctccctttcttactatatcatgcaccttcatgagacgatttaatctatttactcaagaaaaaaatatatttcaaaagttgtaagtacttaatccatctcccactcaaagtttgtaaatggatttttaagatatcttaacaaaaaatcgaacccttaaattattataaaataacaatatccgaactttagtttgcccttaattatgagatattttttttaacaaacaataaaaatcttacctttcaataatataagtgcccgcgcgtatgcgcgggccaccttcctagttttgataaaggttgcatcagtaataaaccaaacaagcgctttggtggttctacatgatcaaaagcagtactaccaaacagggcctttaacctcaaaatcactgtaactttaactgctctatccagtaatgatagtagaagcatggatgtatcactacatgattcattcatttgagcaaagccgacatgagaagaccagcaatccagcatttgatcgtggtcgtctgatggttgaaaaggcatttgtatcgacttatgctagcccctatcaaggttggttatccgtcagcgtgatcgttgattttgcacggaaaacaacaggaaaacataaggtctactggaacactacgagagtctacgatacggacgaactgaagggcccttgcgtttgacgccgggtttaggtcgccttggctccgttgatgtcaccgtttgggcgtccgtgtaggaggggccagccaagtactgcactgattagttcttgatcactctgctggccagtaatctctcttcatcttaggtcggcttggctactagtagttgaggagtaaggccctgccttttgtagctggcacacgcttgaaactgttgacaatttttgctccatcgaacatcaggttcagactttcagtcatcgttttcgatccccttgcttgttgcagcaatttcattcagagaaagcatgtgtgtcaatggacactcttcagctgcaagaatcaataatgtacttccttagagtaagtttaataacggagccaactataagcttatagtttatattaaagttaacatatatagtaagtgagctacaaggttatctctttttttttctcctcctctctctatctctcacctatgcatttaatgtatttatcttgaagtatgtgaattgctagctcttgtattagagccaatcctctctaattttcaaattctctttcatccacataagcttatagttggcttatagcctactagtatacttgctcttagtattagggtattcccaacccaatgactaggatggtgtccatagcattaaataagttaccacttaggataaaaaatgatgtggcaagtgaataaatgaggaaagagaaggaaaccatatcttgcatgggacatggttttctacacaacatccaagacatcatgtgagataaatagcattaaattggagtatggaatagtggtgtttgcattggaagagtagtatctaggactagtttcttgatgatgtggagtttatggaaactatgtctagtgttatgggttgggactgcccttactgcttctaaatgagacttgtgactgctggtctcctttgatttacttccttacttgcatgagatttttttcatgtgttattgacgtactacctccgtcccaaaataagtacagccgtgaatatccgtgcccaacgtttgaccgtccgtattatttaaaaaatttgtgaaaaatttaaaaatatttagtcacacataaagtgctattcatgttttatcatctaatagcaataaaaatactaatcataaaaaaatttcaaataagatgaatggtcaaacgttgaacgtgaatagtgcaaaactatacttattttgggacggagggagtactgaagtactggaacaaatatctgatgatgttccaatctttctttagttattgcaccggtaaaagattgcaataagaaactggagttagtacgcactttaggctaccctgaagaattttttgcatggtggttagtttattgaaggtgtggtgtcatccttgcgtgtagagattatcacattgtctaatcaagaagagccaggagctaagctaatctagctcggccgcgaacacgacagcaagttatcttgaaggaatcagtcagttgactaagcaggctctcgctctctccagtccagaaaagcttcggcatttagaatcccctgtttgcaacaggcgacaaggcaactttcatatggcaccaaacatgtcggtaacagctgatgaaaccgtctaatttatctgctaatctcgctgttttttcccttgtcaggatggctcacaagtggaccaagttgtagaatgttgcaaaacccgttgtttatcatggccacattcggctagcgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgaggccgtaattgaaagtcttttctgaagaaaatgggaataaagatgaggatttgatacagtaaaaggctgtttggggcgaattgggctatcggctcagtaggattgcttagttgatctaacctccatatgggctgacgctgatcatgggctttacatgggcgagttgccatggcccatgggctgtcttgcgcggaagaggcgtgcgtggcagttgatggcggtgtcgccgtgagagaacggagaagcggagaaaccgacccgtctccgcctcatccaccgctccgccacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggtcgcctcccccgtcgagcacctgctgtctcggttcgaggtttcttgtgtgcgtactgcgtagctaacatcacttcctgcctactcattttaggatttgagcggcggggcgctcgtgccggtcgaggggcctgaggcgccattgtttgcgcttgaggtgagcggtattagtatatgaaaatcttagggcatccatttgctttgagaagctttgggctatgcaacataatcatttagattgtaatgaagtgttagcatatgaacatcgtagagaacatccattttgctttgagaaactttgagctatgcaatataatcatttagcttctacagtaataagctgaaaacctctacctgtgaaattctaggatttgtttggaatcagaatgatttaatttagatcaaccttctgattgacttactctagatcaatatagatagtgcttgagtgtggcatattcgagttttaatgcagataaatcctgagaaagcccgagaagagtttcgtgcagcaagtcagaagaatggagggactggggtaaaggacttcatggatggcatgggactgggagtgcttgctgagcaggtgcaaggctgcatatctgtttactgtcgctctctgtatttcatcacctcccattatgtctgaatgttgtggtccttgtgttcgtgaatttgcctgaattgctttgtttaactttggtattaccatcttattccatatagctgggggagttaaaactgggggagttattggacacaccaccaccaggattggatgaagcaatagcgatttcaaaggtgagaaaaagcaggtcatgggctttacctggttcatcttgttgttcttcttctagcatgtgactcctacttgcatccaggttatgcaattccttgaagcacaagagtatagcatgtttagacgcattgtttttgacactgctccaacggtaactatcctatatatgtgaatccacaattgactccatacgcacattcacattattacctatgatttgtctccctcatcaacagggccatacactccgtttattatccttgccagatttcctggatgcatctattgggaagatcttgaaggtattatttgcttgattgcttctgcaccttttgctatcatgctacgatgtaaggcctgcagtacatacataattgatgaagaaaatgtgtattatcttgtgtaactattatcctgcctatcgtcacacaaaacaaagtcattttagaatgtgtgtagtcaacacaagttaactttgaccataaatatcacttaaaatataggttttggggctatgaaaaatgatatatttaagtttgccataacaagagatttcataatactacacttatgtaaccttcttttaaaaaaaatgctaaagaactaggtagtcaaagttgtataatggtgaccagagagagtagccactacaatcttgttatttttgtggctaaatggtagcgggaagcttattgcatttctgctattattcatttgtgttcgtttgcgcagcttcagattgtgctttttttttgttaacttgtgaaattggaaggctgcctatcttgttgaatatttatctgctcaaatacattgtttacatctttttcatcagagttttttagacacttgttagaagaaaccgcttatccttgttctgcttcatatgatgaaatatcatgtctctggaatttaataaggaattaatgcaaagttattcttcaagtcctgttaccaagagctaggcattccatctaagttgtggtttgtcatactgatttatcatctttttttttccagcttaggagcaagatcgcttctgcaacatcagctattaaatcagtttttggacaagaagttcaacagcaggatgcagtaagtatttgcctaaaattcctctgaacttggtgtttcttcaccatgtctttaaacctttgaatttgttattctcccccttaaggcaaacaaattggagcagctgagagaaaggatggtccaagtgcgagaactttttcgtgacacagaatcaactgaatttataattgtgactattccaacagtaaagattctgtgtatccattcccccaccaccttctgtatgtatttatcagtgtaatagccatctttatatttccttttggcatttttcaggtgatggcaataagtgaatcagcaagactacattcttccctaagaaatgaaagtgttcccgttaagagactcattgttaaccaaattctaccaccttcgtcatcagactgtaaattctgtgctataaaaagaaaggtagagttcataatctgccgaaatgattctctagtaattgtctgctgcttgtagaaactgtgttgcagggccatttaccatcttctttcatccaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctaggaaaaactatcctacggggtaagtttttcaaacagaggtaggggtagtatacacaatggacgttgcagtactgataaaccagtgactggggtagtaatcttcctttctgtctttcgtagtactacaagacggttgaagatcttttccatcctatcgagatgtactactccacttctgttctgtgcaggttgaatatatgtggcccaatcacatcttgccactaaaaatcttacatttatccatatactccacgaacagtagattttactcatccctgattagacccaaaacaatcatgagcacggtagacaacacaagcttagggcgtcttgcacgattaggtattgttcggtttagaggggattgaagaggattagaggggactgaggggtaataatttcacaccataataggtattgaataaatcccctctaatcccttcctcatgagaattaaccgaacaagcccttaccccgctacacccaaaaatgtttccgctggggtgcaatactgctatcgatggcttcttacgtaggaatttcatttttctaatattttttcattaaaaattgtacaaatatgacaaatctcttttataaaacaaaggtttctatagaaattatgcgagcacatatgttcacatatacacatatttcatatttatgactaattatttttttcaacgacaccgacaaatccgtcaataggctttatttttctttcacaaagcccgtaaacttccataggagcctactacatcagtggcttcgtgccgcactaacgaggcatctatagtgattgactttatcaatgtaaaatatgacagccaaatattttgatgggaggtgttcatggttatatgtacgtttatactccgtatgagtgagtagcactccctccgttctgagatatttactagtactacgaatctggaaatactctttattcagattcattgtactataaaagtatctcatatatccaaaaatttttatattttgagaccgagtgaatatatgtttgtggttttcctacatgtgagtagagtgcatcagtggatattagagcctccacgatatgggaatagtatcagccagtgtgttgatgacgtcaaagctcaaagggtagatgaaaagttcatgcttcaaaaatggcatgtcttggaaactgggattttcctaataatgagaaatcctatgtgcagagaggagacaaaagcactgctcaacacactgcaggctgcaaagatttgctagtactactactccagtacacaaacacatcattggccacttccctaatctcatttaacgtttgcataacgcactcattctgcggttactgcattagctactcatgaatgtggctatttactagtagtacaattctaagtgccattcccaggaggagtgagcagcttctccacccttaatcaggggcggagctaattggttttggcgatcaatctgcctcgtcgagtcgtcgttccgccctccacacttcccagttcgcgactgcgccaacgattgcgcgagcaccgctgccgcaactcaactcccgtgaccgacggcggcaatcggtggccggcgaggcagcgatcaggatcagggtaagtatatttcatctcctcctcctgtcctttggccctcccttctctgatccctcccgtcttcattaagctctaatcctaggtactaaattactaatttgattagtaagcggttaggccactagaacttgcgcccttgccgacggccaacacgacgctcgcaggccacaagacaaaagctgaatgaagcaccggcatcgcatgaactgatcgcattgtgttggtaaattctatacttctatgtcgacatattacatttatagtgttaaagaaaatttatgttcagttggaccatcctagcctaaaatcgtagctacgccactgcccttaagcccttgccaatggagaagtggaggttctatgggggccatcagtttcagagttacagctttcacgaagaggagaacctctttcaggattggaggtaagcagtcaaaatctcatgcaaggtttgtgtttttactaatactctctgaagatgctatcctttgcaaaactttgctcattttaccttgttttcttcaagatgaacttctttttgcactctgcattagaaagagaacttcactgatgcctgtaatttatgttgtactcttcattgacactgtccatttttgccatcttggagtcttgattacctgctgctgggagaggatgagccctttttcactcaccacttcagcactagtgttcatagcaacttcgtgcaaggtaatacaggtctctgtaccgaggaagaatgaagcatcatgtactcaagcaagtatgcagtagaaagttttgaaagttcatgtattttctatctatcaatgcagacgagctttacaccctcttcgacggagatatcctgagcatttggggcgacatgaaagaagacgcctatcacaggagcgacaaagatggcggcgagaaggaagagaagctggatcatgagaaggccatggagctgcagctgcaacgactcccgagcggccgtcaatcaggggaaaagacactgacgttcgagctcgtgtcccagtacttctgcctgccgatcaagcaggcggcgcaggagctcaacgtcgggctcacgcttctgaagaggagatgcagggtgctcggcatcccacgatggccgcaccgcaaggtcaagagcttggagacgatcatcaagaatgtccaggtagtatttttcctatctcattttttttctctcgattagatggaagaggtatacacaccagggtttgaaatttcggttcgaaattaatttcggaaatttcggcccccaccggtatgctcaaatctcgtccgaaattttcgtttttttgcaattttttgtgaatttgtcaaattttattcaaattcagttaaattttcaaataattccggccagaaatttccgaaattttggtcacccccggcataaaatccaatttcgaaattgaaaaccctgatacacacacgcccctgtagtcctctatcctggtgatctttgatgggcgaagtcatttaccaacaattccattaccttaccataagagttttcccgtaattttccatctatgtaaatagtatagtgtctaagtttatatctgagcaaatctgaatttcatgtcctgcaggagctagggatggagactggccaagacgaagataatactaggaacgcagtggagatgttgcagcaaacaaagaagctcatcgagcaaagtcctgatgctaagctggatgattggacgaagatgttaaggcaagcgtgtttcaaggagaactacaagaggaggaggctcctggcgattgaaggatgaagagggatatgtagcaaggtgactctgcttgtagatggtaacatcaggatagtgcaggtaatcaggttattttggctgatcaaatgtgtaggcagtaatttctagtcaggcttttaggtatgacccaaggcagaaaagtaggaatttttgctgtatatacctcttttctagccaagtcttcactgatagtaacagtactagtttggtatgttggtcatgggaagtatcatgtatatatctgttttcagacacgatctggcgtgtgaacaactagtgcttttagttctgaaaataaagatggcgtcttttgctgcacatttgttctgtggagaaattcagaattgcatgaagaacagctaaagtaaaccatttcatgtcattcaccattcgtcaggaaacatgaaccatgcagaaacatggagcttatatagtagtacattgagttcacaccgaagattggtgtgcttcagtaatccaaccaaactgcccccaagtctgaacatcaccttgtgttgtacaagaaaatcggacagggtcgatcggtacacagcctctctctcttatccatctctacttacgcttgttcaaatctgtttgatcagccgcgaatctgtactatacatgcacactgatccaccgcaaattgcagtttctaatgcctcaagaaaatgaagcaaagtgttcgatcgcggtcgtggtcatggcagctcaggctcacaaggtgaccttctccatctcgcggcggagggcggtggcgcggacgaggctgccgatggtgttgacggcgagcttgatgtcgtcgagcgggttgcccggcacgacgcgcttgtagaggtagctgtcgaaggtcatcctctggacgtagtcgtcggcgcacatctcgacgaacgcctcgcgggcggcgttggagcggtagaacaccttctggagcacgtcgagcaccttgtacgtcggccagtagaggcggtcgaactcggccaggtacctgcgcaggtcgctctcctccaccatccgcgtcccgttcgccgacccggccacgatcgcctccgcgcacatccgcccgctcttcgccgcgaagtagatcccctcgccggagcactttgtcacgtaccccgccgcgtcccccaccagcgtcaccctccccgccaccctgtcgaacaggtgtcaaccccgaccgatcgaccagccattgatttgatgcagaaatgcttgtggattctggcattgttgattacctcttaggcctcgggtgctcggggatggggtgagcctcgacgcggatgatcttgccgccctcgatccggtccttggcgcgaaggcgggtggcggcctggaacttcttgatgtcgggcttgtgggtgacggtgccggtgccgacggcgacgtggtcgcacttggggaacacccagccgtagaagtccggcgagacgtcgtcgccgacgtacatctcggcgcgctcctcgtagtacttcatcttgtcgtcggggatcttgacgcgctcctggaacgcgatggcgtactcgtagtcgccggcgcccatgtccttggcgacgcgggagttggcgccgtccgcgcccacgatcgcgtccacctcgaacgtccgcttctcgccgccggccttgccgttggagctgtcgtagtggttgtagtgcaccacgtacgacccgttgggttccttgggcgcctcatacctttcaaacaacagagacgacatgatccaaaaacatgtttattttccccaataaacttgtaatagtgttaatgcacagggcagcataaatcaagtaaaaatgttgcaatcacaccgaatgggcctagtttagaacatggaggtatttctttatacatgtggtgctgaattatgtttcaatgaaatttttgctggactttacggaaatcaatagttagaatcttgcaacatatccaaacatcaagccattatcattttttttcattatttcaacatgcacgtacaaattagtattgcttttttacaggtattagaaaattggggtttccacgcagatagactgttcctaagataaatttgcaacaaatattcatgctattttacggttgctagaattcagggtggttctacaaacatgcacaaatcttctgaacagtactagaaattttgggttttgcacacatgcacacagatcagctcttggtgaggcagtagtaataaacaaacatgtacattttcgtgcaggtactatataattttgttcatcatcgtgcaaaattagtgttcagtgcgcacaaaggttcagagcaatcagaaatccaacacgatggcagaagtttttactcacaaaattcacaatgcatgtgactgagttagcaatatacctcaggaagagaccattgacgacctcggcgccggccccctcggcgcgggagcggaggtaggcgtcgagcacctcgcggcggaccatgccgatgtactcgtgcggcgcgagcgtgccgccgatgtcgacggcgacgttggacggcgaaatcatcttcatcttcctcaccttcctgtcgacgaggtccagcggcaggtcgaactccgacaccatgcacagcgggatggccccgccgcagggcttgcagttgtccagcttccgttcgatgagcaccgtctccacgccgcccttggccagcgcctccgccgccgcgccgcccgcgggtccgcctccgaccaccgccacccgcagccgccgcccgctcgggagcttcgggctcgacgccgccgcgcgcgtcaccagcctcgccatcctcctgccgcggctcatgcccccacgaaccgacgacggcatgacgaaggtggcgcgcgccgcggcggcggaggacgacagcgaggtcatcgtttctgtggcttctcctcctcggattcggaaaagatctctctcgtttgagctcgacctggcggtggaggagtgagcgcgagagtgagacgcgagcagagggtgggagtagtgaagtgttaggtttggggggcgagtagtggataggatgaggggagattgcgggggacacgagccgttggatcgagcgattggacggcgcggattggatacggatgaggtttttgtccgctttctccttcgccgtttgatccgcgcgagtggctgacgctttgccaggtcggaattgaatcttttggatcgttgtgtactgtatgtgatggacgatactttgccacgtcacgtcgtactgtttgttgatcaacgtttttgtaccgtgacgcttgtgtagttgtaatagtacacagtgctacgcgtgctgacaagcttgaagaagtgcttgcttgattatctactgtatcaagtgtggcgggtgccacagtgatcgttgtattattgtatccatcatgattaaaatcttgatgcccacagacttgtcgttggtctctgtttttttttatcgtgtgctggggtgtctatttgcggaattgcgtgtatgtgagcatggtgtgcatgtatgcgtatttcgtgtaatcagaaaacatatttggtaacgatgagttttggcaataaaaagaattgggtggcaaatgattgtgttgggtatttttttaaccaatattttacggcaatgctagatatcgcatatcattcttagcttccagaatgagatcctcttcctccctcatgcgggtatggcaaagaaacgatgcagaggcagccagatttcacgggggctgttgcagtgcttcaatgaagagtgatttcttcgaacacgggattggtgtcacgccccgaactattaccgaccggaactagcccgtgacgctccaaattaacctgttaatcgataccagtcccagaaaacagtgctggtatcacaggaagacagaatatcacagcaacagaggtctctttattatagagtaggagtacaatcaagtcgggctgcggacagatcccgagctcacaaccgcattacaaaagggaagcggaagccaggacttggaccaaacaacacaggcgcgacttgggaactaggccgaaaccctaaaactcatcgtagccggcttgctcctggaagaactcctcgtcagcgggatccgcttcatcttcttcagcaactgggggggattatttatgtagagcaagggtgagtacgggagtactcagcaagccatgggaaataagtgtttaatgcaggcttcaaggaaaggctgttgtttttgtaattgattttatttgaactcttttctgaaagcaactaagtgagtgcttctcaaacgacatggatgagacagtgcgtctcgtccggttgaagtatgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctttccacaacagcaatttcacaaggcagtagtcaaacaacactacgcaaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgtaagccgacacaggtttaccatatgccgacgagaggggtcccagaccaacaacaggttaggtcccagaccatactatgccaggaagcccaggggtcctccccgacaccaccccggcgaatccacatgtctctcggcatcaaggctcccttgataagctagttactcagccaggggtgtcccattccacccatgtggtcgtacttgtcttatgttcggatgaaattccaaggaaacggtccttaggtgcaagagcgggaaaccgtacacccggtacgttccccgattcgcggttttggaaattcatttagttcgcaagcaccgactcaggtgtcgggttttccaagccttttgtaaaacccaagttttacccaagaagtttttcagattttaagtttgaaggcgaccgtcgatactcgcacagggtgcacgaatatcgaggcacaactagatggttacaaggggacatgatataacaattaacaaaggaaggatcaaatgcaacaaattaggtaggtccgccaatctgccttgcagacgggacaaacagattaagtgcgatcctatcaatgcgtaatatttttcaagtaacataattaaattcaaatataggctcaagatgctcaaaggtggcttgccttgctcgagatctggagcttgatcctcgaaatcctcgcactgcgagtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgaatttctaagattattggatttttgggtctaaagtaaaaggatttaattaaatcctttttgaaaaagaaaagaaaagaaaagaaaagagggagggaaattagacttccctcgggcggctagggcgcggcccgagagaaaaggggcggctcggccgagctaaatgggccggccggcccaaggcggcccaaggcacgcgcgcgcgggaggggaggagagagagagccggtggaccgggcccacctcgcgtggtcccgagtgggacccgcttgtcagcggctcggctcaccgtgcggagggagcacgcggcgcggcgctaggatgggggagagacgcggtgcacgcgcgcggttcgcggaggacgcggatgcggcgggcccatgcgcagcctcacggctcgcggtggaacgcacgcacgggaggggctgaccggggtcggcccgacccgatctcggccgagctggcgccgacgtggcgcctacgtggttgccacgcgggctggcgggaggtagacgacgacgccggccggaacggatggcggacgacagcgacgagcggcggagcgaaccacggcgatacaggcgaaagcgagcgcaccgggtggttgctcaggacgaggggagacgagccaatggctcggattcgccggaggatgcccgacggcggcgaattgcggcggcggcaaccggcggcgggagaagggggaaacggcgacgaggtcacgaggggtcgattcccggcggcgagagcatctacgcggctacgggaatccgatgctagcgttggattgggcggagctgcgccgagcgaggccggcgacgagcggcgcttccgagctcgggcggcgacggcggcgagcacatggcgagcggcggcaacggtcggggcggcgccggctagctacggggaggctactcgtgctactacccgagtctaaggggaggaaatggagcgaggagggagaacggggagatgcactaccgtgcgggcgggcgcagtgacgagaggccgacagcgcgggagtaatctctccggcctcgggccggggaagaggaaggagagggcgcgctcggagtccccttccgcgtccttgctcgtgccggctcctccgacacgcgcaacgacgaacggcaacagcgaacagagcacgggaggcggcggcaatggcgtggaggcaaatgggagaggaaaggaaagggggaagcttgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaaggggcttgtccccttgcctcttcgggaaaaggaggagggagcgggggcgacgcggcagagggaggaggagctctgcctccgtcccttggcagcttgcgcgcggagtggcgggggccgggcgatgacgacggcgatgacggcggggcggtttggagcggagcggcgacacgggcgacaggcgcaggcaggtgctgacgacggcggcgaccaggcggtcggccaccacggcacgcgcgcgcggttgcaacgggaggcgcggcggggcagcggggccgggcggcgcggacggctcaggcgcggcagggcagcggccacacgggcgtgcgcacgcgagggaggagggctcgactcggcgcggctcacgcgcacgcgcgcgcggcgcgcgggcagagcggagaagagggagagagagagagagagagagagacccggggagggagggggagatgggccgagagagattcggcccatcgaacccggggaggcaaattagacttttgcggaggaattgatttgggaaggatttggattcgggattgaactcggcgatagatcggggatttgagatctgagatggcatggacactagacaacaagcaaagaaacaaatttcgcaaatagagtttttaagagatagttttcccgctaggcgccacgacggaacgggcgctacaattggtgacggtgcggggtgggccgatcgagctgatggccacgtggtgcagagtagggaggaggtctcagtatacaagagccggagaaggaagaagaaagggagaaagaaggaggaagagaaagagatagacgggaatggataaggaaaggattgagcgagatagaggggaatggataagggaaggattgagctcccgaagtttggttttagccattgcatattagggaggcaccgggcttcgttttgtcatatagtgtcctcccttaaactcgtcattcctccggtgtttgaatttgatatcatatgtcaagcttcttcttcctcctcgagctccttcttcttttctccctagctagcaagacctcgccagtcttcagttggaagtctcatcatgtgggagtgagaaaaagggaagaggaagaggacaacactacattcatttgtctgtgttgctttctctccttcctcctagtaccaacaggccgatatctaatggcaccaacgagtatcaatgagtatcgaccagtggaaccgatagggtatcaactggtacagacggttaccaattgatactaatgagatgctgatggtacctatagggtatgagatctagtaccaaaacgagcatcaattggtacccatgggtatctagatctaatacctatttgatatcatatcgtccggacggaatcccgtggtatagcggtccaaattgtgatatgggtgcattgacattagcaatttttattacaaaatgaatgtggttggttgtcgctctataaaaccaacttttttttagaaatgcacgaaaatattcatttgctactttgatagggtaacaaactaaaagattttatagattatgcttgaaacaaatattatccgttgctcattaatcttgggtcttagtaactcttgaaactctcgaaccttcgtctattaagtgattgctatgggcgtatgcggtatgaacactcagaacattaaagattttactttctttcaaaggcatctactggagaccccaagcttcaagagctatatcatcaaaggttttggtttttctactcctcggtttttggagatacgcttcttaagggtaagtggatacctacaccctacgcaagcatactcatgtttgcttccacatagtaggaatatatgataccgatccgaccttcaacaaatatgaaaaccactatctcactgatgcgcatacatatgtgccatgactaacccaaggatcaaatccaagggtttatatgaggcgcaataggtaatagcatgggattgaacctagccacatggccataccttagttctataatctataatgtttagagctttcttcgatgattgacaatatgcaaatgagtggcaattgaaagaaggcaagagcaaatggtgaaaagtgctatgtgccacatgatagaaaagttaggtcgtaaatttttcatgtgttaagtgccctatgttgactcgatctcttggaagaagtgaagattatatgtcatgcatatgtggccaaccccatgtggattcatgcatgtgtttgtgtgtgttttgtgcatgtgtggtggagatgagctcggcaaatttgaggccatggagaaattacaaatattgatctcaacataagggtgtttttcagctggtgaaaggccatgaatgttagtctctttaaaagcatgggacaattttttttttagagaatggtattttttatctggtctctatacccaaccgaatatatgaagccttttaaattgagaacttagcccctcaaacaactcaatctaaaatttgctcatatggagatttgaactcaggacttggtgtactacttatgtcactgtaaccactaggctacatgcccattcgcaaagcatgagacaataagaacgttataacctaatatagtaagtaagccgatttgtgccacctagtaaggatagagcccatagaaatgtatactccacatagcatgttcctttgattgtgctagtgttaattgttgaatgacttgggcctctctgattgtcttaagttagcaaaacttattatgatatttttctagaacatggccgcctcatactagcaaattagttattttcttggatttcttgtatgaacatgcattcctctcaaattgaaatttattgttttattgtattttttggagcattttggagatgcatgtgccattttcattggtaggtcgaaacagagatatgcacaaaccagacatgaaatatttgaggcattcatgttttatatttcttcatcattatgatttgctccgagatacatacaaagtacctattgtttatcactgttggttggtttcaatacaccccttgcattgcaattgtatgtgccatggagttggtctaaacattcataattgagtgttatgttcaagaaatctcgggccacatcttttcgcttatacttatacttatcaatcaaaatttaaattttcaaccttaaatttgaagttgattttgggtttttttcatcgaagtttatttttcagcctttgcttttagatctctaaaaacacgtatataaaagttttattcacaaattatttttcatttgaaaatataccgtttgagtccgctcgatttgaacacagtatgtttgcctcagcgacatcaaacgatatatagggtttgttcggatcagctagacagtggctgtacagccgcagtgctgcagttgttttagtacaaatttacttggtagatcctgttggtgtggctgcagcgcagccactgctagctcttccgaacacagccataataaaagattttgttggtttttggtaagtaaacaagttgactggctgggtggatttacaatccaactccggctgaaatgattcatatccatatagaaattaagacgaaaatttaggccgagtataatgcacaactaattgtgtactttgcacaacggtaccgtaggaaaattctttgaagaggtaaactattgaattgaagtatgaaaattattgtttggagacgtgaattattggactgaagttgattagcgaaccgattgcatatgcactccgcacactgcattttccactagccacatcgccaccacatcatcaagtccaaagactggacagggccacgagcccacgacgtgtttcaggccggtccttctggcaccttctcccctctgcctgacacgtgggccccacaccatcacccaccaaattgaggccccacaggtcagtcaaaccaaaacccaatcttgttctcccatgcccctttccatggcccaccccagtacccacaaccaatcggagacggccattccaaacggtggggcccacttgtcagaaaatagaaaaaaatacaggaaaatatcctgaaaattttggtgcacaagagcggcgagccgtttgccttccctccaatctcttttctctcgtcgtcgtctcgtcttcccacctctcggattcccgagctccacacgacacgacccacctcggccactctccgccgtcggtggccagtggcctccaccccctccgtcccccggggaccacaccggcgtaacatcagccacacctccggcagatctttcccccgccgcttaattcacctcgtgcgcgcgcggcgccgctcgttgcctagctagctagctcggccgcaatctagtagtagtagtaggaggaggaggagcggcggcggcggcggatcctatgtcgggggcaatcgcttcctcgccggcggctactctcttcctcgctggctcctcctcctcttcgccgcggcgcaggcggagcagggtgagcggggtttggtggcacttgtatggtggcacggggctgcggttgcattgggagcggcggggtttggttcgggacggagccgtcgtgtgctcggcgtcggccgccggtggtgaggatggcgtcgcgaaggcgaagacgaagtcagcggggagctcgaaggcggtcgctgtgcagggcagcacggccaaggttgatacttttcctccattttttttagaaccaagcttgagactgttggcccacgtgtttcagactttcagatcgtgtcattttgatattttaactacttttcgtgatttgattatagtatgcgtgccagaacgtgcaattagttagtgcaaatagcgcagttacatgtagagccatgttgctagaactacagttgcttgatctagcgagctaggagctaattatttaccatttgttattcggaaatgttacctcgctgcactttttgacatgaatttccctatccaacttgtttagtatattccactacccctgtgtgacatttcatttttcaagttgataatgcttaaatgcttataactttgctgattctggttgagtgatggtgtatatgcattcaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtatgcatatctaaactggaaattgggcctgaccccatcatttcccctttttgagcatgaccaatcaggcttttacttttaagcttaggcaatgttccttctaataactgctatcatgtgaaggtggtcttggagatgttgtgggtgctttgcctaaggctctggcaagaagaggacatcgtgttatggtacgtactccttcacatttgtctttgtttgattgtctcggaagagattaacaatctgtagtactagtatatgtgcaatccacaacgtaagagactaagaggtggtattttgattgttatatctgaaactcttaagtctcattcttttgatttgcgtgcatcatggaaaacaatcctcaaattgttaccctgttgtctctgtcagctattaaatgttgtttcacatatttaggagagaagtgtggaaatctatcttgtattcttgttagataacaatttttgagctgtatgatttagcatgcttgagatggatgacaattcttaagatagcatcttaaattgaaatgtagtaggatatgcaccgattgagttcagtggcttagttttaagtgatccaaatataagtggctatttcaattttaggttgtgataccaagatacggagaatatgcagaagccaaggatctaggtgtccgcaaacgttacagggtagctggacaggtaagaaaacattgaaacagttattgtgcaatgtgaaatgaaaagtttaaaggttcatgatagaatctttttttttctgtgtgtgtggttttcaggattcagaagtgagttattttcatgcttttatcgatggtgttgattttgtgtttctagaggcccctccctttcgacaccggcacaatgatatttatggaggagaaagatttgtaagtcccaatttttctatagcttaattgacttacaaataagttccttttaaatcttctgtaaatattttttgcacaattttatcatttgatggcaggatgttttgaagcgtatgattttgttctgcaaagctgctgttgaggtaacttcccattttattgctactagtctataaatgtactccttacagttctgttagattcgcagctcactccaccacgagtgggccacccaggtctcaccaccatcaatttccagtgggactaaacacaataatttcttactacagtccacaattagaatttcgtacaccagctggtcagtcgatgcatatccaagtttcttgcagcaagctgtttatgcacctttcactacttcgtagcaaacagttaatactaaaattttgatgtttgacaattagaatttagtacaccatctagtcagtcgatatatatctgagtgtcttgcagcaagctgtttgtgtgccattgactactttgtagaaaacacaagaacaattaatgataagattttcatgtttgttttagtttatgaggtgaatgagcctgatgttatgttctcgaataagtacaattcattcatctgatgaaacatttgcaggttccttggtttgctccatgtggtggttccatctacggtgatggcaatttagtcttcattgcaaatgattggcatactgcacttttacccgtatatttgaaggcatattaccgagataatggcttgatgcagtatactcgctctgttcttgtgatacacaacattgctcatcaggtttttcacctagtcttattctgcaatttcattcttcgaatattatctgaaccactaatgtacttgttttcaagtgatctgctcaatggcatttgtattttgcaagtgtttctccttttctttaataagggccatacaattttaaacctggtattcagataaagtacaaaattcagttcagagttgtgtactggaatacagcagagtgcacctgctattttaccctatatgtagaaaatataggaaatttgtgtttatttatgacaccagttttgttcttacgaagttgaattagttattgattttgcctcttgaaagataattgactatactactgtcatagtgacaccaatttagttctaatgaaagttaaattggcttctatttattttatgattgcgtttcgcaatgtaattcaatcttgttttcccgcttgtcatccgtgggcatttaccttgatgctaatctcttatagatgtttcatgattttcttctttcagggtcgtggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaacggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcgggctgaaccagctgtacgccatggcgtacggcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaggcattgtcctggtaaatggtggagacgagatggccgggtcgcgggagttatatttgtatatgttgccagctttctgagtttttcaagccagtgcggctcttcagtgcaggttccaagcaagttcagtgccggatgttaaccatgttctgaatcttgtcttttctttcatataagcagtgaagcacagggcttctactgacactaccatgtcatgctgctatttggaactgtgttaggggataggaacaccattaaacaacccgggattcgcgcgctcgtgttaatgtcaatgactaaatgactgtgttccaataattgccatcccaagatactgcacgtacaaggaagaaacacagccggagacatctcagtcagacggccattgcggctgctagctcagtagtaccaacagtagtactctatccgttttacgatataagactttttaatattatctatattcatatatagatatcaataaatctagatatataactaaatatatatatatgtttatggtaatgcttaggttgtgaaaaggagtaagtagttttttttttcgcctgagcctgaccacaattaagcggcctaccaaacacgttaacatctcgcatatattgctcctactatcacacaggctgtcatacgcatgtagtagatcctagcctgggtacctagctagtactggctcgcatggcaccaacacaagtcagccaaccgcgtgggatgcggatatggctaaaaacacaaattgaccacaggtcaacaaagcatccaaaggctcacatggcagccataaaccaaaggcaatacttacccagctataaccatatgcaattatctccgataaaacaatgttacgcagcagctagcagctttgcataaatatcagctaaattcagcgaagagaacgtgccaatcgtaaacagcgccgtcttaccctagatctggaatatgcccatgtccatgtacatccaaagcccgattcaaccagtaacagtgcgcccattgccgtcatggccattcatgtcttaaccaccactgcaccaccacttgctctgctgcctcctcaatcaagtgtctgaaactgcacaagggccaggaagcagcagcagcaatgcaaggtagtagtacatcaatattgcattttgttccttctgatcctaccagcactagtgttcttgacttcttgtctccgactccaagaggcacctcacccgtgcacgatcgccgattgcatgcaggtgatcttgcgttgcgcgccggcggtgataggctcttggtcgccgacacggtggccgccgtggtggagagcttggtgcaggcatggcggcaggtgaggatggagctgctggtgccgctgcttagaggcgcggtggtggcgtgcatggtcatgtcggtgatcgtgctcgcggagaaggtgttcctcggggtggtcagcgcggtggtgaagttgctccgccggcggccggcgaggctgtacaggtgcgatcccgtcgtcgtggaggacgacgatgaggctggccgggcgtccttccccatggttcttgtccagatccccatgtacaacgagaaggaggtaacatggctttcaatcagttctgaactctgccatttccgggaacactgcagtgctctgtcgtttttttcagaagagcaaagtgataatccccgtttttgtcgccgcattcagcatcgtgttcagatttacatgcattaaacatttaaaattttgagcagaaatgcatgattgattagttagcatagaacaggcaattcttggctgtaggattcgttcacgggggtaaccttagctccacctgacaaaaacagtgaacaatgcaggtataccaactatcaattggggcggcatgcaggctcacatggccggcagatcggttaatagtacaggtcctggacgactccaccgacgccatcgtcaaggtgggaccatcgaatcctgaaagttgcccaaccaaaacgaagtaaattttggaagtaatcaactgacaaagtaatctgtctgtgtgttcttgggtcaggagctggtgaggaaggagtgcgagaggtgggggaagaaggggatcaacgtcaagtacgagacgcgcaaggacagggccgggtacaaggccggcaacctcagggaagggatgcggcgtggctacgtgcaggggtgcgagttcgtggccatgctcgacgccgacttccagccgccgccggacttcctcctcaagacggtgccgttcctcgtccacaacccacgcctcgcgctcgtgcagacgcgatgggagttcggtgagtcacctccgctttgtttgtttgttttcggggcaattgggcaggaaagaaagtagcctacgctgctacagcactgaccatggtacggtgtcgttattcgtttgcgccactcgtcgtagtactacgaagataatgctgctgccggttgtcgtcttccatccacagttgattcgaggagcagttgaagacttactgtactgtgctactaataaacctcgtgctctactgctctagtacagtttctgggtagtgatagaagtactccctctgcctaagaatattgtaatttctaagtggatggaacgtatcctagtcagagactcagggctccccaaatcgttttttagtggttaccagttacaaccaccctatgatttggcgattaccgcgatacccatgcggttatcacataccgtggtttcaaaaactgacaaggttaccgcacgtgataatcacgaaaaaccttgaccataatactatacaaactctctatctagattcataatatacgatatgtcccatccatttaaaatttgctatattttaggatggagatgtatgaatcttagccgagctaaacaagatgggcccagtgctagtgtccacatatggcggcctagtcggtattttagagacagacggcccatccacccaggcgatctcaacatctttgtcatgccaacttttcctctctttttttttgcagtggaccccatgtgtcatcctctcattatttttgccgcacattaccaatgttttagctaggtggtgttgcaatgtttgataatcaaccaatgaactaaacatggccgaagctcatatcaattattctaaatttttgaagtatgagagtgcttgtcatatgctgagagaaattctgtttaagctgccttgcagtgaatgctaacgactgcttgctgacgagaatgcaagagatgtcaatggactaccatttcaaggttgagcaagaggccggctcctcgctctgcaacttctttggctacaatggtatgatccttgctcgcctctgccactgcaattgctccttgctttccttctcctctacaagtttttcagaggttttgagaattttatatgctcatgaacgcatccaggaactgctggagtgtggagaaggcaagtgattgatgaatccggtggttgggaggaccgaactacggcagaagatatggatctggcactgagagcaggactgctgggctgggaatttgtctatgttggtagcattaaggtatttttacctcacttcagcagttcagttctaccatgatgacatggcaatccatgaacaaaaacattagcagattaattggataacttgagagtttgcttccaattccaggttaagagtgagctgccgagtactttgaaagcctatcggtcccaacaacatcgctggtcatgtggacctgcactcttgttcaagaaaatgttctgggaaattctggctgccaaggttagtattattttctcaagttgcacagcaccctggaaactgatgcatcgaaactgtatttgactcggagaattattgcagcattctttcttctagtgctagaattacctgaaagcccttatattcttccattgttttccaacgcagaaagtctcgttctggaaaaagttatacatgacatatgacttcttcatcgcacggaggatcatatcgacgttcttcacctttttctttttcagcgtactgcttcctatgaaagttttctttccagaggtgcagattcctttgtgggagctgatcctcatacctacagctatcattctactccattcagttgggactccaaggttagatcagtgctgtttacccttttttgtgtgtgtgtcaccagctactatgatcaaaaggatggtacatctcatgaactccatgtgcttcaggtcaatccatctgatcatactgtggttcttatttgagaatgttatggcattgcaccggttgaaagccaccctgatcggattttttgaggctggaagggcaaacgaatggattgtcacgcaaaagttgggaaacatccagaagctcaaatccattgtcagagttaccaagaattgccgtttcaaagacaggtaaattcttatatgaatataagaatcactttgaacttgatctgtgccatgagttatgcgctaatttctccatctgccggtgcttcttaggttccactgccttgagctattcattggtggatttcttcttacgtctgcatgctatgactacttgtacagagatgatattttttacatctttcttctgtcccaatcgatcatatattttgcaattggatttgaattcatgggcgtcagtgtctccagttagatcaaggcagggcaattgcaagatctgctccagaagcaggatccatgttaaagcagtcaatggggaactcttgtgccttgcatgtgacaggaaagctcaacgctgcggcaattgagggcttcaacaaattgcgataagcatatgggagataagaacacattgagcaagaagaaaatcatctagtattgtcaacgtatttaataggcaagtgctatctttagtgaagagtagcttcgcatcttatgtaacttagcatgttaatagtgacaattatcatttcagagctacagatattgtagcacgacatttaacacctatgaacttcaatggaatacatttacgataacaaaactggaggaaactatacgctctaaacccgatttcaagaagggggaaatctactgccaatgtactaatacagtgtgcttggaatcctacagtacttcgcaattctgatttgtttgtgttcataaaaatgcgctgaaaatatttgcagcagaccaaggctgtgtttagattggcccaaagtttggaatttggttgaaattgaaggcgatgtgactgaaaagttgtgtgtatgaaaggtttaatgtgatggaaagttggaagtttggaaaaaaaaactttggaactaaacacacttcaagaactcactaaagtagggtcaaaagacattgaaataacatctaaattggtcttttcgattgatgtgttgctgataatcagttagagaagggttccaagatgaataaaaacgaagagaactgggcgaaacggaaactcaccttgtgggttgcggattgcaacacgagggccgccgggagcctcaggctgggtgaacaagacgcgtggggagaggaatcgagttgagcacgccgcagagacgatcgagtcgccggtgatggccaccgccgccgccgccgcggccaaactgtacttgtagggtgtagccatcaagaagagccgagacggtggagcagttggctcttgggccaaaactcaggcgttctgatggctttgcattgggctattggagatttgatgggccatatatatcggattggaataagttcaagttaggtcccttaatttgtcaacgaattcgattttcgtccttcaaccggaaaaccagatacaacaggtcccttaattgtcaaaaccggtgcaaaataagtcccaaggcggtttggatggtggttttcgctgacgtggcgcatacgtggctaatttgactcgttcttcgtctcacatggcattaacgtgatgcttacgtggcaatttagttttgaaaatgataaaaacatcgggcccacatgtaagttacacaaaaaacaataattaaaaaaggcggggccaacgtggcccccacctgtcaatctcactcccctcttcttcctcctcactcccaatctcccctctgtccgtctctctcctctctcctctctcctctctcttctctctcgggcgcgacgaccgacgggcggcggagcagagcggaccgcgggaggcggccgaagaaacccacggccgggagcgcgaccacgtcgacgcgccccgtccgcgcgtcgcatgacaccctgggccaggcgcaggcgcggtcggcatcctccgaccacggcgccaataggccccccgggtcggacacccccgacttgaagaccaccagcgcaagtacgtcgtcgttcacggcgtccgctgcggcgaggatggcgacggctggacgacatccgttcggcacgagaccggcgtcggcttcagcctgcatcacctcgagcagcttcgtaaaatgctctatgagtagaagtagcatttagcatcactacatcactattagatatgcttgctgccttttcatgtgcttgacctttgaggtttgagccacacgaacatgttatattcgatccagccaacatccagtcgatcccactggagcggagacagactacggccttgacccggcgaagctgctcgaggtgatgcaggctgacgccgacgctagtcttgtgcccaccaacgtctgcgccatggtggactcctccacctcccgctgcgacgcggccgatgggtcgggctcccggcggaaggggttggcctcgagggagaaaacgaggcagtcggcgcggatgggcggactccggctgcgtcggcgggagcagcaacgacgtcggcggcggcagcgggcgctcagaagccatgggggactggagaggggagagagagttgaggagagggagatggggagagaggaggaagaaaggggggctgagaatgactggtggggccccaccattttttattaatttatgtgtaaaactgacatgtgggtcccacgaagttttttttttttggtcgaattgccacgtaagcgccacgtcaatgccatatcagatgaagaccaagtcaaattagccacgtaggcgatacgtcagccaaaaccgccgtcaaaaccgccgagggacctcatctgcactggttttgacagttgagggacccatcatattttctggttgaggaacgaaaatcggattcgttgacaagttaagggaccttaaatgaacttatttctatcggattaaaacctggatgcaaacaggcccgtctccttatggcccaatagggacccaaccttccgctatcctcggtgaacccgaggcacagagcacggtgcgatgcgagtatcgtgttcggacttccgacggaaccgacaagccacaaggcaacggcaacacgcgaccgtcggatcagttgatacggccacgaaacgtcgccgcagcgctcgagatcgagtccgacgagacgacgacgactcctccctctcggctcccgtgccggacgaggacgcgctggctcgatccatggaaaacgtgcgcttcggaatttcctctggtcttttggcgtactcttcgtcgccctttactgatgctccgtactcccttcctcttaaataaaacccattcctaacatcccaatataaaattagtatagtgtgagaataactaaaatacccttaattattaaaaaaaatagtaagggtgatagatagataaaagatattaaagggataaaacttttcgtttgagattaggtagaatgatagaagttggttttttatgggataaaatttaaactctagaaattaagttttttttaagatggagggagaatgccgtagcccatcgcactgtactccctctgttgagtatagtactgctctcttcttaactacacattcttaagaaaaaatattgatccaattgggcagaatcaagagtgtctatagatcacacctgtataattgctcactgacagtatcaggttaacgtcgcgcgtacattttaccctccaaaagaattcagatcaacaccaccacccacggaaaaacaaaggtaaaaaggtacaagtagtattagtaaaggcacaaaggcataccccaactaaccaccatctcacagtccacggcgacgcagtacacccagcaagtgggaggcagagacatcgcaaagatttcaatgcacagtagctgtagcatcatgtgcaccacgccatccgtatctcctccatgcggctgcaggctcgcatactgggttcagtgagacgagccaccgacactcgcacgttgcttgccaccaccaccatccctttcgtgtgagccgagtaaccgggacgtgtggcctttgtgaccgccatgtctcctctccgctactactagtagtacgaccaagcaaggggaagggaaaaaaaagagcccatcaatggcgcgcctgaccggcgtcttcctgcctcttttgtgaatcgattcaagacgccgcatgcaaaagcaaaacaatcgcagcatctttttcccatgccttgtatatgttgtcggttatctcctcagcgaaacctcctgcagatgccaaaagatttacctgtctgcaggacagtgttatctgttgtgcccggtatgtgtccaacatgctgagggggtgttttggaactaggtaacttttagtctctctcacaaaagcataagatagtgtttggaaagtagtgactaagctttaatctctctcacaaaaacataagtccctatagaagagactaaaatttttgtgagagggactaaactctagtccctccttacctaccctagagatttatgtttttagtttagccctctctcccaaacacccctagtttgttcgctgttgcctgaggttggctgatcgatgaccttgcaggattagcaaaagttttgatcggcctggtttgtgcatggcacgttaaattcaaatgctctactagtagtactcctgtactactcaaaacagagtctcttatctttgtcgctaacagcctcgttaatcttacacttgagtgctactgctcgacaacatcaaagaatccaatgggtagctcgctggcaatgacggtctctggtcaaaaattgggtcagagattggaatgacggttctagaaatccgcatcgagcggaaccagattccttgtttcctgaccattgctccgagtgttccactttctggagcccaactacttgagctctgcaaccttgcaggcacgagttttaccggtaagttgatgactggctggagtgtttgattgcttgacggtccgtgcaggaatctctatggctgtgtttgcaaccccagttcccaacccttctccctcgttttttcggacgcacgcttttcaaactactaaacggtgtgttttttgtaaaaattttctatacgaaagttgcttaaaaaaatcaaattgatctatttttgaaaaaaaaattagctaatatttaattaatcacgcgctaatagaccgttccgtattccgtgcgtgggtgataggttctcaacacccaccaccgaacacacccatagggatctgtatgccttctgtatgtaggagtagttctagtatgtgtatcaaacagtaggtgctctccgtatacatagtagtactacgctactttatacagttcatatcctgatttcctggagactggactggattagtacacggtttgagccggatacaaccaatgactaaaatggagcagcctacatacgcgcggatacaattgtgtatcaaacagtaggtgctctccatataatacgtagtagtactatgctactttagggcatgtacagtggtttttattagcggtctctctttattactccctccatctattttttaatagttacatttcatcttaacacacagaccaaggataagtaattctacttatcattcatttaagcatgctactattcattcctcgtaaacaagcgattcattaatatttacatttctcaaagcccatgtagccaatcatgtgtggaagaatggagagtcacgtattaaattcgagaaaatcattaagatgataggttgttggattgaaatatgcctatcaaaaataaaattttcagatttggaaatatgattatcaaaagtagatggagggagtatcatgcaagcatatttggtgacgtggaagagagaggaagaaggaaagagaaagatggttgctacgcatgacaacggtgtagagtcgactcttagcatttattaggaaatttttttattgcattgagtctaataaaggaaagatgactagtaagaaaatattttggtacattaatgattagagactgtaacttaaatattgtaacgtgatagcctctaattaacgtagagactttaccgttctctacttttgtacttgccctacagttcatatcctgatttcctggagactggactggagtagtacacggtttggagtcggatacaaccaaaccgtggatacatacgcgcggatacaattgtttttgccaatcccaaaatccaattgtttacagattggtattgacatttcacatacacgccggcgactgcacatggctttaacggcaatgtgttggtgatcggactcgtgaagtcgtgagtcgtctccccgttgctgccgtcgctccacacgaacaactcctacattcggtgagcccatgacacgcagactgaccggcgatgctgcctattgtcgccgactcgccgtgagccggtgaacactgtacatagccttgacgttgctcgctgccgacggtgcgttgggtcaccgcacttctttctctcgctcggttgaaaacttccgccaacgccgggttgttcatgtccccggcctgcggcgcctgtgcgcgtcgagcagctttggacaccgacgcgtctctcgtagaactcttgctcggcggtctaaccgagcgaacacaggaacgtaatccggtcattcgttttcccttcacgcgcgccacgccgctgtctagtctgtgtgcaacgaccacgcagcgccgtaccgcgcactacgatcggcacaagagattgatgcgcacagcgaaaacgagcagtacggtgcaatgggcctcgcacgagcagatgtacactaggctcgacacactcatttgcacggttgttgacgcagcaagcaaatcatgtacggcggtttcttggatttgtttcagattgtttcagattgtgatacggtggattgaattcaaatgcattaatactcccgcataagagaagcacgagtaaaaagaaattgttcataagcagcacacagggcataccccagatgcctaaactgtttggcacccccaaaatgaggtccggtactggggtccggtacagacaacaaccaggcaaaaccattactagcagaaggccattcccattaggcccaattttgctattttggcgggtgatacaaggcggcctctgtcaatcaagccacagccttaccaccacttccaatccctagccaaaagataccacaaaagctcaactaatggtacttgtaacaaactaccactagcagtgacaccagcacaaagcccatgttgatactaggccaaactacccactaaatactttcccaagaaccaaggcgagactgagtaccaatcataaaacaatggcacttcccagcacggtccagttgggagtactactgcaactaccacgacgatgctcgagtaaaattgagcggaatcagttgaactgggccccgctgaaggtctggccgaaggaccagccacgggggacggcgttgttggagacgacggagcggccgtcgccggtggtgacgcggaaggagagcgcctgaccgtcgaggagcgcggcgctctgccagttctggccccagttgcgcgacagggcctgccacgccgccgagcgctccgacttcacggccaccgcgtgcacgtcgccggcgccgcccacgttggtcaccagcaccaggttgaagtaggagtgcccgttgatggtgaaccggatcccgcccttcttctggcaagccaccctgcactcgagagcacgcacgccatggtcagtaagttccggtagatccaagaaagcgaaacgcgaaggcaagaaattgccggcgttggctactcaccggcggtaggagacggggacaatgccggccttgaagagagcgatgcgctggaagacgggctgggacatgtcgaagtgcgcgcgcggagggttgcaccagccgccgtcgtcggacgggagcgcgttgttcggcgggcagaagttggtggccgtgacgacgaccgagccgggcaggcacgagtggctcccgccgccgccggcgtcgcagcgcacctcgaagcacgcgccgcagctgaggccgttgttgaacagcgccgtgctcagcgccgccgtgttcgtcccgtacccctggctgtagaggttcccgtacccgcacgcccctcctgcacgcgaccaaaaacgcacacgcaaaacagtgagcacaacacgcagatgtaacaacatttcagcacagtgcacagcgagaaaaaaacgtacccatggtgcccgacgcgtcacccccgccgtagaacgtggcgtgcgccgacgaccacccgccgccgccgagcggcgcgtgctgctgcggcccctgtccctggccgtgtccgccgacatgcggcgcgcgccatcgcccgtgcccgtgccccagcccgtggtgccccagccaaagcccacgggacaacgccggcgggagcagcgcggccacgaggacaacagcgaggacgtctcggcgggacgacattgttgtgacggggatggagtcgtcgcacgcgacggggtgcgctgcgacgagagcgggcggaggcgtggagtgtggagtgcagcgaggttgttgggggcggggataaatagaggggtgcgtggtgggaacggtgaaacgaaaggaacgggtttgaaacggcgcggcgcagtagggtggggtggagtggagtgcggcgtaggccgcggcgtacgcgggtggggctcacagcgtgggtgcaaaagctcgcagctgctccggcacgtagggacacgagatttcgggggcgttgggaggcgtggcgggagtgtgaaaaaaaagggatggcgtggtggggtaataaagacggggaagctgccgccgcggcggtgcctttggaagtcgaaaccgagcgcggcgagcgggagcactgcttttgctttcttttttttcgccgccgtcccgtactactaccaaccaaaatcgctgccctccgcccctcccagcttcaaaacctaacgcggtgatacattccgcaaatgttgtcacggcaaagcttccatctttactctaaccctcaggagtacataccctaacccttacgtttggccatacaagtcttcttcacatacctgcactattctaacggagttgtcagctccaggagctgagctacacatccctccatattttaaggcaagggtttataaatggcatctttgactgaaccacgggacaacagtccacacagcagtctgacgggttttactgcacaacattattccctccgttaaaaaaaaatactcaactttcaaaaaaaatttgaaacttttaactttttcatcacatcaaaacttttctacacacataaaatttcaacttttccgtcacatcgttccaattttaaccaaacttctaattttcgcgtgaactaaacacacccttacgaggttgagtttattttttagacggagagagtactcattcacctttattttcaaatactccctccatccacaaaagttacacatattttatatttaagtttttctaaataagttgttcctattttagtctttatgcattgaagacttaaattaaatgaagagataaattaaacatttgattagaaccaaggagtcatctaaatacttattggttggattttgtatcatccaagacgatttaatttcttcttaatctttgtgataaaactaagtaacttttgtggatggaggaagtattacgtaaaaatataatgtgaccatgagtaaaaattaaaatcagttcattctttttacagcgtaagaccctatttagatgagactaaaattttcaagtctctatcacataagatatttggacactaattataaatattaaacatagacaattaataaaacacatccataatcttatactaattcacgagacgaatctattgagcctaattaatctataattagcctatatgatgttacggtaaatattctctaattatggattaattaggcttaaaaattttgtctcgcaaattagtttttatttatataattagttttataactagtttatatttaatactttaaattagtatctaaatgtatagactaaaattaagtatctgaatcaaaacaacacctaataatattcgcagtaactgtgtggcaggcttatttaatgcttccggtagaaagtatccatatttaatcattaatgtactccactctacttccacctctaccggttcacgaagacatgaagtccaattcattcatgggccaattggctaatgggccaaatgggtgtgcttgctgctcacccaacacgaaaaacggagcagatcattaacacgtgattaattaaatattaactattttttttaaaaatagatcaatatgatttttttaaaataacttttatatataaacttttttaaaaaacgtacattttagcagtttaaaaagcgtgcgcgtggaatatgacggtgagaggttgggaacccttgggtttgaacaaacccaaggcctggtttagttcccatctttttttttcaaacttccaacttttatatcatatcaaaaatttttctacacacaaacttccaacttttccgtcacatcatttcaatttcaatcaaacttacaattgtaacatgaactaaacacaccccaaatataaaggcgtacagccatagcggcatagtagtgataactgtgagtagagtagcataatatgtaaatactctatccgtcccataaaaaaccaatctaatactaggtgtgtttagttcacgttaaaattaaaagtttggttgaaattagaacgatgtgatgaaaaagttgaaagtttatgtgtgtaagaacagttttaatgtgatgaaaaaattgaaagtttgaaaaaaaaaattgtaactatacaagggcgtagtcaaaatacgtgggtagtatttccatgagagcattccgtttcaggtgccttcaatgctgaagggaagttctggctgaaccactgtgaatccagcaaacaagtcatgtgctctttcactcgtcagagcggaagaatccaaaaaaggccgagagaccgtgggctgctccgctgcttgcttgcccacaattgtgtaaccactctgtagatcggttggttccgtcttaaatttctccctcccccgataaaaaaaaaatcacaagtagaggaaagtaggaaggcaatattcatttcgtaagatggtggagcctattatgtagttgtaactgtttgctcaataagtggtactcgctgcggttttattttaattgacgctttgaacaatgacacgctctataaaatatatatttaaccttatttttctattataatatatacaataaataaatgcatgtttacttttattatagtgttttgaaagacaaatctatatatgtttttctagtttctttaaattaaatatttttaaagttattgatggttaaagttataaaagtttaatcttaaccttgtccaaaacgtcaattaatatagaaccagagggagtatatgtctacatactatgtaaatgtaaatatattaattatagagtaaattgcacccacggtagattaacttgttaggtgggtgcaatttggtgtaagaacttgagaaatgagcggtcgagtgcaacaacttggctggtatgtgcaatttaatataagaacttataagatcatataaatgcaacaacttacaaggtatatatgattttgatacaataaattaagaggttatgcggcaacttaatagtatttttttatatagattcaatttttaagtacttattttgacagtatactaacgtgtatttgtataagcatatttatatttttatcctaataactaataactgaaagtcaattaaacaggatatagaaattattatattccggttgatatttgagaaggtcaagaaaaaaagtcttaaaaggtaattggatgtaaattgtatgtgcagtataattcttaaagattaagttcaatattataaggtaatatccgtaggattactatgtaatggcatattgacaacgtggaaaaaattcacctagcatatacttagcaaagttgatgcataaaaatactaaattatcaagttcttgtactagaacgcacacacttatcaagttgttatatttggacgtttaattcttaagttcttgcactatatcgcacaaacttgccaagttgttgtactacgggcgcaatttactcttaattataaaacaggagagcttgtctacatattttcacccaaaaaaaatcaatcagatttgcaacaatgtgataataaatgtccttcgtagtttatatgtagtcatttatctataagccatttttacaaaaacaaaaacaaccaccaaccacctacaccaccagagtttaccaaatcgtgcggttataacgtatgataacattttcggttttactaaaccacagggtggtgataatcccaccctaaatagttcggtaaaccctgaccaccacacggagcctatctccaccagaccaccttacagacgatgcaacaccactgggtgctcactcattcccttcattcctaacaatacattaggtgcaaccctctgtgtggtctttcgtgccctctcgctagcatgctattcacataacattatttatttttcatgtccaatctcgttcgattccagtgtttttcatatgttccacttaaactcacattttctgttttcatatattttttcattccttgttcaggtcagaattatgtgattttcttattattccttttgtttcattctgcgattcaaaggggcatgagtagttatgtctcaatcatacacgagctgccaaagcaataagctttggtttttttttctctagaactatagagtagaaaaatttccacatttttccttttcctcgttcctatgaatcaatggtacgagcattgatttattttttaaagaaaacctctaaaaaattggcatagagttacatcctctatcgtcacggaagaaaaaaactgaccaattttattaaggaaaaacttgccctgcagtcatgcaactgtgaagttaattggtgagtaatcgccgaaaacctccacggcgagaacacacttcgaggcggcaagccaccgcaactgatgacccaagaaaattgagacacatcacgagtcattgttgccatgttttaaagtcaaagaccaagcaacaccgactttcctacgttgatccacaccctccacggtcaacaaccgaaaaaaaaaatcagcaaccacccaaagcgctactccccttcgtctaaaaaaaaaaacaaaccctggtttccgtgtccaacgtttgaccctccgtcttatttaaaaaaattatgaaaaaaattaaaaagacaagtcacgtataaaatattaatcatgttttatcatctaacaacaataaaaatacgaattataaaaaaaaatcatataagacggacaattaaagttggacacggaaacccagggtttgtctttttttggggcggagggagtaccttctaaggccgaatttagttctaaactttttcttcaaacttttaatttttccatcacatcaatatttttctacacacataaacttctaacttttccgtcatatcgttctaatttcaaccaaacatccaattttagcgtgaaagttagaagtttatgtgtgtaggaaagttttgatgtgatggaaaagttggaaatttgaagaattattttggaactaaacacgtcctaaatgaaacttctagagaggacatttgtcaactcttgctccgaacaccaggactaggttttcacccgaataaaaagggagaagacgacgttcatatgcaccaacatctatcgtcgacaccaatcaaaactaggacaagattttcacccaatgtacattctcacttcctgtcatccatgccctttacaaagtgtccctttgccgtggctagaatacgaggaattgaaattatcgttgtcaagctcaccacaggtaccatctttggttgcatactatagttgttctaataagcggcaactacgctatcatccgtaggatcccgattcctacggcatttccttcctttcgaaaagactataagaccattcacagtgcgtctatgtggcattcaacccccgactagtcacctaggagattcccctccacgtaggcaactagcgtggtcctagaaataatgattaccgctatgaggaatgagtagcattgtcagagaaagcatgagagtaagtagaaaaaaaacacaaacacacgtaagagagatagagagagagagaggaatgacgtagtgaagtgtcgcagacgacgatgccatcaccgccgagctccatgttccatcaccgttgggcaacatgtttatcgccgcaagctccatatccaccgtcgccccctcgatctacaccgctgaagaataaggaggcttcctcgtattggatagcttgcataggcgacaaggaacggcgacaactggagttggaagctagtggagggaggaaggcaccgacagtaggagggagggataatgtggcgtcgacaccggtggatggaggaggggagaaatggtgccatcatcgccgctagctggatgcaatggcaagaagtgaaaagatcaggtgaggatagggcgtgattttatattatttatagattttagggtgttgagtgtaaaattttataccactatatgtatatatagtagaaaacagaaggggttgaaatgcaaaaatatctataggggtttaaggctacgttcgttaggactggttttaaattgcatcactgtcactgatattggtagcagaagtaacaaaggctgtgtttagattcaaacttctaactttttccatcacatcaacctattatacacacacaacttttcagttacattgtaccaattttaaccaaaacttattaactttggaagtaactaaaaacagccaaaattgccatgtcactggcccgcgtcttctgataacgtgtcaggccctgacgctgcaagctgcaacagcaacaaaggacggaaggagcacatgctgaccgcgacaacgtgcatgccagcatctgcgcaaaagatcatttgtccaacgcacacaggttccgacggcgaaaacactggaccaggagtccagaagaattcaacatgcccaccaaacccagattacggggatcactacccagttgttttgccaacggaaatgcgtcgcccgtgccacgaaatgataaaaaaacaactaaacaaacgacgaataatttgaaggtctacttcacatcaatctctacctcttcatgcccatgccttgtttggaacgggaatagtactacagattttacaaattttcgcaaggggaagcagtaaagggtgccgcagaaacgggatgacgggccctttggcagaaacgggagggggacccgtgactggcccccagcaccggcacaggcgtagtgaatgcacggcgtactacgagccaaaccatcgttgctcacacttggcgcgtatcctcggggcgggcacatgcgaggcgcagcgccagcgcgctgctgcaaagggacgcggcccggcggccgcgccatgtgtcgcgcgggcgaagcaggggaacgtgcaagtgtcctgtgccgtgcgtgacacggggtcccctcgccgcgtgccccacggtggtcacctacacttgccacgtgccccacggtggagtaactaacctaactgaactggaatgaatgctgtgggctggtggtgaacacgtcgcacatgcacgcaggactactactacttttgcaccccaagttctagagcaatggtttggtgtgttcggttcacgccaaaattagaagtttgattgaaattagatgatatgacggaaaagttaaaagtttatgtgtgtagaaaaatcttgatgtgatggaaaagtttgaagtttgaagaaaatgttaggaactaaaccatgcccaaggttaatagtttcggcgactgttggcggcaaccgagtgccacgtcctctaatagacaactaatctacaatgcatacaacaacaacacttctttattttttttaatcgagctagtgcctactccgaaggaacttgcccagtattttacgtccccatttatttttccattggttgttgtgagagcaaatgggcccatggtaagtgaaatgtagaggctcgcgcaaaaagccggcgactaaatagttgctcacttttctctctccaagttttctttcttggccacgtatacaaaaatcctatatgtaagcaggctattagcccattgttgtacctgctcttatggttcacaatcgacaatttgaagagttccaagctgcaagaaatcagcagacaggacacgggcccagcccaacagcaacgaaatgttaacagaaaaggcccatttaatatcttcgaggcatccagccatttctgaagaccagcccatctaacgtgtggcatggaatattcagccttggaaacctagcgtgatactgtagctcatattgctgacaaataacaatttacacaattagatggaacaacgaaaggagaggaaatatcatttacatgctactccataaacatgggggctgaggataaatgcagtagacaagcgagtcgtgttcaggtccaagctcgagaacccagcatccctgatgatttcgcctgtttctctggtgaggtggcacccgtcagagacaaactgctgcagaggattaagggcaccttgcacgaatcggaggaaggatccatctattgcacggggcaaaaggagaaggagagtcaataatgcacaacaacagaaaatctctaaacagaaatggtcttaagccatttgtgtgtaaaatgtgaaagagaatagcaggtggtaccaggcgcagcaacatgctcaatgaatatgtagagaccaccaggcttcaggactcgttttatttctgtacaattaaaggctctgagttgtttagctagaaaatgattattataatttaatatagatgaagtttgttgtctatgcaaggcaaaaatgattatgccaaaattcaagagatgcaaaaatattgtggaaatatacagacaagaacagatgtcatacttcagttatgtaaaaggggatgaagagtttcacttctttttcagataatggaaatagtttacatttacggtgaagagtttaacacaaaacggtaaacttcagtttaaacctttcttagcattggatggctcgagttctaggtaacgccaatttcttataattgggaaaacacaagacgaagagtatgaagtgtaaaagtatccgacacatcatattaccttgttcaataatgtgcatatttcaagcccagtgacagtgagtgcatttatttttttggatagaaaatcagtgacaatttcaggtagctaagaaacaatagtaaaattaaaatattcttgataataattttatggaatattttaaacatcttgcctcatggacatatctaaagattccatatgttgcaaagctttgcagaaattataaagagcatttgtactcagataagaaatactgttgttagaaaagaaacaactcttacctctcaatgccatttcaacgtcacttacagaacacattaccagagtgccaacaacagcatccattgaattgtcctcagctggcaaagcttcaccaacctaaatacaattacgcatcaaagatagttcacagaactaaaaagagaaatagtgcgctaccagaaggcaccatacccctcttctgaaggtgaagttcgaaggtggaagtccagcagacactgcagctgctctggcatactcctccatgtgtttattaggatccaccccaactatgttaacgccatcggcatttgcatagtacttgagattagggcctgttccaacaccaagttcaagaatgttcttcccagcagtcatcaattgggaaaagagctttgatttatactgtgcaatctgcaaaactcattattgtgataagatcagcatgatcacggcagatgatcaaaatcacatcacaatccctgagaaaaaaaacagtgataactttttttaacagggaagctaaaattactgatgaagatttaagatcatgtctgctactcgcagacactctaggtgcttacttgtgaattctgatatagtgatatctatggaaaaaaattcagatactaagacaaattaccgagttctgaaaatcaaacgttagagcttatacagattaacagatatgtgatcgaaatggtcaacatgtcatgtatggaaaaaaattaactctgatgtcgaattgggcaaactgagttgagtgagcactgagcaccaatacagttgttcgtatagacaaaaatctactagcaaaccacaagtttcagaatggcagagtagtggaactgaaagtctgaaactaggggaaaagcaaaaatacctcagcctcgtaaggtttcatgaacttgtccatggccgtggcatagaacttctcgtaccactccggcctggcagggtgcacccgctcaagcatcacctgcacaacaaccaaaaacccaagtacgggcagctcagaagatggccatgaagccaccaaacatggagggcctcatcagggccagggccggcaagaagcttacttcggggtcgacgggcgaggcggcgggcgacgggagggcgagcagggggaggagagcggtggccgaggtggagccgatgaggtggcgccggccacagcggcagaggggagggagagcagcggtggtgcacacgcggctggttttgacggtgagggatggccggctcccgaggccggtcgccggcgtgagcgcggcggcgccctgctgctgcatgccgtcgacgagcggcggaggacgggggcctcgtctttgtggtggcctctcgcttcggttggaaattgcactttcggaagcgaggaatacgtcagctgctgtcgaaggcgtattttcgggtttacttgggattggcggaatcaaagcccatatatatgtaggagaaggataggcccatcaacggatcaacgtgtgtgggctttcttcgtgtgtaagcaaattttgaccagaaaaatcgccgcgcccacttcttccgatctgagtaatggagaacacggaatagtttgcttctctgtctgcctctcctggagctgggcaccctgaacaatagaacacagagtttgattattctattctctctatgtctctgcatctctatgtgcaaactgcaaacacaattttgttaggggcaaaaggccaaaaaaacacgcggattgctattcgggccgtgtttagttgttttgggaaaaaaaattgatgtatacggactcacatttgaactattaaacgtagactaaaacaaaacaaattacatattccgcctgtaaacagcgagacgaatctattaagcctaattaatccatcattagcaaatgcaaattaggctcaaaagattcgtctcgcaatttacatgcaaattgtgcaattggtttttattctgtccatatttaatgctctatgcatgtgtctaaacatttgacgtgacgaaaaagttgaaagtttgaatagaactaaaacacagccttggacgatttttctgtagtttttcttcggccggattgataaacgtacgttgaccaaagcaggtgtgccaactggaagaaggtggttttctcctgcatgtttgacgttttgtcgacggagattcacctacctggcaatttctcaggtgccatcaaggttcagtatctgcagcattttgctccgacggaccaggtcatgctgtgcaagtttggttcgtgtgatcatgttggttatctgcttaactaggattatacaaatcttttgcacgtgctgttatagcattacattgagtaaattaaactacaaatatttttgtcaaaactattactcactttacttcaattagacatttcataaggccgccataacaataggtactatctaataacaaatctgcagcttttaccctctaggtgtgtttgacaagtggactacccaattaccaatttgcaacaatgcaagtattacatatgcgcctggcaggtagaagttgacaaactttgcatttctttgacaaaaatcattagcaaatgatgcatttttatgagattacattgaaaattgtagcaaagtgacagttcctacgtattagttcggtttctaaattttgctctattatatatcccttgttttatttactgtagcggtactttctccaagtaggggtaaactaactcgcgcaagagtaggcaaataatgagtttctaagagcatctccaagagaatggccaaataaccctccaagttcaattatagtaagtttgagagaagaaaaaaaaacactcgaacaacctctctatcctgctggccaagccatcacgagtggataaggagagggaggggcggagtggtcgtcattatccactccactcgcctcccctcctctctctctctccctctctctctctcactagggtgtcgtggcctgcatagatctgccccaaggcagtgtgaggcaccgaggccaccgcgcgcgaggtgttactatgggtggtgcccatggaggagacggagtggtgccggcggttgggtggatccgatagtgaccaaggttcgtctgcgtagataggcggattcagctgcgaacatagcgtcggcagctccccgcaggcggtaatgatggagaaagaggcttgcccctcctctccatccggtgatagcagcggtggtggtggagaaggccaacgtagaggcgaggtagtggccaagaaggaggctctgttaggttcttttagtgtttttggatgtttttagtgttgggtttgttcatgtattcttggatgttcttgaatgccgattgatatttatggaatctgatcggggcgaaggggaactgctcaatgcatcggattgatcgaaccgacttttttattttttgctttcctgaaacttcaaatgtgtcggttcttaaatcgaggtgttgcacgctggataccgattgcgaaatctggcacttataaccggtttcgaaccgacacctaccccttttatgtagtagtgtcctccttaaacacatgttcgactgaaactaccgaacaaacacatgtcgtgtgtgaacttaaagagatggtttaggattctactctggatctgcagaagtgaagaaaaaaaatattcggatgacgggaagagcacatcagcgatgagcctgctctcccagcctttgcccggctgtccggctggaccgccggagcttggccccatctgcagtctgcctcctccgctactgcagctgcttcactgtcgtctgcttgtaccgtttcatcaaacctgacaggaaaagaagctggagacgcaaaaggcgccgtaggtttagacaggagctgcacaactaggtacgtactatacatgattcgatcataggctgcctgccagctgaccgagacgtgatacgtgtcggaattgcaagagaagagtaccgtctctctctccctttcatttgggtgggcttcgtcttcacaatgccatttggcggctgttagtactgtgaaaaaatagtgatagagtgatactagtagtagctgttctatacgcgcgtacagtatcatatcatcgggcagattcttggccagtgcaagtacggttcagcatttacgttggtactccgtcttttacggcagagtagtacagtgtcactgtactggtattctggtactggtactaacacatgggatcttcacaaatcacaatcattgtccctgtacatttattcattatattccccatgcatatggtgtcaaggttcacaaattgtgctcctaagctagctctcaagtggtacacataatatactagctagcaaaccgcattaacataagtgcctaacagtagcattgtactacgaaatactactccctaccaggctaccaaagcatgggcgatggatcgtaacgttgtgaagaatctccggcacatcatttcaccgaaatccgggctgcatccacggcggggcacacacgactaaacgagccagccagctacgacgtgcgcgcgatgcaagcgcacggcgcggccgcggcggttcacatgcgcgacccgagcgagcctcaaaagcggcctacccatgcgcccatgcaaagctagacgccatagcccataggcaaatggagcagcggtgtgtgtgtgcagagatctcactctcctacgtacagtaggtgtactagacctgtcagcgtgccgcggcgtcaaatccatgcaggccagggggccgtgcggtgcgtgtcgcgctgcggcgatcgaacgtactgtacgctaaacctgcgatccatcgaatcgtcgatcactcgttcacataattaaaggcacatcttttctcctttattatagacacccaccaacctcaccccctgcacacacagtcgatcgtcacacacaacaactcagggcttgtttagatcccttgcaagttttttcaccctgttatattgaatatttggacacatgtataaattattaaatatagaaaaaaaatgttatacaaattgcttgtaaattgtgagatgaatcttttaagcctaattactccataatttgacaatgttgggctgcagtaaacatttgctaataaagaattaattaggcttaataaattcgtctcgcagtttacaggcggaatctgtaatttgttttgttattagaccatatttaatactttaaatgtgtatccgtatatctgataaaacattgtaaaaattttcacccctaaatctaaacactgccacagattcaaagtgacgaggaacatacggtgatcgatgcgcggttggactgatctgccccgtgccctgtactaacggcatataaatacagtctccatcgattcgaagctcgcgttgcattcagcgagcatttgagcttcttcagacattgcccggtgaatgagagagagcttgtcttcctactaggtcgactcttcccgtacgtgctggacttctactgctgctggtggtctgcagcaatggagctagtacggcatccaccgatgattcctaggccgcagtggtacgtacgctcatctcaggtcttgcatgtggagacgaggtgtattgctggttgtgtagccaaggatgacttgccggcctggtttgtgttcatcagcaatccagcatatgctgtattgccgtgtgtgatcgatcgatgcatggaccggcaagttattttctttggctacattacaacctcgtcttctcatgctagacctcaagatgatacacatgcatgagtgcaggatcagatgcagcgataggatatgatgtcggtgctgatcgagggcactacttgttcggtgatctctctcttaatttctcgtacactagctagctaagctagttcttccatagttccatgtctggttcaatgcaattgcactttcattctttgaggggagggggttgtcgatcgagaaggactgatcgattgcagatttctaacttgtgtcctatgcttcacgtacgtcgccgatcttcgtatcacaaatgtttagattgctgcattgtccatttcgtgtctagcacatagtattagttcagttttgaaccgattattaagtaacttttgcatagtgtacacaactaaaaaaaggggtacaataatatgcatgaactaactacataaactacactgaactaggacgatagaaatacaagactaattactactccactcggtcccatctgctgtcatatatatgtattttttcttttgagtaattttacagttcttgacaaggtatcatgagataccactttttctattataaatttgatacctcttattacctatgtattatgagatatcaaattttacactaattttttgttatcttatagtacctcctaaaaaactgtaaaattcctatttttcttttcagggatataggctttcatattggacaaatatctagtgaaacattttagttaataaatactgaataaacatcatagtattgaaactttaatggcacctatttgtatccacaggaaatcataagttcaaagtataaaaggagtatgttgataacaaattaatctgataactttaaaacattgagtacaaacgttttgcatcaattaacaagtgaaaaatgtggaaacaagtgatagcaagttaatgtattgaatggtgtacgttcagttaatacactgaagtaactgactataaggcacgtttagtgacttattagggccagcatgtttgaatctctaatttgatttatctttttcagcggcatgtaaaaatgagataagcaataatgcacataaataattcagtatcaattattataaactttaaaataagtttatctgatttttcaaagaaatttttttatatattttttaaaaaatatcatttaacagcttaaaaaacgtcctaattgaaaacaaagaagttgttctctgaagttaaaggaatgaacacggccagaaccatgacaaggacgtcgtaaatgcatactcctactaaataatgaagtactcctactacatcttttctttcagagtccaaataatgaagtactcctactacatgtttatgcatctgccgatctgcgttcatctgtgttatcacaaagacaccaaccagtacacagtaggcgatcataccagtatcctgtgtgggatcagcagctagtcctactccttgcagctttgcgcagcgaccagtgtactagcacagtacatcgcctgatcgtttcagtctcgatcacgccgctgctgctggccggtctgttcgcgccgtacgcatgcccatctgctgctcctgcagccctactccggctcgccgcgacctcacccgcacatgtcgggagcgagccgatcacgatcgcttgcatcagccatggcccagccgattcaagcctgtcgagagacctgtgtcgaaataactattgttagtctctgatgactgatgagctgatcgacggaatactacgaagttctgcaccctatacaagtagtatatacatgtgctacctactgtggtagtgtggtctgtactgtacgttgagtgcagactgattgctgctggttcgcggcctgtagtggagcagctcaagtatgatcagcggttcttcttcctcgatcgaatggccgtggccgacgatggcgtccaattcccagcgcgcgaccaccagcgcaagcaggccgaactaacggagttttttgggccagtccatcaccgagcggcccggtaaaggtagcccataatcgctaccattctgtactggacccaaataaagttggcccgacaccgtgagagccgacagaacgaaagcatattggatcgccacaatttggttgcgatctgacaaaacttccgtctccacagggcacgtatatccaccatggtgtaggtctatatcagtcgatttacacaatttatatattttggaagcaatatccaccatggtgaacggtacaggttctttgattaacatggagtagtacattccttcttttagcctacactacaaatgcaatataatgcattcatgcagacggagcacctatttgctttccttttgagtctgatgccaacatttacaggcgctatcaggcaactgtgtatcttgctattacacagccgctctgtacggtattacagaatgcagccgcatcgcgccatgatcatgcagtcatccatccatgcgcaatctctcattcatccatcagtttgtaagctgctcctccttggctgcttcctcgagttctctgagccctccgaccctctgctcgatctcctcgagtagctcctccctcaggagctcctctcttgcagacgcctccaggtcctcttgctgcagaatcaaccatgggagagtggagatcgatcagcaaaatgactggttatcttagtagcttcgcacaactagagtttgtctaattgtctgaatgttctttcttcgtgataaaggaaaaaaaaaaagccgtaatgaaagacatacccggtcatagtaccagtgcacggtgccgtcacccccttgtcccctgtacgcctcactgtcgtagaaaggatcctgtaaattcacacaagaccgtgtcagtaacacatatcgaagatgtaatttcgttccaagttgtagtggcatatgttctgcgtgcttgccttcatggacgcaaagaagcagatgccccagactgtgaagaaggcgtagaaggtatctacgagacagacagagaaatttttttgtgaaaagtttcagtttcagacgtaacaacaaactgcaggaaaggtgaaacgacgacgacgactcacagacgctcttgagggcggcgtcgctgagatgccagatcgacttgtgcacgacgtagtccctctgcaggtcgacgtgctccaccatcgtcaccatcagcgtcaccacgtccaacggggacgcgttcgccttcactgaacccctcccggccgatttctgcaaacgctaagaccgcattactttgcctcaccaatcaccacggatttcttctttctcggtgaaaaaattaaaatgcactgggacctttcaccttgcaacggctggagttggacctcgggtcatggaatccaccgagctgcaaatttaacaacaacatttgaacaagtaggtgaaattcgcaaggaattcaggaaagcagtttttgcatgaacgcgaaggggagaatggacggtgcggtaccgttgcacggcagcggccatggagctgggctctgttcgcggagtgaagagcagagaagtggggggacgacttgagcagcggcaacgccattgctggtaggctgctgcttcagtagcgggttggcgatgagcttgttgttgtcagtgtagcgggctcacgtttggctcaggggtgaaacctgtaacctgtaatctgtatggaaaattttagtggataaggtcagacttttgggtggccaaccattgtctgatcttgggcagacgaaaagcacaagaattttgggcttggttgaagcgggcttgagcgttgctaggccttgcccggtcaaggtcatgtttgggccggatgggattaggttgacccgtgggctcgtggcccgttacgtgcatccgtccgccatttcttggagggcgctacggcttggcgtccggcatctcaccaaaaatcggacgcccatgcaggcatgtgagaacgaaccctgtcactgtaacgtatgtgtctaactgcttcttttcattcttttctcctctctttagatattttttatcctaaattacttatccaatttacgatccgatcacaccgttctattcgttgcaattaaatctttacaatgagatatcacatgattatattatgtcaaaagaaaaacatgtatttcaaaacgttaaaacaaaatgtttcgtacgtgatagtgatatgtttcaatatgtgtcatcggtgtgtttcacaaaattcatgaaactaactgctactactctctctcctctctctccacctcatccatgcacacatgtatgtattttagcaagcttcaaaataatttttctcttaaattacttatccaatttatgatccgatcacaccattatatttgttctaattaaatctttacaataaaatatcacatgattttattttgataaaagaaaaatatatgtttcaattcgttaatacttgttgtttcatatgtgccagcgacatgtttcaacgtgtattttcaccatgtttcataaaatacttaaatgtttcggttgttgattttttttgtttcaccatatataacataatgtttcacttgctggtcaacgctcacccccgcactgccgcgcgcatacgcatgcatgtaggccgcccatgctgcattgttcacgtgccacgttgcttgcctcccctgtatgtgttgcttgcgctgctgcttgcatacgctccctccctctcccttctattattacatgtgcctaattttttcctcaaattttaaatatttttttctccaaaattatatattctgatctaaatttcaatgataccattagattcatcatcattaaatctttataacaagatctcacatggttatattttgataaaaatatacatgtgtctcaaaaaataacttgtctcaccattgatagaaaactgtttcatcacatgtacacaaatattacaactcacctcgtgaattgtttcaaatttagagaaatacaacaatttactaactgaaacaatcacaaccactacacaaaacgttaaataccaatgagtgaaacataaaaaaaatcatatgaaaaataaaatatttttgcacaaatacttaattatgttgaaatatttttaaatcggacgctacaaatcgtacgttcaatattttttcaaatatcggagcctaccaatcgtacgttcaatatttttttaaagacgctgctcctcgtttgtatgcagggacacgttgaaggagcgaggttgtcgcatgcatgcatgcatgcaggagtagacctggttgccaagatgacgtgaggcatcattactctgtctctcttaatcaaactttaaacataattttattctaaaatatatatccaatctataatttataacaagatctcacatgaatatattttgataaaaatatatgtgttctagaaaaaaaacaaacttatgttgaactatttaaaaataattctttcatcacttgtggagatgtttcaacccacttcacaaactacaggcatagcactaagctcggcagcccatttttgcaagctgataagtgataaacacaaggacgcaagctccaagtgatactttcacacattggaaaaaggtccaattagcagtacggagtactgaacatagaacaagtctagctgatgctgtttatgtcgatggagcaagcgacagttggtaccaaccaaacaccatgcaccggccggtgagcgcggggcacgcatcatgccatgtattactcacgtcacaatcacctaaccccacacgcgctagtttcatgggtgcctcggccctgtcccttcctgtatactatctccgtcctataaaatacaaatttaaaaccgtatatattatattctaatatgatatatatatatatatatatatatatatatatatcagattcgtaatactagaatattacactttggcacacagccacacaagcttgcaacaccaacacgccaacacgaacacgtcgtatatcctgcttcatcaagaacagcgagtctgcatccttcaccttcgcttgaactaattaagcgtcaccaatggaaggaaaagccgcagtgacgacgtcgaccgagcacggcgacggcgaggcttcgagaacggcggcccgcaccgtggtgagcggcagcagccgcggcggagcggcgagcagagcgctgtccgtggccgacctcatcctccgcgtcgtggcggtcgtcgccatcgtcgacagcgccatcgccatgggcaccaccaaccagacgctcccgttcttcacgcagttcctccggttcaaggcgcagtacagtgacctcccgaccttaacgtgcgaccattcttgccttctagctacaatcgtcaatctgcattacttccgtttgcaagctcgtttattccttcctgttgtcaccaggttgttcgtggtggcgaattcggctgttactgcgtacctggtgctgtccatcccgctgtccgtcgtgcacatcatcaggagcagggcaagttacagtaggctggtgttgatcttccttgactcggtataaatcgatcgatcaaaacgtaaaatattactgaattttggctaatctgggggggctctcgtgatcgtgcaaaaggtaatgctggcgctggtggcggcggtcgcgtcggcgtcggcggcgatcgtgtacctggcgcacaagggcaacgtgagggccaactggttcgccgtctgccagcagttcgactcgttctgcgagcgcatctcaggccccctgatcggctccttcgccgccatggccgtgctcctcctccttgtgctcctctccgccgccgcgctggcccgccgctgagtaataagaaaatcaaggttgaattgtgcatcgcgcggctgaccgggagagacggtaacatcaatacatgtggctgttgctggttgttactgtagttgttaccgtgtcgcctgtgtatcaggagattcagagtccgtgagccgttgtcgagtacgtacgtgccggcagagaccggtgccttgctttgaaaattcagtactccaacatcgagtgcagtgacctgtactggtttacaaattttcaattttaaactcatctgcacaatgagaaagcagaaggtattattgatgtgcggatcaattttggacatacaactttcagagtatgcagacgcatactgttacaatgttttccgaatcataaatacatatacatgtgatgtctacataatataaatcgggcgtccgatttttttttatatatatatataaattgtgcgttgtttcaccaagtagatcgaaattatttcactaagtagataaaaaatgttcattttttaatattttaaaaagctgaaacacaaccaaatcatctcgtgaaacattttactacaacgtatgaaacaacggtttccaaaaaaaccggacgctatttcaccttatataaaaacaatgtttcagcaaataacgaaaggatgtttcaattaactgcaacatttcattcatacgtagtgaaacatcacaagtacacttactgaaacattattggcggaacaaaaaatgaaacgaatttcattaatagagcgtttctgtaatatgtgggtgatttgttgtaatgacgcgtgtggtggggtgtgtggtggggacgacgcaggaagcggtgagcgcccgatttttcttccgctgatcgagcgctcgatcggtgccatttccgatataaatcgatatgaaaacatgatatttgatgagtgagagccctcagggccgatttatatatgggccatcccatggtgggccggttagttctgttcctgggccatccacgaaggtcatgacttgggcctaaggcctaaaggagttcctccgtacgtgaacacattttactacggtaacaggttacaggctaacagccaatcaagttttggattaaacggttaaactcgactaaattacccgcgctattactgtaccgtgcgtcgattcgcttacctcctaatacacactgacggatgggccttggatgcaaaccggacccacatgtcactgactgataagtcgatcccacccacatccgcgctgatgttctagaacctttcgtaaacctcctctttctcatataaatcgggcccaaacgaaaactcccattcctccgactccaatccaatccaacgcttccttcctcgcaaagcctctgcgaatctcgcgcacgcagaaaccgctcccaaaccctagacgcaatggtggtcaccatcgatctccgggaggtcaccatcgatctccgggaggaggacgaggcggcggcggcggcggcgatgaaggccatcgctgggaggagcgacgaggaggtcctcgcggcggtgctcgcgcgcaagggtggccctgtcccgttcctccaggcggcgatcgacgccgcggcggcggcggcgacgaaggccatcgctgggaggagcgacgaggaggtcctcgcagcggtgctcgcgcgcaagggtggccctgtcccgttcctccaggcggcgatcgacgtcgcgcagcggcgatccgacctgttcctcgacccctccgcaccgggggtggtggcggagatggcggtggaagcccaggccaaggcggaggcggaggagaggcggaagagggcgaagggggagccgaggaaggcggaggagatgctgaaggaggaggagccgatgaaggcggaggagatgctgaaggaggaggagccgatgaaggcggaggagatgctgaaggaggagccgaggacgccgatgagagaggcggggagggacaaggtggagagggcagcggtagtggagcgcgtaagaggtgggtgatctcgcaccgtgaccttctaattgttcatcgtgttcgaatgcgaaatgtttgcgtgcttcggtgacctgtatgctcttattcgattatagattgtcatttcgcctgttgatctctacctcttatgcggaattgggggcagatattgagtttgaatcagcaaatgtgctttcccatcttgtgccaagctagggccacttgtctagacttcgatcagttttcgatctgtagtagatctatagtggagctataatcctcagatttcgaggttgcagatatggcggagtataaaattgccatgtagtagttttttattttcaggtccgatctcatgttgcacattggtggctgaagggagtaaaattttgatcaagtgcttactaattagtctggataaatcttaacattaaaatgggtggtggttctaggcatttatggcacatacagattatataaatccttcaagatttgcaagtagtttggtcttgttttcaacttatcaaaatttccaaatcgccatgatatgtttggttgatttaccgtgatcgatttcagatttatctcaccgcatcagtattcgtagagcactaaatgtgtagaaacaagaaggtccaaagtttggcagtagtatagtggttgcaatcagtttatatgcatctcgctatattttttttgaaaaattctctgtggattttcatattgttgctttaagacaatagattctgtactaagctgtcctcacgggtctaataaactgaatttccatcataatcgatctaattattgaggtttcataatttttactgtacatttgaatttcaaggtgaatcatgccttgcattttccaccttttgatatatcatttgctgataagtgtgattatacatgttatacctagtagtacacttttagattctgtatttcctgttcagtttgggtctgctgcttttgctaacttattggttgtgatttggaatttgtttctatctttaatacaaagatctgcagcctttctactgttctacatgtgtttcaaaaaggaatggttgtgcagtttataaagttgaaaggctactatgtgaagttgttattgtactggttctctattaatgggaacagcaacatttcaagccttcacatataactgttggatcatttgatcaatatcatcactcatcactagcagtattttttactgtgtttggttctcttacgttttctgtaattcgagtatcaacaaccgttgcaattttgtactgtagagagctcgctaccttattcctccaacaaaatatatgcgacatcctaatctttcgacttatagacaggaagtgctactgcattattacgaaactaaatgaatttattgtttctttaatcgctttgattgccaatttggagttcagtgcactgaaaggatatcctccttttgtattgcatgttagaccctaagcctaatgctggaaatggtctggacttggagaaatattcctggactcaggaaaggccagaggttaccataaccattccagttccccaaggaacaaaatcaagtcttgtcacttatgagattatgaagaaccatctgaaggttggactgaagggttgctcttttataattgatgtaagtggatatacagaatgttttatatagtctgctgctagattaaatacacaacaagaatatctctcatttgcaatagaagtatagaactgctggtataatgttctacttgtgtttcttttcagggggagctttttgagccagttaaagttaatgactgcttgtggaccattggtacatacatagtttgatgatacttgttacatttctcatcgatagcaatacctacatgactcttgttactgacttgacatgcattattttgtgataattccttcagaggatgggaatacactgtctatacttttgacaaaggaaaaccagaaggaatgcgtggacatcagtgataaaaggtgaccctgaacttgacccccgggacatgaaagtacctgaactccgtgattgtgatgttgaggccaaagagactattgtgaggatagtaagtcatggattgcccaaggcaatgaatttctgccccttcatgcacaatcgattcagttaccactgatcaagtttactaatttgtcttcacatttctgattgattcatcagagagctatggatcatgcaacaagtgatgatatccagcaagaggaacttctgaagaatgcccaggcgagtttcaggctttctgctacctttcctccctttttctttaacctctcattttctgaatcctgtagttctgtttgtactttgccaccgtttgtttgttggtgcttcaatgtatctgatgcagctatttcttgcagtactcgcatatggattcctaaggcaaaaattgaggatgttgaacccaagaagtgtacatacatcatcctttgacagagaatagaagttcagacacagaacagaaggtcacatcatcttttttgtaccgggttaggaagctcaaatactgaagacttctctgctagtacgatttagctctatggtaactagtaatcctcgaatcatagcctggtagtcacacaatgttagtctataaacatgaagctgcacctattcagaaaccttcctcttaaacaccttatcctgtatctactcagcagtaacatggtcgagattttgtgctctaagctctggtggttgtgcaaatggatatcggcatctacaaagcaaatgcagttcctctctctttggtttttgctcttgtttctggggaatcttttatcctgtattctgcagtacgttgtagtactatagtagtagtaggctacgagtagttcttatttgtactgaatgcggccggaattggtatgctggcctgcgagccctgagggcagcctatctgggcggattgttggtggcgggtgacagggggactaacatcagcagcgccaaggtgggcaaagattctgagccgcgactacgaccatccagcagttggcggctgctgctcgcctactctctgatgagatgcgacgctgtactaggatgctgccgcctccatcaacatcaggaacccaatcaactttctcgtacgcgcactgccccggtttctctttctcctccccatagccaaacagtggcgagcgaaacggacgcgcacaggcggaggaggcacagccgcagcactacgtaggaacagtgatgcagctgatgatatcatgatacagctattctgcaagggacatcggcagcatggccgggcgattgaacgttgccatggactgatgaaccgccgtaagttgatctgttgatgcctttgcatagttgcttggatgggaatgaggaatgggcacaacagggaggcatggcgaccacgacaacgggtcctgcctaatctttggaagccctatcagattatcaatgcggccatcactacacgatcttggagttgctgggcttcccacatgcacgggctataattaatcgatattctaaaaaaaaccatcacatttgtatacaccgtacactgtacaacagcaagtaaaaacggctgactatgtagccatttcctagtatggccttagcatattctccaggtccagggccttgaagagctccgcgacagagaaacctttattccattttacattgaaactcagcgtaagaaacagtgtcaaatcctctgattacagcctctgtttacgctggtaaaagatacgcctatctagtagtacagtaaattacaaagctactgtgtataattaactctgtggtgggtgctatcaagagcaaacatttgcacaactagtctcttctaataagatggagagcctgcagaatgcagggttttttttaccttctgttgttacacacattgcctacatacagggcaagacccatggccaacgagccatttgtccacgcaaggctggtggaaagtgtgggagcaattcggcaatctcctcgccgtttcaccggttacaatatcctgcaaagcggtaattaagcagtgacattgagtgtgtgtagggagtgagcaagttgcaaagcaaatcctaaccacattgcatttagtagcaggcataatttggtatgcaagttgccacaaaaggggaacataaaaacggaggtcgttgcatctccctgctctacatatcacaccataacaatcatgtcatatctactatccagctatatatatgtacttgaatgtttcatttatcaatctaaaaaatgggccgcatttcctggttcaacaaggtcgggaaaagctttggtttctggttggaaatcattgatcaagtaatagaccgtattcaatggtcaggacgagttaggtttaaaacgttctatgaagaaggtcaaaagaatttcatgaataatttgaagatgtcttcccatttacccccttggcaattatgtttagaacagttactactatatgtgatcagccatcactaacaaccagatggagacttgtagtggtatgctatcaccaattttcaaatcactggtgatcttgattttcttaacaaactttgccaaaaaggagaaagctcaaatatgctaactaaacattcactatattgtctgcaatcatgaaatggatgttgttttgcttttattatcgttgttgaacctaaaccatgtgcaaaattgtgcaaggcagccaggcaggtttgtcgacaacataaagctaattttgataaatgtacctgcaggcagatagtgcaagagaggtcttcaccaaacgagttccgtgtttggtcagtgaccacatagtgtggtaatttattcagtgactcccgtgaaagccctttggatgaacaatctccaaaaatatcatacagatcatcatgaccaaaatctgaaatgctgacctgttgacaaagaacataaaaaaaatcagtaaaagaaaatgcttcaataaataacgatgtgttccaataaacggtgattctgcgaaccgaacatcgtttccaaagtacccgggcctactagccaataaatttgtaccgttgtctcaactaaataaagtggtttaaaactaccaattttgcaaatagaataatgaaatgatggccagcagatcaggtttttcacataaaaaaacattttataaaatgagaaccatggcaaacaaaattgcatcagcagaacatgtaactgacctgccaacgatgcgttgcatatcctgaaggtacaatttgctcttgcacaaaccgcgcttggaggagctgctctatgaaatctgcctgaacaccaaatcgttatgaatttttcttagaggcgtatcttacaaacacagacgagagatacatttcaaaatcatggtgtcaagccgtcgaggagtaaagtaaacggcacagcatattggaagaagttacatcaggctaatgagcatatatctttcagagaaataaattcgtcaaatacttcaggtcacatcatctgaagtcaaacgcattaatataacttcttggacaaacaaatatgcaagtatggaagaagcttactgaccatggaggatgtgccatgagagcccagccggtccgagcaccaataagcacgagaagcctcgaggacctcaatggagagcacagctccggcgaacgcccccaatccagctccccggagcacgccgctgtctgaagcccttccggccagcgcgccggtcaccgctccggtcaaggccccagcttttacaaagcaccacatcaaacaacggacataaaaaaaaatcggaacacgtacgcgacgcgaggccagcaaagaacgagctctcacgggcaatgctcgctgtcgctggcgtcaaagaatcacatgaacagctcgagcaaggggggaaagaaggggcgggtgttttggtgagtaccgagagcgaagaggccggtgagagcgccggagatgacgccggcgagaagcctggggaggtacaccgccacgccgctctcctccagcgcgtcctccgcggccgcgacctccatcgaaggcaggcgcccccccgggaagcgcgcgccgcgcggtttcttggtatgccgcgtgcgtcgcgcgggttggcgtggggaggcggtgatgagagagagagagagagagagagagagagagagagagagagagagagagaggaggccgaggcgagaggagaggagagggagaggctctccgggagcagaggaaggtgaagacgtgaagtgaagctctctccaagctttgcttttcttttcgctgttgtttcgcaggcgactcgtgatgatgagacgatttatttgctttgctctttccctttttcttttttccttttctttgtagacaagagaattatttgcatttctttagttttctcatacggttgtagctttcaaggttggctcggggcccttttttttgttttgttttattctttcagaaattttcgcgcatgctccaaataaaaggcacaggattatgccacatagttgtcgcttaaatttacgtgcaataaccttttttttttgtgagaaaatatcctctcttgcgatagttgcgagaagagtctagaaagaagaatttcaataaatattttggttgcaactaagaagccagcgagtatatataattatgcgtatctctactctgcagttcggagtgcaataacaaaatgctagggccggccgaatacatttcattgttggatattaacacatttaaacagaactttagttgctagtttttattgtaacatatttataaaaccaatacgggcataatgccatcacaaagtacttctttaagacatactattcacaaattattttcatgcgtccaacttaaatattgaaaaatatataggtcatggtgtaaagatagttactagctcctattaggttttcaaattgtaggtcaatggtaaatttatgttttaatattttataaagagaaatttgttgtatttaatatatttttaatgtaaaacttgatattttctctcacagtttgtctaaaggacttaccgtcactcttgattaatcaatgcctaagagatggtttttggccatcaaacacaagaagatatttgttaagcatgtcctcatccaaatagcttgtgagttggaggtactccaaggtccttgtcgaaagctattttccttaaaagaaaaattgactgatgctttttttaagggtacaagggaaacgtacacagcaccattactataatatcgaagtattgattaaaatatgtttggtttctagcctatcaaaatacggcactgaaaatatgtctatattatcaaattttgataaaattagaagcaccaacaatatgatctcataataaaatctagggccactagagaaaataccttgcactcagcgaataaagcctgtgcgggtcgccgcacagtggcagtgctaactggccacttcgatctcagcttgactgaaactccccccgaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctccttaggctacattaggcagtgctccctccgtcctataatataagagattttaggtggatgtgatctaattgggagaaatactcgctccttcttcacgcacacgcttcccaaactgctaaaccgcgtatttcttataaacacattttatagaaaagtttgctttaaaaattatattaactctcaattaatcatgtcataatggatcatctcattttgagtattttctcaatcttctctttttctcttctctcaaacacatatgcgtagcagtgttcagtggacccacatataaataaaaaagactcgacaatggtgtacatttgttctaataaaagactctaagtgatgacatcatacatatgtaagcacgataccttagataccaaacctggtataagtaataccggacacatacccattgataccaaactgtagtagcaagctaccacatctagtattgggtattagatgtgatacctgtatatgccaaagtctgatacctagttaccatgtttgatgtcacacacgcacaaactattgcattgaaacggtattactgttttgtagtatttttatataaaaagcactacctttggttttaaatatctgttatgctatgtttaggagttcaagtttccaactcttctccctcgtttttcacacatactctttccaagttaaacgacatgttttttttaaaaaaaattctacatgaaagttgcttttaaaaatcatattaatccatttattagaaaagatatagctaatacttaattaatcatgcattaataaattgctttgttttacgtacgccatattaattcccaactcaaactaccgaacacaaccttactcttgaagcgcacaattttaactttcaccattgcaaaatttaaatgtttaaataatgatgtttgaaagtttcgtggttacatttaagatgcaatatacttagtatggcatatttcttttatatatatatatatattatatttatatatataaatatatatataagaaatcatagtttaaaaataaaaagtatataatgataagtatttgaaaacgggagtaattgaagttacgcgtagcgaatttggcaaagttagaaaataaagaaaaatccatggagcctatgcatcagcgctaacattttctttatctagcatctacctcttctattgtgtagaatcggtgttgatgttaagagtttctcaaatgtatccatgaaactagagattatgcatcattttttcagattcgtagtattaaaatgtctcaactttaattctaattctagattactatattttaatattgtagtaacaactcactatgtaaattagagaagcaaaaacatatatattctattagttagtatatcattatctaaaaatatatattagttagtatatggtattcattgctgttattttacttcaaagtgatatttgacgaataagagtacacattaatctggctgcggctatcacctatcagtaagtcttcaaagagtgctatcctgtaatcaatgtcggatgtaaggctgaatccaacgtgtgctgcacatacttcgctccatccatgcgggcgcattgagttttcttgaaagatacactgccccctattcacttcccaggacggagacggtacgccggtccagcccaatcttcttcttcaagcacgccacgcccagcatgctcgaaagctcgatcgatccagccaactaatcggggccatccggcgatgaccactcggcctaccggcacgcgcgcgtacgcgtgccgcagcgcttcgccggacagagagcggccccggccggcgaaacgagctagcggctggttccctgacgccacggcgacgtttatatcaacccaaacacgtagtcggcatgtgataacatccttccacttcaacaactttctatcgaagttgaaactttataagcatgtacatattcctctctcttaagtaaatttggtccggctatcatagatcggcccggctaaagaaaacacatcgtccgaccacgcctgtgacaacatcctttcacttcgacaacttcttatcgaagttgaaactttataaacatgtacatatccctctcttaagtaaatttggtccggctatctcagaccggtccggctaaaaaaaaaaacacgtcgtccggccaaggatcatgcacgccggcatcagcgtcgtttttcgaaccaacgtgacctgcagtaggctggtacttggtagaatgtcactagctcgatcagcgacaagtctgtcgaaccatgcttcttcacgcccaataatgctcgctggctttacgtatcgtcacagactcacagtgagagttaaaagcaaaccgtttctgacgcaacatcctcttcgcctcgcactattgcagaaatgcagagcacgccagtggcatgcacggttgcttggctcttcttcttatttccattttttttgctcagacgtcatggtgcacgtgagagaaggcgagcatgggcagcctcaaatgcgatctggttagtgctaggtgtgagtgagttgtggtgacgtggtgcgatatcattaggaggatcaaaccacctgtcaattcggctactagctgttttcctgttcatgtatctgtgagcttgttgctaccagcaaccaggttgatcagatcgattgaacactaattttggggagaatattaatgatgcttacctgccgcatcaaagattgtcatatacccattcgtcctttaatataagaaattttaacattttacttacattgtttgaccactcgtcttattaaaaaaaattgtgcaaatataaaaaacgaaaaatttacacacatttgaagtattaaagtagtctaataataaaacaaattacataatccacctgtaaactacgagacgaatttattaaggctaattaatccgtcattagcaaatgtttactgtaggctgtagcaccacattgtcaaatcatgatacaattaggcttaaaagattcgcctcgcaagttacacgtaatctgtgtaattagttatttttttcgtttatattaatactctatgcatgtgtccaagcattcgatgtgatatggtgtaaaattttaccaggggatctaaatagaccctaagcatattggatgaacattgcatagtttttagagaaaaggcatcatttcctcaaagagcattgaatagttgcacatacaaaggcataaaagaagtcgaatacattttattcaaaaggatcacaagcataccattggaagctgatcagtaatcagatagcagcaaattaagaacacagcaaggcaaaagttcgattattttcattcgccaaaaacaataataacttgctcatttagcagagatatatatagcatggtgtgcgagccagtaatagcgtcctcacagcctgcttaactgactcgtgctcgtccgatcaatcgtcgtaatcgtggcggcggcggttgttcttctcgtagcgctgcttcctctcgccgtcggagtcgtcgtcgtcgtcgtcgcgcttcttgtaacgcggcttcctctcgccgtcgtcgtcgtcgtcgtgcttcttgtatcgcggcttcctctcgtcgccggagccatcgtcgtcgtcacctccctaaatgaagaacagaggcaaagttaaggaggcctggaaggccggagtacacaagaacccatataaggcccgtgaagctaacgggccgggcccgtggaatgagctcacatgcttcttgcggccgccgccggaggtgtgccgccgctgctgctcgtcgtccccgtacgccggcttgggcttcctgtacccgccgccgtgcgtcgcctcgtcgtcgtccggcctcctgccgtggccagccgagaggtgggtctcctcggcaggtggcctccggccttgctgggggcggtcgtacgaggaggaggaggaggaggcggtggagatggggtggcatatctcgtcggagggcgggagggcgcggccgaaggtgagggcgatgtcgtagccgccgccgtacggggtggggtcgtactcgtcgaagtcggcaacctcgtcggcgggatggccgcttccccagaacacgctcgccatatcggtggctggctggctggctcgattcgatcgatcacggtgtacgttggcgggaaggcacggagggcgggaagagatagataggcgcggcaatgggccgcggcgcgcttggttcggggagttttcgtggctgggaactggtcaggtcgcgcgaccggcggccgggcatccattgcgttgcgttttcggtaacgagggccgcagtagacggtaacatggagccgaacaaaccgcgcgattgagtgtttttttttaactggaatttgagtgcttttagatgaacttgaaatagaaatttcacagcaaacttttttttgaacaaggagagccaaggtccccgcctatctatctattatatattattaaaggaatagaaaaaggaggctccacgttcgctctcatgacctagaaattctcacaataatcagagaaaaagaaaaagcaaactccatacaaaaatacaatttaggaacagctaaaattctcacattaatgggagaaaaagaaaaaacagagtccatatagaaataaaatttagaaatagctgaaattcagaattaaaaaataatgaatattagaagaggagactagagtccatatagaaacacaatttagaattaattgaaattcggaattaaaaaataaggaatattagaagaggggactagagtccatatagaaatacaattaagaaataactaaaatttggaattaaaaataaggaatattagaagtagagtataaagtccatatagaaatacaattaggaaataatagaaattcagaattataaataaggaatattagaagtagagcatagagtccatatagaaatacaattaagcaaaaaaaatagaaattcagaattaaaaaataaggaatatgggaagtggagtatagagcccatataggaatttaaaattaactaaaattcggaataaaaaggagcctccacgtccactctcatgacttagaaattctcacattaatcggagaaaaagaaaaagcagactccatatagaaatacaatttagaaatagctaaaattcgaaattaaaaataagaaatattagaagaggagactagagtccatataaaaatacaattagaaaataactgaaattcgaaattaaaaataaggaatatcagaagtagagtatagagtccatatagaaatacaattaggaaataatagaaattcggaattaaaaataagaaatattagaagtagagtataaagtccatataaaattcaattaagaaaaaaaaaattgaaattcagaattaaaaaataaggaatattataagtagaatatagagtccatgtaggaatttaaaactaactaaaattcggaataaacataataaaattaaaagtagagtttacagtccgtataaaaatacaatttacaaataactacatttcgaaattaagaaaaatatgggaagaagagtttaaagtcaatataggagtacaatttagaagtaattgaaatttgaagttaaaaattaaagaatattgaaatatgagtttatatagaaatacaatttagaaatagctgaaattcggaattaaaaataaggagtattagaagatgagactagagtccacatagaaatacaatttagaaatagttgaaattcgaaattaaaaaataagaaatattagaagaggagactagagtccatatagacatacaattaggaaataactgaaatttgaaattaaaaataaggaatattagagtagagtacagagtccatatagaaatacaattaggaaataatagaaattcggaattaaaaataaggaatattagaagtagagtatagagtccatatagaaatacaattaagaaaaaaatagaaattcggaattaaaaaataaggaatatcataagtaaagtatagagtccatataggaatttaaaactaactaaaattcgaaataaacataataaaatgaaaagtagtgtttagagtccatataaaaatacattttacaaataattaaaattcgaaattaagaaaaacatgggaagaagagttgaaagtcaatataggaataaaatttagaagcaactgtaatttgaaattaaaaattaaagaatattgaaagatgagtttaaagtccacatagaaatacaattagaaataataaaaattcagaattaaaaaaatattaaaagacgagtctagagtccatataggaatatatataatttacaaataaccaaaatttgatattaaaaataattaataactaacacgtatataaaatacaatatgaatattacacattagtagtttcgtaaagttattgcaaaatttaaaattatgttgtcattgtaatatattttataatataatgagaaaacatatattttattatatgagagaaaatataatgatactagccgtgcaatctgcgcgggccaccatgatagttaatttattaaagaaatagaaaaaggagcctccatgttcgctctcacagcctagaaatttccacattaatcagagaaaaagaaaaacatagtccatatagaaatacaatttagaaatagttgaaattcggaattaaaaaaataaggaatattgaaaaagaagactagagtccatatagaaatataattgagaaacaatagaaaatcggaattaaaaataaggaatattacaagtagagtatagagtacatatagaaatagaattaagaaataatagaaatttggaattaaaagtaagaaatattagaagtagagtatagagtccatttagaaatgcaattaagaaataatagaaattcggaattaaaaataaggaatattagaagtagagtatatagtccatatagaaatacaattaagaagtaatagacattcagaattaaaaataagaaatattagaagtagagtatagagtccatataagaatttaaaactaattaaaattcggaataataataaaattaaaattagattttagagttcgtataaaaatacaatttacaaataactaaaattcaaaattaaaaaaaacatgggaagaggagtttaaagtcaatataagaatacaatttagaagtaacttaaattcgaaattaaaaattaatgaatattgaaagatgagtttagagtccacatagaaatacaattagaaataataaaaattcagaattaaaaataaataatattggaagaagatcctaaagtccatataggaatataatttataaataaaaaaatttaaaaataattaataactaacacgtatataaaaaacaatatgaatattatacattagtagttttgtaaaggtagtaaaaaatttaaaataatgttgtcattttaatatatttgaataatacattgagaaaacatatatattattatatgacagaaaatataatgatgctagccgcgcaatctgcgcgggccaccacgctagtttccattaacaaaaatgagatttacagtataaaagtatcatactccctccctcccaaatatctagtcgtacaaatgattttaggatggatgagtaaaagattatgctatttcaggctgtcccaaatatctagtcgtacaaattattttgggatgaatggagtagaaaattatgctatttcaggttgtaaggctagggggacaacaattttaagcaacaaaggatagctacaacctcatcaccccacgtcatttaaccatactccctttgtcccataaaaaccaatttagtaccggatgctagtattatgaatctggacatacatactctctccgtccacccaacctaggaggggttatagcgtctatttgtccagattcgttgtactaggttgggtttttttttaacggagaaagtatgtttatatttgtaaatctataatatgacacatctgatattagattaatttttatgacacggagagagtacaactgaaaaggttttattcaaaaagactcagggatcagcatctctccctagggcacaaaaatcaacacattcaatccccctcagcagccttcattaaccttgcaggcttcttggcatgaccttcttctgcaagatggctcattgggaaataattgagatatagtgaacaacctgaaaaataacttccatgggatctttaggtaacttgttctcaaaacatgatttgtttcttaagccctgtttagttcacgaaaagaaaattttttagtgtcacatcggacgtttgaccggatgtcgaaaggtgtttttggacacgaatgaaaaaactaatttcataactcgtctggaaaccgcgagacgaatttattaagcataattaatccgttattagtacatgtgggttaatgtagtacttatggttaatcatgaactaattaggctcaaaagatttgtctcgtgatttccacgcaaactgtgcgattagtttttttttatctatatttaatactacatacatgtgtctaaagattcgatgtgatgtttttggaaaaaaaattgggaattaaacaaggccttagcttccaaatctcccaaagaaatgctgcatcccctactgccacaagttttttggtcctcttattaaaccccttcaaccagtccccattccatttgttatcccacaagcaaatgcacaactgagaacactccaaacacacctggccaaatagcaatgtaaaaacagatggtcttgtaggataacaattgatataataagatttgctcaatctttaaaactttctgaaaatgctggccatcagcacagcagggaagggagcactgagcacgattgaacaaccgttttctcctttttcattttcttgatggacagcaaatcatttttttttctttttcttgccatattacacaaataccaccatttggtggagaacacgagataaaggaaaagagagatggtatgaaaaaagcatgtgtaacttccgcccgccatgtgatttcctgagactggtgtttttggggaagaactgtgctaaacatttgattcgcgtttgcacagtttcttgccgctgttcaattttcctccatcgtggacgggtttggcagcgctggtcttcacagatggatacccagcacactaacatcatcacgctttccaatctcgaacacacaattggtgttactatacaaaaaacaaaaaaaaatgctatacttaggccttcgggcagctggtaacatcctcttttttcttactcgtcggtttgttgtactctctgccttggcgcttgagcggtcatgtttttcagcagtggtttcaatgaggccatgatatctgcaaatgatggccgcaattttgggtccctacaccaaatacaggaagcaacactgagaaaatggttgtgtattccgaaaatggaatgcaggttttagtgcgtccggaagaatgcagatgagcgacaaagtgagttaggcacactaacgtctgccagcattttgctattatttctgcaatggcgggatcagtgttatctggaatatcaaggcgacgattctgaaacccaacagctccgacgacttgcatggcgttcatgccttcccaaggttgcagtaatgtacaaagttcccacagtatgaccccatagctaaaaacatcgcatctgccaatatgcacagccatttaagcaatcacaaactcatttaaggtacgaatacatctgagagcttagtttttagaatttagaacttacttctcgtctgatggttcattacgaagtacttcaggtgccatccactccgcctgcacaccaacataaatattcagtgccaacaatgttaacagtcaatagcatagcacaaagatgatacccatacatagcataaatctcattccatagttcacaagaagtcctgacacccttaaatcatgtcacaaactactctaaacaatccagctagctatgaaatcttgcacagataaacccgaggacggtggactggagaattgcttataaagcttataagcttttagaggtctatatattgtttgtcagcatagtctttaatgcttagtactccctctatctacttttgataatcatatttcatcttgacacacagaccaagtataagtaattctacttatcatccatttaaatatgctagtaccagtcattcctcgtaaacaagcgattcattaatatttacatttctcgatgcccatgtagccaatcatgtgtgaagaatggagagtcacgcattaaattcgagaaaattattaagatgatagtttgttggattgaaatatgcctattaaaaataaatttttcagatttggaaatatgactatcaaaagtagatggagggagtatctaattagatagcatagtatttagtgcaatcaaggatcttattgtatgaaaccaagccaaactacacattgccttaacataaattgaccatagaaaatcaggcgaaaccagaagaacaaaaaaaaagtgtgattcaggcacaaactttatgtcacaaaaggctttcagtgaacactgcgtatccactacatggtaatatggcctttcagctggtcatttgtggggtggtcttattgaaaagatgatttgagtatcaatcatataaaatcctcaaagaacaaatgggcttatgggcataacacaaaaaatttccacagagagtaggaacattgctgtaaagtccaaaatatattttgagcccctttgattcatcactatcatcatcgatcttccttccagactaggataattggagttattccttcattccaatctttttttatatacatggatcacaatggattatacttcaaaatatttcaatcccttgttatatgcacatagcataatgaagagggaaaatactatgcacaagagtaatatatcatctggtataaaactctcccaatatgagagctgaaaaagcagacaacccaggctcttgccgcttgacatttctgaagagatgcacacaattgcaaagcataaagtatgttattttcataacaatgcacaaataattaagtgttgtagaacttaaaacacttcaaacaaatttaatcatgcagacggaagtacttcttaatctccctaaaattgcacaacatcgcaacaattaccattttaaatgtgcacaggattggtgctcaaataaagttataataaaatttctgaaatcgttcgagcttactgttccagctgttgatcttgatgacaagaaggtcttgttcttcattttagataaaccaaagtcgcaaacctagttgcaaaaacgtaagtggtttgcaacagaaattgaaggaaaatgaatttcattgctatcgtgcaacttgtgtattaccttcacaacccaattcttgtcaaccagtaggtttggagacttcagatctcgatggactatcaccggtgtgcagttatgtagataattcataccacgtgcctagggaccattcaaggaatcttagtaaacaatatttggcttctccacacttatcagttatcagcaactgtgttaacaataagttgagatttagagtcacaaatcatgcataccacatcaagtgccattcttaagcgctttctttcatccaactggttgttgggacgatgaattaaccgaaataagctacctctgcaagaccaatagaaaaaaaaaggggcaagaatgattaataatatagagttcctaaaaaaagtgagcaactatccccacaattaatgcactgttctttaaggggttgcaggtgaatgttccaaaatatgtctgatactatgacacaggtcaactgagtcagctcgaattacaaaacaggaagtttatctttttaacgcatcaaattctgaacaaaacattaactagtatatgatcctaagttcctatttcctacatgaaataaacataaatgtgatgtaaaaatttacaccaataacaacaagacataccttggaagaaattcggtgacaatagaaagattgggtacacgagtaatagcacccatgaagagaacaacattcggatgccgcaacctcttgattattcgcacctaaacatgaaaagtaatacattactataaggctcatatggtgtgtgcatgaggttaatatgcaaacatgctgcaagtgcaaacatgcacaataaaacacatgagcatgcacacaaacatatgaacacaggcaagaagccaaaacatctgtacttcagactatttggtcatttgaactaaattatggagtatatggtatacctcagttctaaattcttccagagcatcacttgaaatatcttgttgcagaaacttcttacagcaacttcctataaacaaagcgattttgatacactgttaaacataagatttgctagaactttcaagaagatggtgcataacaaaagatgggtcttcaaactaatgataacagctgaatacaaaaattagacatattaaaacacttttttcacaaaatattgaagtctgttgcgaagaaatcatacgtagctttccaggtgaaaacattttgatacaagactgggcaacagaaaactaatcaaatggctatagtggtttctcaatgtattatctttaaagctgaaccttttcattataaaatataatcaagttttttagaaaaaaaagtagggagttattctattcggtacaatagttgacagtggcatgaacattatgtatgttatctcagtgaacaataattcacatctttcatcctcgagagatcaaacagttaacaaatgtgccgattgcattcagataataacatggaacttgttgacaaattaaaatgtaagagagcatatttttactgaaacacttactgttccatgccactctcctctataaacttctccaaatgatcctggagcacagaaggttggatcaatttaagagaaagaaaaccacaataagattttacagacagtcaacggaacagtagcatgactaagaaaacaactgtttgaataaattgaaagaaatttaccaagaccaatgcgttccccaatagtaatttcttcccattggatttcaaactccgcaacatcatccagagtgatttcagattttgcactctctgttccgcttgacttatctgaggttctttcagcatcctggcgaacttcagctgaatctttttcttgatccaaagtattatcttgaccatgatcaatttcaaaattctgtttatcccaaaactcatctgcacttttctcgattgattcattcccttcggagggacttggtaaactatgcag

SEQ ID NO: 57701 - DNA, 10337 bp, Oryza sativa
cagatattgctgaaagaatgatcatcacattagatgagcttgaaaaggcaactaacaactttgacaaagctcgtgagcttggaggtggagggcatggcactgtttataaagggattctatcagacctacatgtggtagccatcaagatatcaaatatagtggtcccgaaagaaatagatgatttcataaatgaggttgccatcctctcacaaatcaaccataaaaatgtagtaaaactaattggctgttgtctagagactgaagttccattgttagtttatgaatttatttccaatggaaccctgtatcaccatcttcatggtgagggtccaaggtcgctatcatggagcaataggttgaggatcgcagccgaaattgcaaatgctctttcctatcttcactcatcagttacaatcccaataatccatagagatataaagtccagtaacatacttcttgatgataatctgacatcaaaggtatcggactttggagcttcaaggtatatcccaatcgagaaaacagcactaacaacagcagttcaaggtactgtaggatatttggatcctatgtacttttacacgggtcgtctcaatgataaaagtgatgtctatagccttggtgttatgctagtggaattgctcacctaaagaaaactattttcatatttgtcctctgaaggtgatggccttgttgcagattttgtcaacttacacagtgtaggtaatttggtccaaatgctatattctcaagttatagaagaagggggcactgaaatccaagaggtttcccaactagccatatcatgtatagaattaagaggtgaggatcgacctaccatgagacaagtgaactgttcactcgaaggcatcctctcacaaatcaaccaaaaatgaattatgtcatctgagaaggatgcggaggatagttcactggttggtggagaaatttgatcttcgagaataaggtttgatggttattaatcagttgtatgtaaactattgaagcgcaaagcacggggaaataagcatcgtacttgtaacatgatcaggttttgatgtttgtgttggccatagatatgcaatatatatttaatgttaatacctaaacatttaaaaaagttttatactcatttgaattgggtatatactcaatttcaaccatggtgcccaggcaccatggagcactaaacaattttgagtggtgccagttgattttgtggtgctgtgcatttatgttgtgactggcgattgcaactttgatgtccgtaggtgttgtcttcctcctcggaggcatcgatatgtgggttgcacttctttcaggtgaaaccctagttcggtgatccggatgggcgttggtagtatccttgatatttgtttcctccttggaggcttcgcatggaagtttgtgttccatggttgggcaggaagtcggagctgcctatatggtggggctagcttggcaacaaaaaaagtcagatgcccattcaaaatttttcatttttctcttctttcccttttcatttgcttttttgttcttcttcttttagacgccgaagctccgtttgtcaatgtagagttattgatgataccacgttggcgcttatgtggcatgacacatcagtgccatataggatcttggaagggctgtgacagtttgggatcggaatgacacattttgtcgagttctggtatctaaatatatattttgatagtttggggatctagatgacatggccgtacaagtttaggaactgttcgtgccctttactctttcctttaatttacaatgcgattatgttgttttcaggcctggttttcctcaaacaaggccaactcttttttcttcttaataattagaaaccttatccttcttcttgatgtttacctcaaaaaaatccataagggtttactcccttcggtttcataattcttgacattttagacaatgttgaggttaaacttttgtaactttgactatcagtaactttaaaattattttgtttaaaggaactagaacaacatatataaatttatgtttcgaagtactataataaaagtaaacatgcatttatttattgtatatgttacaataaaaaaaccaaggtcaaagatatattttggagaccatgccattgtctaaaacgtaaggaattatgaaactggatagagtaactagctagaagcttgataacaaaaatctcccagtttcatcggcgaactaaaagaatttaatttagaaacaagttttgacatattaattccattgaaatcattatcatgattaatatttcgtgatgaacaattggctttgcaaatgacttatttaataaaaattggttcgtaaatatatgtggatgttggtgtgggtacgtgtgactaatgttggtcaggttatgatatttatgcctaaatacatttgctttgcctttttgtctcttcaaatcaagctatcaatctttgcaaattgcgtaatctaaatttgatcgaacatagtctttgcgtcaacgaaccatgaaccagacctttcaataagaatggttacatcagagacattgcaaagtaagtaaacgtagtttatctactttgcaaaattggtgtcttcagatcagaacttagcctaggaaactatttgagtttacgtttgcaacaaaccaacatactagtcacattgctgcagttttctatctctacatgacacattaatctgttttagatttgtcacgaaaatagaagatcttttttggaccatgaatctaggtattctattgttcttattgaggtcaaagtttgtcagtactactggggaaagtgaacggctgcactatgacaactcgagttctgatcttgtatgtactaaatttatttcgctccgatttagtagcatgttcgcatgtacttagttgctaaaactcataggcctgacgaagttgcgataaaccaacatactagttacttcttgcatgtacttagtttgcttattttgcacattaattaagggagaatataagcccagaaaagctgatgaagtttgcaccgcaaaacctgtagctttagcgcagaaaagctgatgaatatacctattttgttttcatccctcgtcaggttactgtagctgtttgacaaaattcagaacagagctaaactgagttcagtatgaagggtcatttctgagacactacacaactcttctagtacaaacagatacaataatatatacatcaatgtggatcaatgcatcatatgcatttaggatacttgttctaataagttccatctatgacaaaatatacaacccaactaagagtgttgtagacctgctccagcttctttgtcttcgtctattcatagtattcgtcagagtcgatggatgaccatgcgacctgcgacattcgcaatctttcatctgttcttcctgtcaactttgcccagacaacaatcaccttcacataaacctcatcatacatattgtccaagaagcaaaagtaagcaatcctccaggatttcttgaacaaaagaatatagaaaaccacccataggcctgccataaatcccactgtaactccaatggaaaatgaccctatgtgaaaaccttgtttgcttctgatctggtaaccttgctttgaggcatcatacttataacaacttttttggagaggtggcccacaaagaccatcattgccgtcatacagatgatggttttggtcatagaggctacaaagttgtgtccctgatggtactcttccagtaagattgttataagataggttcaaataacttaaatatgttaaatcagataggctttgtgggatttcaccatagaaattgttcttcgagaggtcgagtgattccaatgacttgatggccccaatcatgtatggaatttttccattcaaattgttccatgacaaattcaaatttataattccgtcaagagaaactatgccttcaggaattacaccagtcaaaaaatttgaagacaagtcaattgtcacaactgttactttttcttggttgtattgtagttcctgtcccttcatgttcacaaaagatttgtagtcacatccagatagtctctcttcatattttgtggtatcatggtttatcatcattcctgttaaatttgacaaatgctgaggcaggggacctgataaaccattgctggctagatccaaatgagaaagctttccaaggttggtgatgctgtcaggaatacttccagagaacatattgtgcttaagctgcagaaattctagcttgttaaagtttccaatccatgtaggcaaagtcccagagaatttattccatgacagatcaaggaaacttaactttgtccaaccctgtaaaaaagatgggaagttgccagaaaaactattgttacttgcacgaaaaaatgataccctgctcattagagaacattgagggaactcgccctcgagtagattattggacaagtcaaggccatttaatttctgcaattcacaaatagactgtggaacatcaccactgataaggttatatgatatatctagtagcataaggtttctcggcatccgaggaattcgatcagctatgtggttgcagtccaaatataatttttccaatgacatgttttccatatttgttggcaagcctccagcaatttgattctgcgacatctccaaaaacgtggccttcgaaaatgttgtagagaaccagtctggaaatgtatcatttattccagcatcgctcatagcaagttcaagaatatcgacttgtgattgaagccatgagggaaatgagggacccatcgaagtagatgcaaagtatgccttctctaatctgaagggaggtaaccattcaggatccactacaatctccaagtaattataacacaaatatatcgacttcaagctcgttagattggcaaagtgctcctctgtgatgacaccatccaggcaattgtaatggaggtacaagtttgtcaaatttgtgagcatacctatctcagaaggcacttgtccagtgatgttattattaaagaggtcaagagtgactaagcttgttagcctccctaccaattttggtaaattcccagtcaaattgttattagccaaatgaagttccttcagtttgttgggtgaacactgtggtaaactctcaaatatttctgaaatctctccatatgccagtctataatcaaggtcaagaacttccaaattgcacagattcttcaagtttgccttcatgatgcacatgttacctttcttcgaaacactcatgttgtacgagaaatcaagaacttggagggacagcatgtttcctagtgcttgtgggatctcaccatacaaactagtcgaactaagattgagatacttgagggatgtcaagctccaaatccaactagattcagcttggtcactaagttcataattgttggaaagatcaagtatctcaagttgcctgaggttaatctgtgtgggatactgatttgcactctgaagtgagcaagaagaaaggctaaggaacttcagagaagggatcatattcagaacatgaggccaatcgagtactgtgctaaggtttaccccgttaaggttcagatattgcaaattggacaagtgtgctaaccatgaagcatcactaatgtacagaaatggagccatgctggagggcaacatcccggagaagtcgagaaatttcagatttgaaagcttaccgagctgaggtggcaccatgccggagaacactataccagatagattcagatatctcaagcttctgaaagagcccaagaactcagggacatgtccagttggacctgccaggttgttcatgctgagatcaaggtacctgagatgctccagcgagatcagagaatggcctatctcgccaaccaaacctgttccaacgtcggcgtaatcgtttcgaaggttaagcttaacaacatggccggtaaggttgttgcaccgaacgcctctccattggcaacaatcctcttccagcagctgatcatcatcatcatcatagtggcctcctctttgccagaaggagaggaggcctgcaggatccttgacgatgccttccttgaacgccagcagagcgtctctctcccgcggtttccagccgccgccggtagtgatcatgaggaggaggaagaagaagaagaaggagcaggtggtggtggagacgatgataatggccgtactcatggtcggccggccaagtgattagctgctgtgtctgtgcgatactgtgatgttacttcacactactgttagcttagctactggggctttgatgcaagcatgtgttgttgctcggcattaataagcgtttcagactttcagtgtagaagctaggtcaagtcgtcggtggtttggctggccttctcccctcctacaggatcggctggtgttaatagatggctccattaatcaattgtgtattaaaagccgaaggggcttgatgagaatcaatgccgagcattatgcactactggagaaaccatctttactgggttaaccaaaaaccacattagtaccggtttgaaacaggactaaacttttttttcccgattaaaaagcctaaccgattttttttatctttagtaaatatcacttttagtcccggttccaaaatcgtcagggacctcactatcttcagtcccggttgtttataccaaccgggaaaaaaaaatctcgcgcatccccaatccttatctcctcgattggcacggcaaccacgcgccggcctcagctcctcatcttatctctggaactaaaccacgcaaactccacgtctcctcttcctcactccatatgcacgcctccctcccatctcctctcctcatccctttcccttctcattcccttctccccttcccctctccggcgggaggcgggaaatgaggcgacggcggcccagcggaaggcagtgcacgaggcggcggcggcccggcggcggcggttggcggcctcccctccactagatatgggaggggaggcggcggctgcagcggtgttgggggcaatgtcggcaatggccgtccggaggcgcacggctatggtttttttttaagattttgtgaatgatctgtagatttttttagatttgtggatgattttgtgaatgatttgtggatcggcctatgaatttgtagatgattttgctgtggatgacttgtggggatttggggggtgacgtcgttggtgctcaaagcacaaaacaacggaaaaaaaaaactttaatagatggtagtgctacatggcgttaccatttttaggttaccaaccggggctaaaaatggatctttagtcctattattttaactaggactaaagatacctatttaatttagtctcggattcggggtcccgatttgctactcaggagtaaagggggttgcaaaccgggataaaaaggcttcccccgtagcgatggtggataataatttttaaagtcaaaatttttgaaagttgaataaccaagttaatagaaataaatagtaacatttatggtataaaattagttttattagatctaatattaaacatattttgatagtttctttgttttacgtttaaaatattactatttttttctataaagttggtcaaaacttaagaaatttaaaaagaaaaagacaaaaatgacttataatataaaatgaaggtagtaacttctatatagttcggtgttttgcaaactgcttggttttaatatatatgttgcatactatatttattcccaaaattttgtacaattgagatattctatatagtaagacatttttaactttttccatccttaatttaatccatataataagcataatatatgatatactcctccctccatttatatatgttgttctgaactagccaacgtcgtaaataaataaattaaaggagggaccgattaagttttaatatttacaataactaaaaagataagcaaatcaaagaacaaacacaagtaattaataaacggcgtgtacatactcaagctgtccatttgttataagacggttaaagtttataatactaaattagtttcattaaatcaataattaaatatattttcatattaaatttgtcttgggttgaaaatagtttgactttgaccaaaatcaaaatatcttataatctgaaacggagtgagtaggagaaaatctcgttagtctagctatagttgcatttcatatcatgtgtatgtgtgaatttaaataccacacgtactggtgctggtaggctaagagttagagaagaactttgagagacaaacttcacataatagtttcatgtatttaatataaataattaaaaagaagataaatatatatccactctcgaagtccagatatcatccacctacactgccactttatgctcgtgattagtatagaccagatcaacggcgacttccgtgggcatgttgcttgttttgcagttgatcgagtcgcttcaaattactatctatactatcatcttttgacagtcacagtcagtctctataaatcaccatcacaacctcctccaattaattattttttgcatattttcttagtactcatgtccactttaaaaattaattatattttaagatggggtagcagtaagacatgttctaggagataggcagtactccttggcagtcggaatgacacaagtgattgcaacttggaagaaatatatcctatacacacaagtatttttaccggctaacaaaattctaccaataattcaagaaaaaattgtgttacatctatggattacgtttatggatggataaggataacgtctgatcttataattaatttaaccaaaacgacaaaattctaacaaattaagaggtcttaaaactgtcagaatttttatctcttttattacggctaaaatagagtgaatttaattaaggttaagaatttacacacaagtatagtactattgaagtacatgtacattttttttaaaggtttagtaaaaatttgttcgttggtgtgcatggtgtgttcatataaagcttttgtgttcgcaactaagatgttggggtaagatttcttctacatatagtaaaattctatagcagaatttttaaaaaaatgataactaaagtgaaaaacaatctttccacataagtttaatatttgcaacaacataaaaatcattatatatacatcagcagtacagcaacaccgagcactaacataataactactccattcaattttgctgttacattattgctcccaccaatttaaacattctatacagtttgactttacaagacaggaagcttaatcgagcgctaaaaacagctctgaaatcgtcacttaataaaaagatgcaaggtaaaaacagctgtgaagccgcgcaaagattgagatttttttatataggcccttggtttatctcatactcctattaccgttacggagaaaagggaaggagagggcaacggcggtggcggcgttgtggcgaacggcggcggtggcggcggcgctcgcggtgttgacttaggaggaactcatctcttcccgcgtggttgccttcgattcggcgaggagaatcgtggagcgcatggcgccgccaccctaccccggatgcggagcgggatcaaatccgctcctgcatgcaggcggcgacggcgaagaactgaaaaagccttgtcctcttggagcaaactggtgatacctcccctcctttcctcttatcccctgttttgtcctctgttttgctctgcttttgtggtgagattggtcagttcaagaaaacaaaattagtttccggtaagattaatctattatatgcatatgcgtgcagtaaagcaatgagatgatactagacagctaaattgaagaatgggtgaatgaaccggacccaaatcatgattcagataaattttggtgagtgggggtgctttctctgaaaatattgatcccgggtatatactactatggctgagaatccccttacagtttagggaatctctgaaagtaagaacgattaacacaaacacaatgaatctgacaaagaactaaccaagctcatccacaactgatgatacaaattataacatggtggactacattacatatggttagtggtgggcagaaaattaatcaactatcagacaacattgactgtcacaccactaacacaggaaacaaaagtatacagaatgacattttcttttgagtgcctctccactttcatttattcattcataccagtaaacctgtcagttgtaggaagcagaacaagcatatgatttgaagtgcttaatttgcagttgcctgtctaattaacctggcccaagtaacaagtgcaaaaacatacgctttgtcgtataagttgt

SEQ ID NO: 57702 - DNA, 4260 bp, Oryza sativa
tggccccttgatgattgcacatcgatccccatgggaaccttgtccagttctttccatatgaccttgctttggtacattattactcgaacaattcttttgaagtggcggcccgcagagaccactgttgccattgtatatgtcagggtgttgattgtagatggtctcaagttgtgaccctgatggtatccttcctgtgagactattatatgacaagttcaaataacttagaaatgtcaaactggataggcttgctgggatttcgccatagagcttgttctctgataggtcaagcgatgccaacattctcatggccccaatcttatatggaatttgtccactcaagtgattccttgatagatttagatttactaatccaccaagagagactatgtcttcaggaattccgccggtcaagaaattggaagacaagtcaatgttcaccacttccacattttcctcattatattggcgctcttgcccttttgtggccacaggaaaagtataagttactcctgatgctggaggagtctgatcagcttcttcatatggttggcctatcatcgctagtatttttgacaaactatttggtatagcacctgaaatattattgcttgcaagatctaaatgatgaaggtttgtaagtttggtgatgcttcttggaatatcgccagagaatgaattatggctcaaacgtaaaatttgtaactcagtcaagtctccaatccatttaggtaatattcctgataatttattccatgatagatcgatgaaatgtagctctttgcatttgcgcagaaaagatggcaagttaccagataatctattattacttaatcgaagaaattttaggtttcctactcccatctcaaaacatcgaggaagttctccctcgaaacgattgttacctaggtccaaggcctccaaagctcccaagttgcataaatatcctggaatatgtccactgatttgattggagtagagattcaggtgagcaagatttggagctccaatgttggatggcaaaggtcctgataggtaattgttgaagatgtccagtgtttcgaggtttattggcaattcaggtatttcaccagttattaggtttgaatccagataaaatgtctccaacaacatggtttccatatttgttggcaatccaccacggatttgattgttggagatgtccaaatatgtggcctttgaaactgttgtccagaaccattctggaaaggtatcttttatacttgtgtttgctatgtcaagttcaataatatcaacttgtgtttggagccatttaggaaacatggggcccatttgacaacaataaaaatatgcatactttagtctgaagggaggtaaccattcaggatcaaccacaatctccaaggaattataaggcaaatatatcgactccaagcttgctagatgcgcaaagtgtttctctgtgatgactccatctaggttgttgaagcttaggtccaaatatcctagatttgagagcatacctatctcagaaggcagatgagaaaagttgttgtggcctaggtcgatataggccaaatttgtgagcatacctatctcaggaggcaaatgaaccaggccattgtagcttaagtccatccatgtcagatttctaagcatgcctatctcagaaggcagttgtcctgtgagatagttttgtgagaggtcaaggtatactaaactggaaaacactcccattgatattggcaggatgcctgtgatattgttgtatttcaaaatcaattgctgcagtttgctggccgggcatttcgccaaattatcaattaactcagttatgtttccagatgagagactctgtgtgaggtccaggatttctaaactgcatagatttctcaagttctcagccatgatagtgatgccttcgatggcggcatcatcgtcaccggaggaagggggtgcttggctggatggaagcagacctattggtgagataggtacaggacgattaatcgaaaaatcgaggacctggagggatgtcatatctgccagtgcatcagggagttggccatataatctgttcccagaaagtatgaggtccttgaggcttgtaatgttccaaaaccaacaagaagcagcaggatgattaaactggttcccggagagatcaagtctctcgagccgggtgaagttattgtgaaggtgagtcagcttttggtctgctctttgaagtgagcaattagagagattaagaacccttaaggaaggaagctggttcatcacatgaagccaattatcaactgcgctgaggtctaccgaattaaggttgagatactgtagcaaaggtatgttccttaaccatgtcatgcctgatcttgactgcatttctagccctatgcaagatgagaggtcaagaaattgcagctttgagaggttaccaagctgaggcggcaccacgccgatgaacggcatgccagagaggttcagatatctcaagttcctaaaagatcctatgaaccctggaatgtggccatctgaaccacttaggttgttccagctgagatcaagatgttgcagatgctccaaagaaagcagagagggacttatcagtcctaccataccgtttccgacgaggctcatgccatcatcatcaaacttgggcttccaaagttgaagcttgatgacatggccggtcctgttgctgcaccggatgcctcgccactggcaacagtcgtcgcctcgccgccaaaacttgagctggcccatcgggtcatccgtaatgctgttcttgaactctagcagcgcgtccctctcgcgcgggatgcagccaatgggagcttgtgcttggccattggaggtgaccatgaggaagacgatggaagtaaggaccacgatgaaggtgcacatgggggaattcatggtcaagtgattggggctgcttgattgctatgatttggtgcttggtgtgtgttattaagtgcagttcattccattgtgttttatagtaaccagttccagggcatcactaccacgaactctttcctcatctgtgacgggttgtaaccatcagttccaggacatgcacagtgaatgtatttttggttcaaaaattcggaaccctctgcccccaccgcaaggcatttttttggccgaaattttccattttctcaaacttttgtgtattttcccaaaatttattgaaattcagtcaagttgtgctaaaattttcaataatttcagtccaaaaattgcctaaatttcaggagtttttgtgctatcgaaattacccaaatattaagcgaaaatcgaaagtgaaaaatcctgggcatgcaatcatacatacaagtcaagtcgtcggtgtggatgtacagttttgtgtcaactggaattaatactgcgtgctagttaatgatcaaggcttctcaacaaacaggcaagttgtccactagttacccctgtaacggccacaggacatccttaattatgcccgaaatccacgtcttactggtcttaggtcattcaataagcagaaatgtggcgtgttagtcggccctctctaaaattccttctctcgatctatggaaatgccatttttaggtgcacatataaatggtcattttcttattgtgcacacacatagttttatgcataagaaatgtgatcagctgattcaccatcgttatggaaaataacctcacatatcttgatcagtgctagtaagaagatggacctctcagatcgtaccgcattcctttgtccgttatactacatgaatctgtgactgatgctggcatgccaattgacctggacatagttataagaggaccttcatagttatgtatagcatgtgatcaactctctcatgacctcccatctcaattataatggtgttttccactaagctgggaccaacggtggatacaggaaatttttagagccgaataaaactacctaccttgaatatttactttaaaagaatgtcttcaaattgctgcactaacatcgaaattttattatgtgtttgcctaccagcctaggcagctgccggagttgtcaggtctattagaacaggtgtcgaatatattagttctaacaggttacagttcgatttagaattattatcgatgacacgggtagggttagagttgacctccataacgcggcaacccttaaaactgagagagagttgccataatgtaaccatggtacttccatgtagttgcggttaggccacgactggattaatgctggtgtgggtcgagtgcagtcaacaaggtggcg

SEQ ID NO: 57703 - DNA, 6564 bp, Oryza sativa
acggactggatgagctagtctgagtccggcagcggggtcatcggcgggagggagaagtggagctgccgctgcggacctcctgcatggtgagcagggcggcaacggtgttgcagaagatggtctgctcggcggcgtcacggagaggaggtcggcggcgtaaaagggctggcgcaggcgctaggacgccgacaatgacggggaggcggagcacgccgccggtgcgcttctccgtctccgcatcccgcgccgccgcccgcacccacctccatccatccctgcgccgaggggtggctgctcgtcgtggccacggctgccgctgcctcctcgtcccccgcccccgccgcagcttcgcgtcccccgcctgccgtcgactggcgagaaagagagaggaagagtgagagagaggaaaagagagagaaagagtgagagaggagtatggcaggtggatcccacatttctttataaataaaatgctgatcggactgccacgcgtacgctacgtaggataaaaccgctctggattgagtccaggggggtaatttgtccgatattgaaagttcggagtgaacgatgtctggttttcgagtttaggggggtaattcgatcgaccgcgatagttcgggggtgggtaatttatactttttccttaaaagttaccctcgaatcgatgaagatcgatctgaccagaattgatgtgccgatttgacatcccaaagacctttggtctaaccggtgttagtaatccggtttgaccgcccggaatcgccatcgttgcttgttcccaccgccagtgtgaccaatgaggtcccgccagttgaaccaccgaacctgagaaaaacacaaattgcaaatctcccaaagtagaatgaaactttcttacttctatttgtgtttacaaaatacaacatcatcactcatctcagaaatcttgactaaactcgaagtcctaactttctctaaactcaacttactaaaaatcaatactgggaggcctcactttatatttatactcgaggtaggcagcataagcctataatctaacttatacaagaagccctaatatcctaggaaaccttcctgtataaaaaaacaaacttttacaaactctaatggtaccaaatttggactcactccaaatttaactcctcatcccacacgaacacaatatctccatcacatgccatatggaatctccatctaccacgtgcattgatcttcagcctaagcaccccgcaagatatcctgatcgttcagacgtaatcttcccccaagttgactactgatccatctccgacaatgctctccaaaggcatcaagactcacctacacatgaatcaaataagaaaccatatttgagcacaagttcactctaactttactcaacatgagcacacaacaacattacatatgcataggaatcatctaaaagtcataaacacgaattaatcacgagtatccaattaaacgacccgaaaccaaaaccgacgcagagccggtctgtcataccgtcaggttggtcggtctaactatgcaacacacgccagtctgaccgacagcacctgcccggtctgatcgatcccgttagacaaaaatatctgttcacaatatgaaaaccacatatcttcaaaaccacttcgccaaatatctctaaatatcaaaaccaactatcgcacatgccaaatgttcatcacgaagtaataatccaaacacactttgatttcacaggaagaaatgccatagaagatccaaaactgataacccacgttggccccataatttcttaatccaatccgcacagtaattatcttcttaatcctccctaaattctcacggacatgtgggccccaccgtttttaatttctatttaaacatcctattaatccttgagtcgcttacatgtgggacccacctttgtttatccgttctgcgcgcccggtccatgtgcatcgggacactgacctccgggtcccacgagcaccgacccgtggatcgtgagccgatccaccacctcaccgcgccatgtgctcggtggactcggtagatcgtgcaccgaacccccagtgccactgacagtgggccctacgaggaatattcttccagaatattcctttccattaaaaagaaactctttttcctttcgttctgaaattaacttgaacttcataaatagatatcttgcaaacggtaactccgtttgactccgttcaactctcaaaatctctataaaaatgagatctatctattggcaatattatcgcctactattttaggtactttagtggcttttgtgttgatttactcctttttgcgtgtagttgccaagcctgaggacgatccgtaagccattcttgatgaggaagaaccacgcaggaccaaggcaaaccacctttggccatattgcttcctatatgtacaaaattatgttgtttggaaatatgcatgcttagattacacgttaaactgtttggtctcggtttgcgaatgcaaccgacggactcacctattagtcgcacttgaatctagtaggatattgaagtaacatgtcctggacagctccacagataatgcgtcggtaacttaccatacaagtatgatcactgaggtagttttgcttagctatgctgcgattgcattgtcgtatggggaaacatgggtttccaaccaaatattcaaaacccgagattttattttggtgtgtttgataaatgaaactggattatgaacctggatgatatgtaggctgaacctgtgtgattggctatgtattgttgttaaggaccgattcatttgggaattccatccaagcatcttgtagtacttagtttgtttgtgcctaccttgtgtgtcagtggttggggacaacggggatgaggagacggagttttgtgttgtgagattttgaccattcatggcaatcgtctctattgtgctgcttacggtacaaataggtgtaggagcatccttgactccttgttgtaccccgagtagacgatggctagccagcctgatgcttgtcgtgcgattcaactaactatgtggcatggggttttcatgaactagatttagaaaggccttgccacaaacttctggtgtcgacgggtgaccgttggtagtttcgtgccatgtgggtaaagcgtacaacctatgtggagtgtaaactgttcgaacagctgtgcttacggtcaagggcgaatgtgaggtgattttcttagcgtagcactgattttgaaagctttttgaaattggtttgtgggatgggccggaatcgttccagagccggtctgtgtggcagacggagaacctgagtggtttcaaacaggtggggtgtcttgtggcaccatagtggagctggaatagttggttaagatgtgttgcgagatgagatggctccgcggttcctagctataagcagtactccgtccgtcccattttaagtgcaacaatagttttccgtacctaattttgaccttccgtcttatttaaaaattttttgaaaaaagttaaaaacataagttatgagtaaagtactattcatattttatcatcttataacaacaaaaatactaattataaaaattttttaaaataagacggacgatcaaagttagacgcggaaacttatggttgcacttaaaatgggacggagagagtaagaacttggcagctgatcgagctacgcgtggtggcagagtgagccggactgacaaatccatatattaattgtttataaacacactagctagatgccagagtttgctgtggaaaaaataaactactagaaacaaaatgtatagatatctgaattgactcgcccgttcactgccagaaaattgcctaccgtgaaaggtgggcacagacacatgccctgtttaaatcccacctaaaatttttcactctgtcaaatcgaacgtttaaatagctgcatgaagtattaaatataggcttaaaaaattacacagattgtgactaattatttgcgagatgaaccttttaaaccaaaatgctccttgatttgataatgtggtgctacacaaaacatttgctaataacggattaattaggcttattttcacgtgcggtccacttaagaggcccgcacgtgaaaatcgatttttccgtacggtcctcttaaggagccgcagatgaaaatggagaatgatttccgcagaccgcaatctaaagagctccttgtacagaaaaaaatcgtttttatagtagtgcaaccggcccaacccaagcttcaaactcaagactcaacttctaaagcaagccaacatagagatacaaaaggagatggtttgagaaataacagaacatcggaaatgtggcatcctggtggccaggcttggcacctcggcgatctatctccgacttcccttcttcttctactaggtgtccttggctttcaaaacattctagtaatttatatccccttgcttctattaaagtttatgccgaatatgtgtataaagttggttattatttaggacttagagttttaataggtgtatggtagagatagagttggactttgtcttaggctctttcttaaatagagatgcgtatatgttgtaaccacatggtgacttagcttaggcgagagagaacggatgcaagcggtgtcttgccaagggttgttgtaactctgatacgatatataaatatgctggatcagggaggaacgtccgtaatcagtgtcccagagatataggctatggttggactccattatcaaatatcgttcctcagtgttgtcaccagtgtggatcttctatggagtttcattcacgtttagttattgatggtgatttcaagctggttttataacaagtggtatcagaatttgccggagattcatggtagagatatgagggaagtggtttacaccgcaacaactacttaggatgtcaaatgatggacatggacacaaggtggagcacaacagcgatcaacggaatttgatcggttgaatcgaacacttcaatggttgctttcagcgacagcagtggtctgaactattcaatggttgctttcaacagggagacgaccagacgtggtgctcgggttgatgttggcaaaagtgattgatgatccaattggtgcaattggatactttggacgggtgactcgaaatttctggtgagctacttctaagttgtcatacggttagaacagggtcatccctctgttgaagagagagcctaggatagagtataactctaccctacacctattactactcccaagtcgtaaacaataacctacttcatacatatattcggcacaaactctagcatcttcctctttctcccttacaccaaacacttgtttgtatttgaatgttcctgtgattcactgaagtaggtttctaacaaggagtgaactcataaccaccagaacagaatacaagtgaacatgctctgagcatactgatcctcgattgcggcgtatacttatgtgacctcttccttgtagcttaggaatctgtgatgtaatgaaggattgacactacaaattgatctgaaaagaacagcaggtttatcacgactgactatcaaattaacaacctacgatgatacagattaacaacgtacaacactgtcagtgatggaaacatagtgcgtttctaggactccacatgaattgatgggcgcagaccgaaagacctcatgtcgctagtctatgcgatctctaaaaaggaaggaaagtccccaaggaaaggacaacgacgcttgggtacaagatttgacccttgaagcaaacccacctatcatagtcaacctcattgaccacctagtagccttgtgggaagtggttcggggtgtacacctggatgacaaagaatcaaaccagattgattggaagttcacaagcaacggacgttacacggcctcctcggcctactgcgcgcagtgttgcgggcgcctagcacaagcttcaactcttgatttggaaagcttgggtgccagggaaatgcaaattccatgctgggcttatcattcagaacagggtctggacatctaaccggctcgcgatcaggggttggaaaacaacggccaatgccccctctaccggtgcgaagctgagatagccttgcatcttgtcgccacgtgtagatacaccagcaggatctggcatcttgtagctagatgggtgggctaccagcaaatgcaaccgggtcaatgggaggaggcccagtcagtcgaacagtggtgagagaacctagcaaatacgtacagtatcccaaaaaaaaggacttcgatccctgattctgctagttgtatgggagatctagaaggagaggaatccgcggattttcaaccacaaacagatggcgacgagtttccttttgacaaaaatcaaagaagaggctagcctctggacccttgcaggtgctaagcgcttgtgcgagttcattccgcactttgtatagtgtatagcttacggtgacctcacttttttctttacccctaaggttgtattttctcctgctctattcaataaaaaggcacactcgtgctgttctccgttcaaaaaaagaaaaaacagcgtacaacacagaaa

SEQ ID NO: 57704 - DNA, 2790 bp, Oryza sativa
tggaatatgatttgaattcactggtaccccggttcattattatggcctaccagaatctggatctccaccaatttgtaccagccacggatgtcgcgcattcgcggaattttttttatttttaattttttttattaaaagttttacaaaaataatttttcatttttgaaaattgacagaagtggtcgcctaccgccctctgggagggtgatttttaaaaatcgccatcccagaaggcggcgaaagtgacgtggcagatggccgttcgctctcaggcgacggccgtcaacgaaatttgcaggcgacccccttgccgccctccgctagggcgattttgtactgtgcggggggccgcctgcaaaatgggcggcggggggcctggaattttgcaggcggcccccttgccgccctgggggagggcgattttatactgtgctttatatttttttataaatatcaatagttatcaaatctttttatattgaaaactatacaagattaaaatctccaagactggtaaaatataattttattattttttagggcctatttggaatgttaccgtacaaatttttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctgtccatgatatgatggagtgacattgtcgatccatcgagtaaatccacacatccttggattgccctgtaaaaatagtaatgttattaagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactaaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttagttagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctccttccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcaagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacga

SEQ ID NO: 57705 - DNA, 796 bp, Oryza sativa
agagttctacatggaaacgacaaggactactcggattgtatccatattggtttccctagttctacttggacaaggggacacctatgggtataaatacaaggccccctaggaggagaggggatacggacaatcgacacccaccacaatcaacatagacgccacaaagccaatacaagccaacatacgccaagccaagacgccggatatcgacttcagggataagcacggctagtcccctacggtgtctccggatactgtcaggagagacgaaagcgttatctctgatctcgccgggcatggattcaaggaggaagactaccctgtcgtcgactacgagtcagaccttcagaccgccatgacgacaacagttagataggctaccccaagtattatactggtgtgattatggtgaataagagcaataccggcttcggccaataggatgtagggttattatctgacaattcaggggcccgaacctgtataaaaatccttgtctctgtctcttttacctcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagact

SEQ ID NO: 57706 - DNA, 709 bp, Oryza sativa
  unsure (1)..(709): unsure at all n locations
tctcccccccccccnannnnntncggtgagttagtcaaaaaatttatatgggttctgtgatgtgcaatcctagttgcttactgtaagattttatcacgtcttgtgttgtgaggacttcaccttcttgtggtggcttgatgctcttgtgcatgtttctgtaaaagattgttaagtgcttgatgatgatatatgtatatgctccaggccgggtgcttcatcaggcatacttcttggtgccactactctgcctagtgtcatgctttcacggttaattcaactttatagggtcttactagcagatcctaatgcacgtgaaggtatccatttttctattttgtcaaatttatcagatccactgctaaatggaaatttccctaaatcttcatcaacatttcaaatcttgtttgacactaagatttcggggcgcatctggttactaactacattggggtcattgcagaatatgctaccttgaaatgcattacgggcagtatctggtaacttgcctgggaaggtataatttttggttgggatttaacggggcttccaacaagggaaatctattgcttcaaaaaccggttggtggtcatcattttttatcccctgaataattggtcccactttttatggaaacggttggagggcaagccttttttatttggtggaaacatatatttaccctttttttcaaaaatcggtggaagtcata

SEQ ID NO: 57707 - DNA, 1202 bp, Oryza sativa
  unsure (1)..(1202): unsure at all n locations
gggcaggagaaaagcaaggagggtagaagagatgaatgggtaaaaacagagaaggaaggaggtaaagaaagaatagagnggccgtcctccatgccaccggggcgcacgcgaaccaacgtggcaggaggagggcgccagccatgctggcgccgccccaggaagaagggcgccagcatggctggcgccgccgcctctattcctgtttctctgtatggagttttttgatgttttttcacactcagaatcacgatacaaccaaccacaaaaaaaatttaaactcgaactaccacttagctaagtctgaaaatatctagcataccacttagtctactttgcaccttcactaaaattagaccataactcttttagtaaaactctttgatcagcatgttaaacataatgcactctaccactatatgaaattacttaatctaattcaaaatataaccacatgaaatgacatatataagttaaatagtacatagagatgtaatttttttatttttatttcattttttttgatatttttttcacacttacgagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctcccccgctttgtcgggttcgtcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaacatatcaaaaaaataaaataaaaataaaaaagttgcacatctctctcctctgtactagttcggagagaggagaggagaggaaaaattctacatgtcacatattacgtccatttgagttcaatttttctatggttggttcttgtgtgtccctaagcgtgaaaaaaaaatatcaaacaaataaaacaaaaataaaaaatttcgggggggggggggggttccctccactttacttcacctccactctaactctctctcctcttataccctcaatctatatttcacttttccgtct

SEQ ID NO: 57708 - DNA, 611 bp, Oryza sativa
aaaattggtaaaaaaaaactacgaagggagtaattaatcggaggaattagctgttgggttctgagtccagggtgtgttgtggcttgtgatagaagctgcatgcagtgatgctgtgcctaggttgttttgcattgtctgcttcttcccactcactcatcagagttcacttttcgatcgaaaagtttggtaataacgtagtacgctgcttgcgtggtttcgcacattgtaaagctaaagtcgttggaggtggctttcttcgtccttgagtactataaaagcagagtaccgtatttggctttcttgataaatattttctatgtcccaaaacaaactcaatcctagatttgaatgtgagtatacccagggttatactttcggtttagccgatttgatctggcgtcaccgaaatttcggaaatttccaaaatttgaacaaaatttagttgaatttgaacaaatattatcaaaattcatgaaaaattgaaaaattttggcccaaaaaatatcatatcgaagggatccaaaatgaccgaaatttccaaccctgagtatacccaatcctaggtttaatttgaacatacactgtaaccggattcaaagtcaggattgagt

SEQ ID NO: 57709 - DNA, 544 bp, Oryza sativa
cgttacaacgcacggatacttttactagttaaattaaaaggacgcagtcccctcctcggctctccttctcgttcctctcgactgctcagcaccgatgatgccgcatcagctcctctttcccttctcgttgacggcggtggcctcggataccgcgaatccgccgccagaggtcgcggtagggactgatcaggaggtgtggattaggtactggggaggtcggagacgacagatccagtgtcgagggaatcggagataatgccagtatggtcagcggcgtccatttgcggggacaaccatggagacaattattcactgtatattagagttagagttgttggaatattctttttagaatttttatttgtttcaccaaaaaacttttgcagtcgggcagcataacatgcctgcctatgaaaatcctttttcacatgcagttgttttgtccatctaggaaaatctcagattttcacatacacctatgctcaggcgattgctccacgtgcctacaaaaattcaattttttataagaaagaacccaaaaatt

SEQ ID NO: 57710 - DNA, 2366 bp, Oryza sativa
ttgtgtctacacaaaattaaaagaaacaatttttcattggaaaaatactttcatcacgtaccttctctctttttattccttgaaggtcaccaagcatgctatgcaaaataaacccatttctatacttttatatgctcatatttttttaacaaatactacgaatatattgaaaaaaaaaacaagtagaagcggatagatctttttttaagtagaagccgatagatcttaataaatcaataaagctcttaactgagacatattaaacttataaagcacaaacaaaagataatggtaatattgtttcaccaaatttacttaatgcgatggacctattattttataccatcttaagaactcaaaaccatttatctatgttaaaaaacaaactcccttcacccaacccaaccatatggatcctctccactgctattatatgtgcatgtactctctccgattcaacttcttcctcttcctttctctaactaacaacttgtaaacataaaaacaatcaataacgagaaagctgaaaaatcataattattaatcctttagtttgtttgaactattgatttatttataatcaaataaataatttaagatccatattaatcatattttttactttataaaaaattaaaatatatcatttgaacatagacccctgtcctttgtatgccaaccaaataataacaacattaatgaaacaacataaataaataaaatgacagcatgcatcccgtgcatcataggaactagaaaacatagattctttatctttcgtatacttaggattattattgttgtaatttactttttggtttggatagttttcgcaactattatatctatttacacaaatcactctaaatcctttgcagcgctcttaactcaccacgtgtcaagtactaaaaattagaacaaaaaaaattccaagggaaaaaaacatttgacaatgggttttcacttaagtcagtggattcattattttcaaccattaggtcttcctttagaaaaaatcttaagccgctatgtgtcacgtcttcaaaattagaaaaatcttagaaactataagaaaaaagcaaaacatatgatcattggttttagttaaattatttagaaaaataaagtccccaatgcatcgcccttcccagaacatgcattcacacaacactgaacgcccccttcccccttggctcacactctccactctccactactccccccttctaatttaagctatcaaactaaaacacaaactattaataataattgcaaagatcgtattcttaagctataaatctaatttttaatttaattgttgctcttttaaataatcaaaccaaaaatacatgatccataatgtctgtatttttaacctaaaatgtctgtattcataagtagaaaaatgtcaatagggattgaattaaatcaattggacaaaatataaaaaatttgtaaaacaaatagttattacttttcaaaaactggataaccattgtacaatgttcgattgccataaccatctttaagtgcttagatgttaatggccttccatccatcctacaccatggcattacgagtttctcaatgtattattgcatatacaagacacattaaggtagcagtgcgtagaagtacgtagttgtggttaaaaagttatgcattgctactattaactttaaatttaggactcatattggctagatattttttttagaaaacgctatagatcacatatataatagggaagcgaggtatacaatatgtatatctcctatgtatttattgacacgttctttccagaaaatgaagaattattgacaattgcttgtagtaatgaattaaatattatatagttcaaatcttacaaaaatattgtaaaaattatctaagcaatgtagatggagaaaatttatgaagaaattaaacttttcaagcgtgacaggtgtcatccggtagatattccaccttacaagttagtcaagcgtatcctattttacgtgcccgcgcgaatgcgcgggctaccttcctagttaatttaatagccaattcatacaattgcctattatctggtcccacatgtcatgcacacatgtatattggagtccgtgctgaagctagctacaaatctatagtccgcagctcttctcttcctctttttatctccttaaaatatgtttgtagctgatttataccctgtacttgcttttagagcaagtttaatagtattccaattcatttatagccaatctaatagccaattcataccatagttgcttactatactactaatatatggtctcacctgtcatacacacattgcgttttggagtccgcgctgcagctggctacagatctgtagcccg

SEQ ID NO: 57711 - DNA, 1696 bp, Oryza sativa
ctaagtaactagtcggttcagggaaacctcgcatgccaatagttggggaacgccggggcggggtcggttggagccaacccgggttcctggtaaggcaagaacacgaagcttgccagattaccgatcgaggtggttggagtttgatttgtgaaaactaaaatggcctatatttatgtgaggaattgatccttctatgtggcatgaggtaaccctgggtcggcttgggaaaggctttgttgcgaacctctgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctacgtggcagatggatgacctgagtagtcagaaacgaatctgtgtgattcgggatgtctgtgggcatcatagactaggcttcccgagtggaagcggattgctttgctgctgggcagctggactctgggagtccgagaaaatgaaaaaggctctgggagccgcttaatcgagtgaaaaggctctgggagccgataagtaatgatctgaccctggaggtcgatatattaccatttgagttgttgaaaagcatttcttaagtcaaatcgagacacaagtctcttttcgatccaaactcaaaaagaaataaatcacttagtgttttcaaaatgaattcaaacaaaggatttgcaaaacaaccttgcctctcttccaagcttgcattaaacacctaaattcccgtgacttgctgagtacgaaagtactcacccttgctctatataaatatatatagttcctccgccttgaagtgaagatgaagtgaagtgaagattagggtttcgtccttgttcccagccgtcgcctgtggtgttgggtgttagttcgttggttccgctgctgctgctgttgttggtgtttactcgtccgtgtcgtcggttgcattctcgggttgttctgagctgcaacctaagttaaggtaaataagtcctctatttattttaaggatttgcaatgattcatatttgtcaccgtgggtaccagcactatgtctgggactggtaccgagatcgcggtttcgtaggtagcggttcgcgccgtttttcttacgacacgctcctatcaggtgccgttgtacggcggtgccggattggggtgtgacatgcgcactagggtgatttttacaacaaaacagagcatggagtggacatttgttacaaaataacttatcaaacttcaagtgacttatgggatggtttttgtagtttttcctatcttttatggtacatctataactaaggctcggtttgtggttgttgtgttggtgttgcgctgtgctcatttttaaaattgctctaaaaatttgaacatataattttggtcgtttggtttatagatgaattatgattatatatattatccaactttcacgtctcttccaattgtttcgtattttcataccataataatattgacaagattataagaaaatcagtttaacaaacaccaaaatgtcaaaaagttgttgcagcaaacgagtttatgatcaggatccatatgccgcaatgtcaaactgaacctaaagcattcttagtttgaaa

SEQ ID NO: 57712 - DNA, 664 bp, Oryza sativa
gaaattttttccacactttcactgttataatacgatccccctattcccccaattacaacccaccccctatatatataaaatattaaccctgttataagaatcataataagatcaaagataggtccatggagccaagtaccagacccagaaggctacaaccaaatcgagcaccgttgggcaggtacggcgagggcggttctcgacgaattcgtcggcggcggggagatcaaaatcggatcttgaaggcgatcccgaggtggcgaggcgctcgtggcttcgtgcagcagcagcagcaccaagaaaaaggagggggatttgggggggaggagaggagacgacaggagcggagaagacaacaggagcaaaagggcaacagcactagtagcatgggatgtgtgtgccttgtatgtgtagtgctgtgctgcctgcttggcctgcagctgctgcactgaatccatacacacaatggggttaagcactagctgggtggatgtgtgtttactttttctccccttctttttctctcaagtgctattgcttttgtaatttgtactagctttgcccctctttctctgttactacttggaatttgggggtaaaagaatatctggaaatctattatataattaaaggaatagaaaaaggagcctccacgttcgctctc

SEQ ID NO: 57713 - DNA, 1032 bp, Oryza sativa
aatctaattgctctgagggcaaaccaccaccattgccatgattccggacaagcgaccagaagattattgatagtctcgttgcattgatcacaaaagacacatcgatcaaggtgtggcaagccgcgattgtggagctgatcggccatccaacatctattgagatccaccaaccacatgaagtaacgacatcgaggaggcgccaacgacctccaaatcggcttgtcctagaactgcaccctttccagttcccacaaacagagacaggtaggcggaatatgacgagtattcccctgaagactcccaccaccagatgagggaatcgggctccttggagaggtcatccaaggagtggattgcaggccacagattgagatattcgaggattgcctagacccctaaggcactggtgatgtccttgatccatcttctatcttgtagtggcaaatcattttctggtaggtttgggagtgttgtcttgcctgaatggaatactaaatagcctaataattcgaggtacaaacaaatgtattaagtaaaagaatggtttaaatgtaatattttaaataacttatatgtaacttttaaaaaaaatcacaccaatagagaacatgtatattcttattctattttattctcggggaaagaacacaccttaacagtttaggatttaagaagaccagctgaatacccgtgatatggagtacggatactcatacacttcaactatgcaaggaactgcagcagcggttgtcagcaaatagtgttctgctttcatatcagagattgagatttcagagtgccggatgcccggaacatggagcttccagtgtttatcagcaaatgtgttctgctttgatatcagagattcagaatgccggatgcacggatctatacagacgatttcatttcatttcatctttttttctttccctaacccgacgtcagagtcgccgcaccctaaccggaacgccgtgctgcgggtgcagcgtcagcacggtgtagggcgcgtgcgcgtacgtgatgaactgctgt

SEQ ID NO: 57714 - DNA, 609 bp, Oryza sativa
acgtggcgctaaggtagcattaaaaataaaacttatatgggctgtatttgtcattcacacaaaaagtaattataggacccacatgtcatccctatgaccctatcaacccttctttctcctccctctctcccttgagatttaaaacttccagctcgagatttgaaattttccatgtctaaatttgaaaaatttaaagttaaaatttaaaaattactagtaaaccaaccactagtaaaaataggaagctaatctaaactaattatatttttttcttttatccgtacggcaggaacaacatacggcgaaaaaaaagaaaaaaaaaaagaaacagcggcgttaaaaaaaagagagaagcgcaaaagcgcgcgtgcatgggtcttggtcttgtgggccagcgtgtgcgccggcagcgcgcggattagcctttccgcatcgcttcagccttcagaccgtcgaattcgatgtacaatcggacacaatcaacccttactacgttttaatcagaaaagaaatgatcttactgacatcgctttagtcgctttactagctagctaatcactttggagtttcagtgatagtgttcaaaaagcgcttgtactggcagctaca

SEQ ID NO: 57715 - DNA, 1783 bp, Oryza sativa
tcatgcgcacagagatcagaacatggtacaaagacactgaaaaaaacaagataattgatgatcaaatagtggcatttctagatcaactgtacgatgaacttaaagttgcataacaacaatcaaatcttggatgtgttcgccgaaaaacaaaacaaaagaaaacaaatattgcagaagtagagcgagtacagtaccgtgttcctccaaggcacggtgaagcagaggcgcgacgcgcgggatgaagtcgtggggccggtccatgggcacgggcttggagcgggccgccgtgacgagccgcaggtcctcggtgaggtcgccatggaggaagcggtactgggtgcccctcaggccctgggccctgagggcccgttccatccgccgcggggccagccaggcccactccagcatctgcgcggcccagaccagcagcagcgcggccaccgcgccgccgagcaggctccacggcgaggcctcgccgaatggtagcgccgcgccggtgccggtgccgatgccgatgccgatgccgatgccgatgccgatgcccattgcttctttttctctctgcatgtaccgagcaaagcaaatgtgttgttgaagcaaacgggacggagagatcagtacgtgtgtgcagagtgcagtgcagatatactaaccaattactaacaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattacggtagtgaatcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgggaagaaattaagatggggggaggatttggaaggatctcaaacagaaaagacgtggctaacataggtgtatctcttgcaggagcgggacaacgacatggggagcatgggcgccgctgcgcatgtcgacgcgacgcaagcgggggttcacgcatcttggcgtggttctacgtgcctcgggcggtggtacacgactggcgctttgaatggaggagaggatgtatggttgcaaatcccggagataccgcaccgcgcgatagggccggaggaaggagaagctgatccaaagacagaccccccaaaatgttcagtcatcagtgggcctggaacggaaaacatcttccggcccatcaaacaccccatgttgatgcacacaggctataaccaacgaggcccatggatgcgtaaggtttagctgaagttttgatttctgggctaaaccttctgcttcagacgttctgatttctcaagctgacgctcgaacattgtgtttttttcttttaagaaaagaacatttgtgtcattttacttttttttaaaaaaaatacatacagagatgggcatgtcgcctacgtggcaccgtcccaccaccattacactgtcctccacctcactcattgcactcacagtcgtcgtccatctgacccttccctccaaaaaa

SEQ ID NO: 57716 - DNA, 1557 bp, Oryza sativa
catgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattctggaggtctactcgtcccaaatacccgtatgcgcaagtactcagaactaggaaacaaccataggagcacataagcagaggaggtgtctacacaagaagaaccaaaaactgaggtagatagaaccgagagagagctctctatctacctagaggtggaagataacgcaagagaaacattactacgttaatctcgattgattgcactataggcctcgtctgttaccggagtaatgaatcatgccggttatgcttttactcataaaaacaaaacggctgaaaacgagcagcccgtccgaacccgccgctttgacgccctggctggcttggcttggctcgagcgcacgcgtgtgacattcccaccaccatctcaaccgctcagtaggtattctctagtagtctatttaagttaagatcatttttcattggtttttaatgtggtattaatctcttaacattaattgtgagcccttgaaattacaagaattaatttgggcctatcccatttaattctaatagataagacggagatacataaataaagaaaaaacaatttatatgtaaaacattttatatgtgtattatcagtttaaaagtcaaggctaaaaactataatatggtgaaaataattcaaaaatcctattgtagaattgtgttttatattaaatatttagttgtgtccgataagtaaggcttagattggatgtgcaaaaattatatgcgtagatttatcttgaatagtacttttatggtgctataaattatatgtagattttaaatagtttgtaataataatatgtggtgaaagttttattttaaataccatggaatgtttattctttcatgaacggatggagcaactggctagataatatttttatataagtatcaaaaaaggagttgaaaaatgtgtggtaaggctcatgctcgtaacttggctagataactgttccaagtgtttgatactttgattgctcctagtattaatctaatacactcctcaccacctgcaaaatacagtcaaaacgctagtgatgatctcctaatggcccgattagtcgtcacaggtcaaccatttggtaccttattatgtaacaagcatagtggcccgcgcagattgcgcggctagcatcattatattttctctcatataatagcatatatgttttctcattatattattcaaatatattaaaatgacaacataattttaa

SEQ ID NO: 57717 - DNA, 1164 bp, Oryza sativa
ttagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagatgcatatatatgacctgtcataggtcaaatgcttcattcagagttcagacacactcaacctgcatagctcatcctactctcttaactctcaatctctcccagcttcttcaaaatttcctgcgagacaagatgaggatgtccaagttgtcaatgctactgctggatcttgctcctggtagtgatggccatggaggttgagggcattcgattggatgcagaaactcgcgcagcaaccagcaaccaaatggtcaatgtaagtgattctgattcactgaatttgttcatcatggaattgtcttctgttcctttttcttttctttttgtatgtgtgtgctgacatatttgttttgttctgaaaaacagaaatcgacagagaatgtgccaaaggattccggtgactcactaggcgaggcgaagagaagcattgctgggaatgaagttagggctgtagcacacaagttacctgagttccatgaagactactatggtcccagtgaccatacacctagacaccactgaagagaaaacaatctttttttttcttcttctcaatctttttgttcagaatagattagatattagctagtcagcggctgcaggttgtagtagatactgaatttcatctgagcttagttagtaagcacatgatggtagcaacatgtgaatctttaacctatctctttttcccctccttttcacctcattagtgaaaaggagcggttttcatgtactgacttgttgacaatacttgaaagcaacaatctcaagacgttgtccatatctttttgtgattgtgtttgttcccatgatcagcgcatagcttaatgtgacgattacaaatccacaaggatgtcaataccatgatgtcgctgatataactggaattgact

SEQ ID NO: 57718 - DNA, 878 bp, Oryza sativa
agcttgacgcgcgtcggggaggcggagcggtagtgcgcggcggagaggacgtgcccgctcggccgcctcgtggccgtcgccgctgccgccatgggagatcgccggagtcgggtggattggggagcagtggcgacgagaggaggagagggcggtttttgtgcttccgggttggtggttttggcaaactgagcggaaatggttttggcggttatttatagggactggttggggcagttccgtaatttactgccggttgggggtgggcccggagaactggtccgggcaggtgtcaaggaatggtggttaggtcaggttaactaactgtagttaataaagctgtgtgcgttgggccccacatgcagcacaccgaaaggctttctccaaccggtcccacattcaaggtaggattccaaacttcttgtttcattgcattcgtcccataatcgtgtatttccgtatctaatgtttaagcgtccgtcccgtttaaaaagtttataaaaagggtgtagctatatttatggcgccatatttttcatcaaaaaatagtcggcatgtatttacattgtaagttcctaaattacatatgtaattttagtgtatttacaatgtaaatctcaaaattacatatgtaagtactaaaattacatatgtaaatttgaaaattacatactaattacatatgtaagtggggtgtaaatgaggtgtaactactgtgtaagtggcggaaaaaaaatcgactatagcatattgcgccatatttctagcaactccgtataaaaattaaaaaatcacatatgaaatactattcatttttatcatctaataataaggaaaatattaataattttttaaataagatggacggtcaaatattggac

SEQ ID NO: 57719 - DNA, 1289 bp, Oryza sativa
ttcctgcgcccctgacacgcatcagacacgattaattaatcaaagtcgttctcatcatgctgcttaactaatcaagcacacatggagttgtactgtggatttgcattaaaaaaaaataataattacaacagaatttacactgactcggatcactgtctggttgcctccggcccaggcaatttaactacacttttttgggcgatctttcccagtttctgttgctgcctgcctcgatcgatcaatcgcattcgcgacgataatctcgtcctacctggactaatcaagtccgtttcctcccgtaaaactcggagaaccaatcgcagcaaaaacttgctccggtttcgtactgtcaagaccgtgtcaagatctcgatcgagttaactcaaaataattcaagcccggattaattactgtatactacgctgtggtagatctgccctggtatctgggtaagctgtgtgtgtccttctaatgctaggtccatttatgcgtctgcaagatgatgatcaggtccaaattaactaactaaccaggataatgggtgattttacttggtcgtggaggttgtaatcaagttattccggctagtcaactgttgacttgccatggccccctccttgatgcagacgtcttgacattttttttttcaaccgctagctggatattcaacgggtttgttgcgtagtagtaatacagtagtactacactactactccactgtctaatgtacaccacggcactagcctttctgcaatttttttggtactcttttaatccttttttattagaatcaattgaaaaaatggtggactaaagttcggttttccattgaatacatgcatggtatcttcacgagaaattttattttatttttatatacttctcttgttgaaatgatttgcaacttgtgtcagggagtggtgctcccccctgctctataaactaggagcagcaaaactattgacaagcaacgctgggggtattttattacagcagaaatcaaacagaattgatttaagtattgttctccctcaactaacaaaacgaaagaaagaaaacactttttttttaaaaaaagccggcggccgctaactgtgtgcctgtgtgcggcgcccaccgttgcgtctcaacatctttgtgtgcaagcttccgtcagtttctacggtgattaaggccgagtttaatttcaaactatttctccaaactttcaattttttctctacacacataaatttttaactctgtcacatcgtttcaattttaattgacgtgaactaaacataacctaa

SEQ ID NO: 57720 - DNA, 2045 bp, Oryza sativa
tgtgcatccaaaactgcaatgacatagatgaatgagtgatgctagagctcacggtgccaaaaaagtgtggagtcggcaaactgataaaagtccccaatatcttgaaaacttccttgcaactttgttaaacttaaaactgagtggcgatggattcatgtcggtcagccggtcaccaacaatggtgcaacatctaatttggaggactgaatactgttgttctctagcctccgcagcactgtagcattcaaaaattggatttagttcaaatatgccaacaacctgattacctgaataatgttgctttctagcctcttgtagcattaaaagaaattggatttagtagaaatataccccttcactctagggtagtgcagaatattccattgattattgatctgtactggagaccaggcgtttagtacatttagtaaattcggacaaaagttagatgaacaacttatgtttcaggggaaaataacacgctaacatctcataattcaggtttagaaaataaaatacacccatattaaagtacagttacaatatatttgcttaggctaggaatttagtcacaacacctttcagaatcatcgtcccaaggccgatcgcgatcatcagaatattcagaatcacgatgctatcttcttttgcttctatcacggtgatccctgtggcgatcatggtccctatcattatcaccattttttaaaaaacatgagaactcattctgcaacacagaaggtaatgggccgtaattttgtaaacgtgcgaggaaagggaccaataaatataatgagaataagtgaatagacattttggccccaaggtttgcacataaggaagttgcagcatttttccaaaaaaaatatttcaagcaatgtaaatctagaggatatttttgccagcctaacgatgaggccctcagctaacatatccccagtgcagggttgtcattttaaacatatcagaatatgctactgctcaatgagcaagttgattgtaaagtgtgacctattggaaaacaaaacaactttacaatgagcaagtagattgtaaagtgtgacctattgagaaattattggctgaggaggatgaaaacaattactttaactcgtctgaattgctagaattgacaattaaacccatcttaatcctttgggcatttcatcaaacatatgtcatgcacgtccaaatttgcaaaatcgacagaagcaagatcagaaaccacctttccacccatatgtggcagcaatgatcttcacgttacccatctcgtatagggaggatctgcacaaataaagcagtaaaatcaggagccaaacccaccatttaaaccaaagacatataatcagtagatttacctcttttggtggaggaatgattctcagtatctcacctgttgttgccgggttggtagcccgatccgccagccaaggactgaagaagtagaagctggtggatgcggtgcaatgaagaggcagaaagaggtagcagccaggcagcaccgcggtagtaatcactgaaccctccctcgagctcttcactgctcgccgttctgcttctccgtagcacggttcggggtggacacggaaataagcaccagtcaatcgtgacaccactcgaaccggaaccctagccacccaatccccgcaccgcgacactcgaatcggagcccaaacgacgccgtacagaacttcaccttagaggggagaaacttcgagggaccctcaccttcgatgatcatcgccatctccacgagcaagtggcggcggcaggcggcatgacgatccgacgacgacggaggggcagcacgtgagggatgcgacgacagcggaggggcggcgcgggagaggagagaaatcgagcagcggtggacgggggatcaaccgcgcgcgggtggggcgtcggcgtcgccgggtgagtgcgagagagagaggagggaagagccgagcgagacgcgggagggtgaatgcggcgtgatttccggcgtgaggaggatgggtgcgaggaggggaggggatgagagggagacgtggggtaatctg

SEQ ID NO: 57721 - DNA, 1731 bp, Oryza sativa
gggaaggcgtgagaggtgtaaattaatcactagtggacgttgacggaccatcgtttcgtttattcgcgaaccgtaaatgaaaagtaagagtgaataaaaacttttatatgtgtttctagtgatctagaagcaaagactaaaaaataaattttaataaaaaaaatcaaaatcagctctaaatttaaggttgaaaattttaaatttttacggataagtattagcataagcggaaagatgaggccttctcctgcgcctaaattctcctccaaagttaaccaaactctacggtagagtttgagtttggttgctgggatgggatggaatggaacaggatgaacccatttttagaggtgtttggttgaggggtgagtgggatggattggtcctggagaggaatattcttcttagatccgggaccaactgatccgggaaaatatgacggaccaacttgggatgagcaaacggcgtcacaacggcttctcgcgtgctcgccgccctgctcgccgcttattgtccgcgtgctcggcgtgatggtggaagacagctcgtgtgacagcaacggcgacgggctcagcttgggcgacggcgacgatggcgggctccagtggtggggagggcgagggaagcggcggcgggatcggcgacggcagcgggtggcggggtgctcggcgacggcggatccagcaatggatcaggtgcacggcatgagcgtcgtccttcttctccgcgtgctcgtcctcccgctgctctctcgcaagcagccagcctgctcgctggccgtgctagctctcccggccaccggtcactgccgattggtccgattagagcaggcgatggtggcgctcgacgaggactcgcgctacctcaccaaactctcttgacggtaactgcaaacggcggccattccatcccttcctcgccccttctactaaacaaaaaaaactgggttcattccatcctttaaatcaaacatacgaatggaatcatctcatcccaaaatctggaatggtatcatcccatcccacctagtcccagaatcaaacacacgctacaagattaggctttggtttcaggtttagggtgtgtttgttcacgctaaaattaaaagtttaattgaaattgaaatgatgagacggaaaagttggaagtttgtgtgtgtaggaaagttttgatgtgatagaaaagttgaaagtttgaaaaaaaagctggtaactaaaccaggccttagttagggtcgtgtaagctacggtttagccgttcactttgtttgatacagttacggatggagtaatattttctttaagctggatgtttttagttttacaaatctaatatggatctgaatatatgatcatataataatattttgataaactattctgtttcacttataaataatttagcatacaaatttcaaatccagtataaataagaaatgtgaagttgtactaaacaggacctgtcttcaataaacgtatgataaaaaagattacggataaaacatttatatttataatcttttaacggtttgaaactttaaaagcaaatgttgaaaagatagacttttatgaacccctaaaatcaactttaaaattaggcttcaaaaattaaattctgtcaacgactgattaaaccaacgcaggcttgacttcttttctgaagacgcaggaatgtcgattggttttcagagtttcttcatctttctcttaaagttcaagaagcttgccagag

SEQ ID NO: 57722 - DNA, 1150 bp, Oryza sativa
tcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggattttgattgaatttaattgaactgatccattcattcctctgaagaaaaaaacacacaaaggagtacagatactagtagagtagtagaaaagcaaagagcacatcacacatggcttcctagccaagccctggatgattctgattctgattaccctagctctagtgtcactcgatgcgtacgcgcgaaatagtggcgtactatcactcgatccgaagagg

SEQ ID NO: 57723 - DNA, 635 bp, Oryza sativa
acaggcgccctttaggtatctggaacacctaacattaaccatatcctatttagcgtcaatccagttgctccaatattaaatcatcacctaaagaagtctccatctgagttgagacccttgatctcttatttatttatttactccttgcagggccagtttacaatacgtacattttcagaaagcagctccaaacaggatcttgcattggatttagcttcagcaggatgatatactgcaaaaaaaaaaaggaaaaaagaaaaaagggttaaatacctactcttgtttgagaaggattttaatgacagaaggattgcaatgacaagatcaggatcacactgtaaatggtgaaagaagagcaacagcaacagggcttcacatcatattcttattcaccaaatctctctttggattccagtcacatttgcccacccactaagggtgaccggtaaaaaatgaggtgtcctttctccatcttaaattcggtccgtggtatgaacccaagattttcctccccctctatcctggtttctgcgacaactcagaattggattgttcgtcgtgtaagatttttgatcacgtatttttgttttcgcagtgttgttatcatctgtctagtcaatgaatggtgctgggat

SEQ ID NO: 57724 - DNA, 13356 bp, Oryza sativa
tcctgcagccctactaccatagtctagcactttaccttccattggactagatgctggaggaatcgcttgtccattctgtacagcatccaatgaggatggggaatcagaatgattgctgtcctccaacttcgatgaacttccaaggcatttgtcgggctgctcatcgggagtgtctgggataggaatagctgccaagtagatgagctccatcgttgtgctactgctatcatccaaatcactgaacgttgagtttttatcatatgtctcaatatcgacatactcatcctcgtttaccagttgttcttcagcctatacagaaagatttagataaaacacatttttatggcacgagtaacagctaaaagtcttaaagacaggtaaagaattgtcattcaccttttctacatatgcatttaagtcaaactcatcctctcgttcaacatactcttcgttttcttctaattctacaaaatcaggagcaaatgcactccaattctctacatgttccttggcccaaatgtatgctaagcctgctacagacactgaaacaattgtaggatctactggatgccaggcaatatcaataagagcttcctttggaccttcaaggatttttacaagacgtcctgatcggttccatatgcacaatctgtgctctcctttgcttgctgaagcaccaacaatccactcactatcaccactaaagcatggtgccttccacggtatctttgcgatagcatccaaaagttcacaagaaatagctaggcagcttgcaccatttgcttttagcttctcgtagtgactctcatagctaatgttgttactgcttattttttctatctcctctccagaacctttaacaggcagaagattatcatagactctaatcacccgatcattagagtttgtgagtagatatcggccatccctgctgaaaacaatatccttaactactgttccacctgggatgggaatcacagcatgtaccttgatgctttttgaatctataattaatatctctcccttggaattgcccacatatatcagatccccatacttgtcaaatgttgcagcagttggtgtaaaaggtggagaaccatcagaaaatttattgcgagtattaggagcagggaggttaccattatcagacagaaaagctgggagaactgtagtacttccagtgtttaaatcaacaagaataggtgcagacgagagagggcatgccaaacaaatagatggggtagatggaccaccaggatgaagacggacacttaacggagtctgctgaagagtaatgcgggcaatttttttctcatttaccacatgccaaagtgtcaatgacttgtcagtagcagaggcgagcaaatggtgaccatatttagaccaggccacacttgttataggtgcagtacaatctttatcatgcagttctcttgcaatcccccttgtttcaaagtcccagataacacaggtaccatttgcacatccagctgaaaaaaaaaatcaactgacataaattgttggataaatttgctttcagggttcaagtacaaagcagcagtccaccaaaatttatggcactccacatgaatgatgtttttacatctgtgtatagatatatcacaaggccttacaggtgtgcacaggttagtcttagaaaagaacaaaaggatgcattaaagtaaacagatcccttatcatatcatcatgttatacttatatgtggcaatgccaagataaatagagatgcggagacaacacaaaagaagaaaaggaactacttcaggctacaagaaatggctttggttactgttaagtgttaacagctaaagaaacttcaaacagattaaaactaacattaatcgtgcaggcatgcttcacaagcgcacagtgtaaaataaacagtctgtgtgaaataagaagataattacatatgagcacaatttaagtgtactgttacaggaatataaaatgggataattaccagcaaggagagttcctctgcggttgaatgctatgcatttcatactcccatactgcaagaactcctcaatcgtctcagggaaatccccctgcaaaggatctaaaccaacataacatagcagaggtcagtatattgctgcaaaattcactgtagttttatcataaaaaaacacaagacaatgctcattgactcttagcacaacatccgtaattgcaaaagaaccagttatctgaacagaaaatttcagaatttgatgcacgtagaaaatgcagcgccactagtaaaggcaccagtgcattcccaaatttaaccaataggccaatactgcaaatcttctcaaatcctactcctagataagcaaaacaatcgaaaatctgagcctaaatcttgaataccacttcatttcaatgcatccaggagacagaaaccagcaaaagcgttcactatagcacaaatacacgctaatgttacccacaagtcccaaaatcaccaaaagaggggggaaactagggccaaacagcgcagccctaattcgcgcaaatccgccctagaaacctaaaatcccacccaaatcggcggaagtaccgcacaaatcccccaaactctcgacctacccacccccgaatcgctccaatcaccgcgtccccgacccatcccgccgcccccacgcagaatgcgagagagagacgaaactcaccgactatagggacgttcatcgcggcggcgccaccccctcagcctcgcctcgccgcgccgctgtccccaggcggaggcaaccggcgaaccgcccccaagaaaacaccaggtggcgagagcgcgcgccacgccggacggaccagggcgagggctagggcggaggaggccgccccgctgctgctccgctacacaaagccctaggaagggaaaaacctctctctctctctctctctctctctctctctctcggcggaagagtgaggaggggaaggaggggatatgcgtttggagcacgagtccgaaaccggcgcgcgctgggccgaggcgaggcgcgcgcggggcaggggaagggaggaattcgccctgttatattctgattctgattattcagattttatttcgatattggttatggtgtaacatcccggctcaggacttaataagattaatataatactcatattaacaagttgtaacttctttttcggaagctgatgtctaaagaactccagggttaaacgtgcttggcctagagcatatgtaggcggacccgaacgctttgtctgtggccaagagggggacctgaggacaagggatgggtgaccgaccggtttcacgggcagagcaatttgaaacgggtgaccggctgagaaattcttcccgggtgagtgcacacgacaatttgggatgggtgaccgaccgaaaactccaagggatgggtgaccgaccggtttcacgggcagagcaatttgaaacgggtgaccgactgagaaattcttcccgggtgagtgcacacgagtgaggacaagtgatgggtgaccgaccaggaattcaagcaatttgggatgggtgaccgaccgaaaactccagggttaagcgtgcttggcctggagcaatttgggacgggtgaccgaccgagaaattcttcccgggtgggtgcacacgagtgagtgtaagttcaagtgccttaatttggtttcggtgattaatgacaaatctaattatatgagactaacgtttttatgagtctttttttgactaatcttatttggatatgaaagtaaaaatgatgggaggtatgtattaaacttcacatattctaacttggtctctcttgtggatccaaaatatagtgtgagctcccttattgatcttgattgattatgtgcatatgcattccttcatatccatatgtatgcacatcttgagagggagcttattctatattttgttcattataagatctctaccttgatttgaaattatctttcatctcatctctttgtattgtttatatcggattattatctatcacaaaagagagaaaagattgaaagatcttggattaaacaatttgtgtaattgttactttggtgatagatgataaaccgatgtttatgggattaacctctcttttctataagttttcaacaaggttatttcccgacaatgagatgtggtagatatgcattctttggtgatggactttaatcatgacaaggatgaaattcatggagataaagcgatatgtatcacttcttatctcctactttttgataggttcatatatatgatttccatgttattgttatataagtgtaagactaatatttacttagtctcctttacattgagaacatggagatcatgaaggtatgtgtttttttttatcttcatcattactacatatgccttctctatgtgtataggataaaccccccattggttcttctttacttatgcatacacttgtctctcttgtatatttctttgtatgcatatacttagggggagcaaatcctatatatttattgtgcatgttttagatccatattgttcacctattatttatatcggatctttgcacttgaacttgcatacgagtatatgacacttgtgatgttaatgaatactcaacaaacatatacatatctttcatatgtaaccggttggtcattaagtgaaggatgacaaccgatttgttgagactaatgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttaacaaatgatggtaaatatcttggtataaacatggttgaatcaaatggtcacaagtgttgatctcgactcaagcttgaccccaagatggatagcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcatatgcatgtgtgtgtatttggtgggcttgtctagccaagtgtggtgagttttctcaagtcctaaacaaagagagatgtgggcaaatcctataggtttgggtagcctcatgtggttatgtccggtggagtatcctttggagtgtgagccctttctccctgagaaaagttgtgtttcttagatggattgttcatgggttggatagccctttgaataagctttccataaagtccaagaacgccaaattccgagacccgagtcaagagatatcgtcgttttactaacggtcggttgagttgaaaagtgacctgcggtctgaccgtgggccttaggccggtcggaccgggcctgttagccggtctgaccggcgtggtaaggccggtctgaccggccccattggtctgttgcactggtttggtttttggtggcgatacagagccgccagagccgcaaccagtcagaccgagccgacggcggtctgaccgagctgtggacggtctgaccggccactacactgcggtcagaccggccagattgagtgggctcaatgattgccctgtaacggctagttacagggcaaaactagccgttacaaagtagtccggtctgaccggccttacaacggcggtctgaccggcagagcacaaagttggggatttcggttccaacggctagttttggtagttgggggtatatatacccactccccagcagtaagggtaaggttttggcactccattgcattatcttgaacccttgcaagagctctcacacccttgtgcacttagtttatctagtgaggtattagagagtgagttaagccaatccaagtgcattgcttcattgttataactagtatggcacttgatcatcctcggcaagcatcctagacttgttactcttggaggttgccgcctcctaaacggcttgtgtaggtgttgcccggtgacctctccgaggagattgtggaggaggttaagcgtgcttggccgaactccagggttaagcgcgcttggcctggagcaatttgggatgggtgaccctgatgtccaaagaactccagggttaagcgtgctttatccgtggccaagagggggacctgatgtccaaagaaactccagggttaagcgtgcttggcctagagcaatttgggatgggtgaccgaccggaaaattcgtcccgggtgcacacgagtgaggacaaagtgtgcactagagcaatttgggatgggtgaccgaccgaactccagggttaagcgtgcttggcctggagcaatttgggatgggtgaccctgatgtccaaagaactccagggttaagaactccagggttaagcgtattttgtctgtggccaagagggggacctaatgtccaaagaactctagggttaagtgtgcttggcctggagcaatttgggatggtgaccgaccggaaaattcttcccgggtgcacacgagtgaggacaaagtgtgcactagagcaatttgggatgggtgaccgaccgggaagattcccgggtgcacacgagtgaggacaaagtgtgcactggagcaatttgggatgggtgaccgaccaggaaattcttcccgggtgcacacgagtgaggacaaagtgtgcactggagcaatttgggatgggtgaccgaccgggaaattcttcccgggtgcacatgaggacaaagtgtgcactggagcaatttgggatgggtgaccgaccgggaaattcttcccgggtgcacatgtgcagaaaagacttgtgttaccctgtgagggcagtttatgacatatgaaagctgtcatatgtaagcggacccgccctgggagaggcgggacgttattatcatgttttttaaactactaattcctctatttcagattataagtacactagtattttcatttacacttcaaatcatcagattaaaaaaaataaaaactactagttggctcgtattgttcaagtgtaagatgtggccaagattcctggtcgaatgctttcttaacgaagaccgccatccttattcttgtttgatgggggtttatccccgagagggagagtgagggtttattcccgacagggagagtgaccactacgtaggtttttattcatcaagaattggaatccctcccttcttgtctacttcctctattttataatgtaagtctttctaacattgcatatatttatataaatgttaatgaatctaaacacatgaaacaaaacagagggagtatgttatttcaccgtctttaccgaccaccaataagacctttattttatataaaaaagttcattattcaaaattaattactttggagggatccaaagtacaatattttaaacgaaaagactaggaattttttttcacctagtacccctgtttaatttagatttatgttaaacccggcacggtcctatcctggataaatagtgaccgttagatcatgatgagcggcccagatcgaagaggataatctacggcagcatttttacataaaagaccctttgttatcatctagtcctcgattaggtcggacgggagagagagaaaagtcaaagaccctagcgaggagccggagctccggcgattgacagcggttgcgccgtcgtcgccatggccgcagagttcccgaaggatgtgaggcgaggcggcacgccggcagcggtaacgagaggacgggtggagcctgacggcagggctgcctctgcatctggctgcctaatgagacgatctgaaggaagacgacggccatggcgacatctcctgaagataacctcggtgggacgacagggtcatttgcctagttcaaaagcatactgatactgaaccaatcaaccaatgatcatgacaaaccaggaagaaattcagcaagtgcaacaaggattcctgactgttcagaagttccaagtgtcaacagcaattctgcagatcatcatcatccaaaaaatgagaaaggtaacaaagttatctactgctgtttataacctcaaacacatgaatgccactgtggtttatcccaaccctaagtggagaagcccaaccaattcgctaatgcacttatacaacagcagaggaatatacagtgtagttcatcggtaggcttcttcctggagctaatacaaatagacttttttactatgcttcttcctggagctaatacaagcaggcagtagtacaagtttttacatgggggagcatctttcttctaatatgatctgcttcaccatggtagaaactaacagttctgaaggccgataagggaattgtcctgccctttttttgttcaaaaaacttctgaaggcgctcatgtgctctttgtcattgctgagcggaggcgagaatacagtgaggtatttcgcatgataagatagacgatgaatgcaaggtaaactgccaatacaacgcacaagcttgaccgaaccaatgctccccggacttcagtggcatagaaggacagtataagatacccattgatgagcatcaagaatactgtaacaatccagctaatcacctaagtataagcaaagataaagttaacagcctacccttgcaaaaacatatatattcaggttttcttttctcatctgaatacagatatgctgttaaacaaccaaagccgaccaaataaatctacagttgattaagaggttggtgaatggtgaactatatactgaaaaaaagtttatatagatgtaagaaggtaggatagcatagacaaacatatatgagatggatttcagcttcaaggctaacagcttaatggaataaaacattgaagaatcatgttcatgcatatcaatttaatcacctacagaaacaatgatctgaaactaaggaactgttgtcgatgattatgaaaatgaaaaccttttattcgttcagtttcatcagatgacaaaaacttaataataagatcacatgacctaaaacagcaaatggagttcaatactagttaaattatctgccaacatgagacatatgataaagaaatattaaagggaaaacttacttttgtgataggaccaaccacaaatgatcccatgacttgctcctttgagacaagtgtgatgagaggaatcagtgcaaatggtatctgtatggattgaagaacattgagtgcctcattcagaatgtccattgtaggatcctccgtgtcaaaaaataaagccacaatcatagttggaataattgcaaagcttcgagtaatcattgctcttaaccacttcttcaaccgaagattaaggaagcctcccataacaaattggcctgcatatgtgccagtaatagtgctactctgtccagatgctaacagcccaatagcccagatatacagtataggaaagaatgcagtcccatatttctgctgtaagtactgtccagcattctcaagacctataccatcagcttgttcagatccataaaatcctttcgcaaaaactgttgtgacacagatgttaataaagaacgagacaatgagggcaagaatggactcaatgttgtaatagaacactgcttcttgaacacgggatttcttgtttgtgtcaatcttccttgactgcactagtgctgagtgcaagaagacattgtggggcatgattatgcagcccacaattccaactgcttgtttgattgtccttgaactcaactttggaaccaccaaacctagataaagaaaagaaaagagagagaataaactcttcgacttctcaaggctgcaagataagcaaaagtatttgcaaacaagtcagcttgaataccaatcagaagctccttgccacttggctttgtttcaccaaacataattgcaaatgatactgccatgactgcaatcaggactccgaaaaatgcttccaattttctcactccatagttctccaggaataaaaagatgaagctggcatcaataacacgtcatgtaagccaaacaaatgtcaattttattggacagttcccaatcatataacaaaacagacaatttgtcagcacataaacaaagtaaaggctaagtcaaaatagagaatcattgaataacactacagcagaaacagacaggaaaatgttgtctctttattagtcatcccgatttttaatatgatttgttcctttcatcgttactagcttcatacccaaacatccctatctagtagtcaataaaattcaaaactaggggcctaaccagggaagacgataagcactaagtagaagtgtacggacaatacataaggacatgcccttagattaatcaacaatcccaggtctcttaactgaatataaattagaagtattaaaccaaacaataaacgtgcattatcgtctgaccgagcgactcccaggacatctgggaccattacagtttttaagcattccgcgaccaccaaacatggctttgatgacaaaaccaacagaaaaacgtctccaagaaaagagcaagcggcaacaaaaataattactacaacgcaacataataccgtcagcaagtagcacggaattgatcgaaaagaagcagaggaaaaactggagtttcgtctaaattttagctcccaagaaggaattctgaagatgaatgcaaaggtagccatcatcacactaaccaaaataataataataactgggggaacaaacaatggaagtgaatagtcccactcaaaatggattcgccacaagggcaactcaccaaaaagacacgaactttatttactcacctaacgattaacgattggcgggaccaaagaaaggaagggaagcgatcgaaggacaggaggaggaaagggaaagaacggaagcgaggtttctgctctctcctgagatgccatcgggaagagtccaacacgagaacgaacaaacaatactcgctgtgtcaatcgagagaccaacaggatcgacgaaaacacatcgaattacagtcttttagttcaaaaacgggaaaagaacaagggcagcgatgaagagcaaacagagcgtccaatttaaccaataagaaagcaacgaactctcctatccaagaaaggaactccttgccagtcaagaaaaaaaaaaaccgatgaacttactcgcaaattctactcgccgcaggtaagaaaggaaatcctaatcagttaaacgatatcgatgtcatactcgcaaattctactcgccgcagctccaaaccaaaacatgaaccaagcaaactcggggctgtatactatgatcagcaataaactgaaaaaggaaatctaggaattttctgtgaacaagaccaacggggtaaggacaaaaaggaaagcctcgttcgttcccaacacccaccaatcgaacgcggtgatgacgacgccgccccagagcgggacggtgccagcggagaggatcttgatggcaatcgcgctgccaatcacctcctggatgtccgcgccgacgagcgcgagctcggtcatggcccagagcgcgcgcgtggcccagggcgggtactcctccctgcagagctcggcgaggtgcttccccgtggcgaccccgagccgcgcggagagcagctgcaccagggcgcccatgaccgtcgcccacagcagcagccacagcagctggtaccccgccgccgcgccggcttgcaggtcgccctccaggttccccgggtcgaggaacgcgatgcacatgaggaacccgggccccgtgaaccgccacagcttgcgccacgagaaggccgggcgcatggcgtcgccgccgccgccgccgccgtcctccgagtcggagtccgagacggcgatggagaccttgtcgtcggagtcgtacgcgcgctcgtcgtactcgtcgtggccggtgacggtgacggtgccggtgacggccccgccccccacggggaggaggctctcggcgaggtcgcgcgacgccatggtgggggggagtgcggcgacggcgaggtgggcgagcgagtgggaagaaatggatgggtcaggactcaggagggaggttaggatgggaagttgtgctctctggactctaggagtggttgtttttctaagataacaagtatagtggcccgcgcagattgcgcggctagcatcattatattttctctcatataatagcatatatgttttctcattatattattcaaatatattaaaatgacaacataattttaaattttacaataactttacaaaactactaatgtgtaatgtttatattatattttatatacgtgttagttattaattatttttaatatcaaattttagttatttgtaaattatatatattcctatatggactctagactcgtcttttaatatttctttttttaattcatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagttttaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctaatatttctttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacttggaggttcctttttctattcctttaattatatatttaattccaaatttctttgtaaattgtatttctatatggactctagtctcctcttctaatatttcttatttttaattccgaatttcagctatttttaaattgtat

SEQ ID NO: 57725 - DNA, 12326 bp, Oryza sativa
ttttaattccgaatttcagctatttgtaaattgtatttctatatggactctgttttttctttttctccgattaatgtgagaatttctaggccatgagagcgaacgtggaggctcctttttctattcctttaatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagattttatactcggttttttatatttatcttaatcaaatttctttagatttggctaaatttatagaaaaaaatagtaccatgtccgttccaaaatataagaacaaccgaatgggacattttctaggatgtggattttcattccttgagaggatatcccctcattgtttgcatgtcatttaaatagttataaaaaaaattgacaacatatattaatacgaaatatatcactctccaaacatgttaaactgaaaatagttatcgcacattcgccgctatatttattattttattacaacttgtagaagttgaatctaagcttgcatgtttgtagactgatatatttcatattaatctattttgccaatttgttcatattttttatgactatttaggtggcatgtgtaccccatttcctagtagtctgtccagattcgtggtaataaaaaatatcacatctagttcttggttattatattttgggacggatgaagtaatatttataacaccaaattagttttattaaatttaaaattgaatatattttgatatatgtttgtgtttatatttgaaatgtaaaatatttttctataaacctgataaaactttaaaaaaattgactaagaaaaaagttaaatgacttataatatgatgcgaagggagtacttttttaaccgcaactaataacatttaatatattagaactaagggacgagctataaaaaaattagggataaaacatgggatctgatggttatctatgcaaactacactcgcgagcttggtgcacgtggtgagaggagaggatgaaaggagcacgacttctcttttaagctagtagagaaacatccaaaatcaagtaaaaaaagaaaacactagccaagtttttgatagaaagatatgtttttaaaaatcaagaaattaaaatataggcatttgcaaatatttaaatgtaactaggcaaagtatttgtattgtattaaaatatggtaccaggtgctttttaaagattttatttttagatgcatacaccatcattccataaaaaatgaaccagtgctagagcaagtatgactgcatgagtaatcgagtactactgtctatatttaaattctgtcgtcagattgtacttggtatacggaagcattctaattaaacaatactagcccttttgtgttgacattggactataaattgggctattatcccattggataatatcttgggtacactttctatatctttgaaagttcttgagagctcagactcgttcagaaaaatctgatccgttaatgcttgtttgcatcggttgtttttcattacctttttttttctcactttttctgttctattttcgcggtgatgcatcggttgttgacaacgtcaaaagcagcaaatttatgatcgcttgatcagcgggaggacgatccctctcgcgtagcattttcgcccatgatctaacgaattttggcggctctattaattgctagtcgaggtagatgattctacgaagatagtgatggattcgtataatcgtattactagatagtagtaaaaattttagatacccatgtactgatgtacatattggatggtagcaaatagtgctttagcgccgtatcgttttcaccgtggataatttgggggcaaaggtagatcgttaaaccctttattctagttaattatcaggacaaggactcgatgagcaaattgtctttgggagttcgcttttccttgccaagaacaaaagtgagtgtagaatagatcgaatttcagagtgtagaatagatcggtcgagaacgcaagacctctcctttttccgcacctttttctctcgctttaatcgtgcgttccaccgggcatcaacagacagcaccactcggctgacgaatccacgttgctgactcactgtgtgtctacgttcatcagctgtccatatttttcaataatgtgaaagggcttatttagaaataataatctctctgtttcagtttatacgacgttttgactttggtcaaaatcaagctactttaagtttaaccaagtttgtagaaaaaattagtaacattttcaactcaagacaaatttattataaaaatatattcagttattgatttgataaaactaatttagtattacaaatattactatatttatatataaacttagttaaacttgaaacagtttgcctaaaacggagggagtagttaactagcatagtagtccgcgatattgcgcggctagcattgttatattttttccttatataatagcttaaatattttcatacgttattattaaaatgtattaaaaatagcaacacaattttgaattttgtattgtatcgatagttattaattattttcgaattttgaattttactcatttctatattgtatcgtatccctatatgttttctagactcttctctcaattttgcttgttttctaaatttaaattttagttatttataaattgtatttctatatgtactataaattatacttttaattccgactttcaattagttctaaatttagagttaacttaaaaattaattttaaatatttaaattttgatttttctttgaattaatagtccattccatgggactcttggatttcggacggtgcaaagttgcaaactataagtgccatgcgagtgaacgcgagcagtggcgcagctaccgggggtgccggagggggccagcaccctccccccggtggctgctagtagtatattacagggttagacaattagacatcatccactgttaggccattagtacgttagattatagtcagacacttagtacttagtcttatgattttcatctttttaaagtaaaatagaaaatgcttatttatgagactatttggtaatttacattgaaagaatttagcaacaaggactagttccaagcttccaatgatattattaaagatctgaattcaagttttttaggcaaaacatatggtgccttgttatattgaacatttgaacctctttttttaaaaacataacatatgatagttttgtaatctagctaaaaaaagctatatttatatacacattggttattgtcagtagtgactatttagcttattatccatattggttaatcggtcttatgacttcctcccccacatcccccctaacctcaaatcttcgccactgaacgcgagagtacccgtgtgtgtctcgcataacgtgtgacgcctcctggccgtgtcgaagcctcttcagccgagacgtacggctcgtctgttgcagatcccgtgcaaaaactgaacacggcggcgtcgcccgtcgcatcggccatggtccctggacagcgacgacggcgtcgcgcgtggcgcgtcccgtcgccacgacgcccgctcgtgcgagggagagtggaagccgcgagcgtgggcatcacagtacaatggtggagaatagctctatagtcccggttggtaaccctttgtagtctcggtttttcaaccgggacggactaaagatcgcaatctttagtcccgattcaaataatcgggactaaaaatatggtcccggttgttgttaccaaccgggactaaaaaagttttgtttgttttcttttcctttcatccggttggcctttttccttttgtattgttctttagctttcgctcgtggatcaaatgaataaaatcaacaacagagcctaaatcatagatcgaatgaataaaatcaaacaacaaaacatccatattctttacacttgttcagatctacaacatcttcagaacaatgagcattcatcacagagaacaaagagagcattcatcacagagaatagagaaagaaaaaagaaagttcacatctacaacatctccagcattcatcagatagcatagagaaaagaaaaaaaaagttctccgcctgccgccgccgccctcccgaccggcgccggctgtccccgacgcagccggctgccgccctctcgaccggcgccggccaccgccacctcgaccggcgccagtcgcccccatctcgccgccccgcgcccgatgcagccggccaccgcccctctcgaccggcgccggtcgccgccgccctcgatgcagcccgccgccgcctccatctcgtcgcctcgcgtcgggccgccgcggaggcctccatcccgtcgccctgtccggggccgccgtggccggcctccatcccgccgccccgctggaggggaggagaggggaggaggagatggggtgagagaagaaggaagagaaggatgggaggaaaggaggagagaagaagataagatggagaggatggctggatgggagaggaggggataaggatggaattaataggagactttcatgcgcgcgcgtggatagaggctttgttttaccggttgttagaatttttagtcccggttacaccaaccgggactaaagttaggatcaccaaccgggactaaagatcaaatatgcccactgtagccaccaaccaggattaaagatgatttttagtggaatcgggactattgtggattttggtcggccgaccaaaaatggtttctccaccagtggtagcaaagccacaacactgcaatgccacttgtacgtccggttccaatttatgtgtttagttcacgttaaaattgaaagtttggttgaaattagaatgatgtgacagaaaagttgaaagtttatatgtgtagaaaagtttttatgtgataaaaaagttaaaagtttgtaactaaactcggccttaagcgccggttgattctcgcatgtactagtacacagtacaccagtactactgtaccactagcactactgatcgcgctaatttttcgcttaaacaaacgggaatcagagggagcgcgacaggcgacagccgccggggacaatcagggtagtactccgtatctctcatccggtcattcttctcactgcgtgagacgaacgtcgcgatcagatcacggcaaattgcgctggtttatatcaccagaagatgaagatggtactccaatcctgcaactgccaggtgccaaattgaaggtgcgcatcacggttggtagtagcgtgctgccgttccgcacttcatcacagggcttcggttagatcctccgtatttggaattttcagatgatctcccggcctgtgcatcgctgattcgctgttagcgtgataagatcgcgactaagccggccggagtagactttttctggagcactagcgagcttggccttttaatttcttcagttcggtggactgtcttctgacgtggtgtatatgtggcgataccagtctcctgtggggcccagctggcagcctccgtagcggaaggggaaggacgcgccacgccggcgaggcagcgtcctcgccgctggccttggcctgactcgtggccgttatctgatccgatctcctaagtaaaaaaaaaagctaacccactactccctttatccaaaaaaaaaaagctaacttaggaggaaatatgattctatcctaatacaacgaatctagatatgatgggttacattctttgttaggttgtttttacaacgaatctagaaatgatgggtcacattttttgttaggttgttttttttaacggatagagtacttttagtagatggcgctgttaaaccgtccaaacgaatgctgctttgttgttgcacgggctcgtgattcgtgaatgccaaatcacttgaagacggctggtcatgtgtagaccgatcgtacacccatgtgaggtagtagtgagtatgaccacacggtccacgggaatacgggatcgtgatgcggctgatctggagttgctggaccatgtaatacagatatctggaatttcagcgtgcgctactgtacatgtgttcgctgtctggctctgggcacgcaggtttaggacgattggcggattgggatataccaatcatgtataggctagtaccatcgctgtgtaatcagttgtgattactcgttgttaaggactggagttcatgctgatatatatgagagttacccatattctcgggatgggaataatttatttgtgggatacgactagcagaaatagctaagcaaaagatactctccatgcgggcacggcagttccagctgacagagttcaattgggaagtgttaatgtggtcaccctgggtcaccatcaattgtaattataactaatcgcctatgcagattaacactgacgtacaattgcttatctattgtattagcaaaaaaaaaacagtgtcatgattaacatttgattaaactagctatactcctccgttctaaaatataagcattcttaattagcaataaaactgaacaagtgtttattttaaccattgctagttatgcaactagaccatcacaattataaatacttatatttgggaattgagctagtatatctgtacccccgtccaaaaaaaccaatcccgcctatgaatctgaacacatatctaaaaattcgtttttttaatgacggagtagtatgtgcctttcaatgtctaattgagcgggtgatatgatgtctaattgaactgggtgatacatgcctatctaagcactagactttaagggccactttcaattggagaaaaaatagaagaaaaacaaaagaattgaaatcctacactattcatgctcttgtttagtaggaacgaggaaaggaaaaacacatgaaattgaactttcatgttcctaggaatctagaggaaaaacgtgaaaaatttaacatccactctaagctcatgtttttctatctcgcgtaggttcgatgtaaatctattagctcatggccatttttctattcaattagtgtatgttagatgtgtataagtaaataaccaacccaatttattctaataattgaaatccattccttttttttcctaatcaaatactcattcctacataattcttgtgtttttcaattttttgtattgcatatatattcatatcctatttctttgttttttctgttaccatgttttttcgttcatgtgattcaatagggccttgagagtatcacaaacacagtaagtgggctagtggcttccgtttcaaccgcaataggggagtcggcctgaaagtccataccgcatgatggatgcctgcagctgctaatgtggacactgcaaccaaattggaacaagttgttgtatcgaagctttttctctagagaacatcatctgtttatctgcactagtacgatcctattcccttctactacatgctcactaatgtcagtaaccacacacaccaacggaattggctgctcagtttggaatcactcgacagacaagacacacagacatcggaatccggacgctatccttctcgtcttctcgttaatttttccggcagcaacggaagactgttcgtgtgggagctttcccccttggctgctgctagcgtccacaaaatgagttcagctccatgcgcgacgcccatgctgcgcacgcagccgcgaatccgcgatgcatctgcacgacgcaccggcggccgaagccctggacccgttgacgagacgcacgcacccgcagccgcgcgatgcatctgcagggatgcaagtgggtcacacgcgaactcacttatagattgaaataaacgagttcccaagttagttttagcctataagcgaatttttatgggtagctgcttgcacccttatctgcaggacgcccagatcccttttgccgctgctgtgcactcctcaaccttcaatcccctgccgccaccggtcagctctgttgacagggtgagaaagagtaaagagtgtgtggaacacatagagagagagaggatatttttattctttttcaataactaggatgacacgtggacgtcacgctaacaaataatactctcggtactacctccatcctaaagtatagcagcctaaaattggataggatacatcctagttcaatgaatatggataagtggttgtccagatttgttgtactaaaatatgtaccatctagtcctaaatagttatattttgggacggaaggagtattgcgcaacaaaactagattgcactcatattaagggactcaaagtggacttattccacgctgtggccgcagcgagactggaaagaggccgtgcaatatctggaccagaaaagcccgcagatgtcatgggccatatgcgatcctgcaatgggcccgctccagccgcagcgcgtttcccctttggccaacgccgttcgcggcggcgccaacgacgcccaaaaccctttgcagtttgcagccggcgaagcgccgccgccatcggaaaaaaaatgccgcccaagccagagcggcggctgttccagtacgtgagcaagccgcgcaggccggcgcgggagcctgcgccggcgcccgaggtctgcggcggcggcggcgaagaggtggtcgcgtccgacgcggatgccgacgccgtgtaccggatggtcacggcggcgcccacgccgtcggcgatggagtccgcgctgtccgcgtcgggcgtcgcgatctccgcgccgctcctcgacctcgtgctgcggaggttccggttcgcgcacggggacccgctccgcgcgctgtcgctcctctccctcgcgctcgaccgccacggcgtcgccccgtcccccttcgcgctcgacaccgcgctctacgtgctcggccgggcgcgccggttcgcgcacatgtgggacctgctgcgatcctcccgccgcctcgtcccggacgccgtcacgccgcgcaccgccatggtcgtcctcggccgcgtcgccaaggtctgctccgtccgcgagaccgtcgactccttccgccgcctctcgcggatgttgaggggccgcggggacgaccaggagggccaactcttcaacgcgctgctccgcacgctgtgccaggagaagagcatgtccgacgcgcgcaacgtctaccacgcgctcaagtacgagttcaaggtgaaccgccagacattcaacatcctgctctccgggtggaagtcagccgaggacgcggaggcgttcgtcgccgagatgcgggagctcggcgtggagccagacctggtgacttacaacagtttgattgattgtcactgcaagaaccggggcgtggagaatgcctacaagctgctcgacgaaatgcgggagaaggacatttctcccgatgtgatcacttacacgagcttgatcggcgggctggggttgattggccagccagacaaggcaaagcacttgctgaaggagatgcatgagcttggatgctaccccgatgtacctgcatacaacacggcgatacggaactttgtgatagcaaagaggcttggtgatgcgtttgcattgatggaagaaatggcctcgaagggactcatgccaaatgccacaacctataaccttttcttccgttgctattattgggcatacgacattggcagtgcttggcagttgtatgagcggatgcgttctgaaggatgcttcccgaacacccagtcttgcatgtttattgtgaggttatgtcataggcatgggagggttgcacaagcactagagctgtggagtgatatggtcaataatgggtttgggtcattcaccttggtgtctgatgtgttgtttgatctgttatgtgatgaagggaagctggatgaggctgagaggtgcttccatcaaatgattgagttagggcagaagccgagcaatgttgcatttagaaggataaagatactcatgcagcttgccaaccgtgaagaatctattgccagattaactgctcaaatggcacagtttggacggttggcgcctgaggattgccgaagagttgatcataccttgcagagcacacatcaaagtagtgatagaactgacactgacactatagtgaaacacagcaacacatttgaatcacgacgatgataaattggggaagataacttggttggacagggaaataactgaaaaagagagttctgtacttcgatatgttgttcaaggtataccttcatggtttctattgattattgttcactgtatttgttggccactttgatttcataagttcttatgactaatgacttttataacaggtatgaagttctgcatgtgatctatagatggccaaccatattattttcaatatcaatagaatatgtttctgcaagttctactgtggaagaccattctagcattgccttctgtgctgagagaaatgctattccagcatcattgttatctgcaagctgaatgcctggatgtaaaatcacaactactgtgtagagacacttcaacatttttgtaacctgtggtgtttgtgtgaatgaccatagagaagtcatgcctgactcttccccagctggtttatcctctgagtctctgatagagaatatatattgaagcatgattgcgagattcatcttaggcaagagggacgaaatacaaactgtaatagaagtttcgcacgacaagtacaaagacacatactataggagtacaatctgaagtacattcatgtgtttgagctgccaatgtcaatgtggtatccctgcttcctcaaaaacgcacagtgcgcgcccaggacaacagtttgacggctccaacaccgttatttaggtggtcttgccataaatcatgttatctctttactttactaaggtctcctttgacatagcctcggatctaagattattttaagctgtatattgctaactccacaaatctatatatctaaatatgtgatttgattatgttgataacatttgaataaattattttgtttctattttgtatgaaatttaaattttaaaccactataatttaacatacaaacgttaaatttatcgtaaatatgagatctgaaactgtgccaaacatagcgtaagcactaagcaagcttgagaatacatgtattgaaccgaatcacgcaattttttttctaatttgtatataccccaaagttcggccttattcgtgcattactcgagtagggctgtgtttagatccaaactttggatcaaacttctaattttttccatcacatcaacctgtcatacacacacaacttttcagtcacatcgtaccaatttcaacccaaacttataactttggaaggaactaaacacagtctagtagtactccatattggatatttggatttatgccgtttttggctttgccaacaaattcccgcctatggacggccattcaaatggccaaaccgcgtcaggaccctcctaaacccaaaccaagccaaagcgcaacaccgagagacgaaggcgagcgctgcgctgcgcggcagcgtgagccgcaggcgtcgccgatggagagcaaggcaatcaacgcgacgcacgcgccgccgccgccgccgcctattaatagggcggcaacgaaggcggcaacgccaagcgaggttgaattccccactgactccaaagcgaatagcggaataaccgtctccaccccacgccgccgcggatgacgaagccgaggacgaggtcggtggccaggatggaggccgcggcggcggctgcggcggaggaggaggcggggaatcccgacggcgtggagggcgcggccgtcgccgccgttgcgcccgaagccgccgccgaaggtccgagtgagccgaacgcaggtg

SEQ ID NO: 57726 - DNA, 635 bp, Oryza sativa
aaagaagtaggaacataataagaattaagacttcttcatggataaatgtgaggattatttacataagaactgtcctgcccacctccagatacacttccttttgtgtgtgcatacttcgttttttctagtacatacaatcaggatccagattttactaaaaaataaattaatatatgtaagactagcaaaaatttgatgcgaaccactctgctcaattaccttgagttctggagcctctactacttgcgctattgcatcacatggaagttctttttgcaatgacttcatcttgccaccacaaatctagcacaaaatcataaccacattgtgaaattttttttgaaacagaaaaacagaaagaaatagtaaaaccctaccatatcttttccagcatttggttcctgcagctttggaacattagaactaggagccgaaggaacagtagcatcctcatgcaatttatcacagatctctgcgacctcaaaagatccagggttcaatctggcagaccttctccgtcgagtttttctgaccacatgtgcccaagagttttgaacaagcttaaatcagataatgatgcaacaatgaacgcattctgttataagcattaagcattgattaccttggatcatcat

SEQ ID NO: 57727 - DNA, 681 bp, Oryza sativa
ccatttgatgagccttagttggtgcgcatttggaagacctggtttttttctcctgattatgttgcacgaacagaacgatttcagaattcagaactagaaataatgcagctaaacatggtgaatcatttgcttaagaatttgactgcataccaatatctttgctctattttgttgattgttagaagtcttactcatcttctgcaatagtagacgatgagaaaagcatgttatatgtaacaaacagaggttcatacagtcaagctttagaattacctcgagttcagaaccctttactttgagcacggctattgtgcatgcaagttcatgttgcaataacttgatctgcatgtcatatccacagattaatccccaaatcagaaatcatactgcatttgaaaattcaaacaacaaagaaccagaggcagcttactctatcttttccttgatttatttcctgcaaggaagaagaaaacatagacatatcaaacagtctgtaactaccacaaaacaatcagcaatgaagtaagacaaacacttctcatttgccattatgcatagctataactcaaactatgtgctcaacctacaggcctggtgaaccagcattgcacaagtataaacaaacattgacacaagaatggtgaggtagggagctaatggataagtagacaaaccgcaaac

SEQ ID NO: 57728 - DNA, 665 bp, Oryza sativa
tatcttcttttttttctcatgctgattagctgtggatttgtgttcttactttgtgcaagtaataagtagactacccttggattctcaacgaggttgcttcacaatcatcatatgcataccaagatttaattaagaactgccacttgttatacccgcagtttccgcttaagttccgctgtgtatttgttcttattcggatgataaactttgcttgttgatgtggtaatcgccaaattgcttaaattagtttgtgtacgcaaccgggtaggcggattgctggcgtctaatctaatatttcaacttgcaaattgaggtgcatcttgctttaatccaagtcctcttgctgaacaatttgctcagtatgatcgatcccagtagtagaggtgattatccccacctgatgttttgggtacgtttcagatgggttggggcgatataggttctcattgcgtatttgcaaacgataaataatttgtaattaaaacttctaaataatttgtaattaaaaatttatatacgtcgtcttagttttagcgatctaaaaatagaaaataaatttagataaaaaaaaccttaaaatcaactttaaccataaacttaaaatcaacttttaacctaaaatttaaattttggctgctaatcataaacggaaagttggtgctgat

SEQ ID NO: 57729 - DNA, 622 bp, Oryza sativa
agacagcttattaaacggatcgccagttcgccgctgctaactgtcactggtcactactacccgcatcctttaattttgattgattccatcaacttaattatatatcgtcgtttcctctcgcatctcctggtctctctctaccatgcacatgtcgcctgcctatgctacagtattatgtctcgatcaaactctctgtaatagtgtacttcctccgtttaacaatgtaagttgttatagtatttctcacatttatatatttagattcattaatattaatataaatgtgaaaaatgttagaatgacttacgttatgaaacgaaatgagtacgtcgtacgccgtggtgttacgaaaattagacacgcggaattacgaaagttactatggaacgacgactaattttcttcttaatcgtggtaggcatggatgattaatcaactcatatatactagatgacgatacggaaacgtatacgatattagtatatttgttaacgaagttaaatccaagcttatatgtctccgattataaacacttctccacagtccacgtagcgtcttaccgctacaagcctatggtctcgtaaccattctcttgctacgtgtttaccctatattatcgtcg

SEQ ID NO: 57730 - DNA, 2008 bp, Oryza sativa
tgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagcccaagaccaaccagccaagacttattcctacacttacaatcctttaccacaagttcttccaatgatccggccctgccaaggtactccagccactccacgttcctactttcatgcaatcaacaaggtggaaagtacaaagactcttgcaaccaactgccaccgagagaagccctcttgaacttattgctggtgcaaagttcagcctgaaagaccttagtttcttgcaataagccagatagccaataccagaatcatcgatataggagcagaagtttaatgtgagatcggtcagtgaagagcagtgagacgaaagcacaaggagcccttggttgtccaactgcttcccgtggatagatatccaaccagagtaatcaatcactactttccacaaattagggaaccgggagcatagtgatgccaaagcttcagttgccgggtgaagaccacagccaacatggatagcatccctttgctccgcgtcgatagtgtagagctgcttcgacacaagggaaagagagttacgatcacttgtcttggcaatcctcttgatgatctctgcgagcagtggctctgacaggttgtccattgggcaatacggttgccttacttaagcaatatcaatgttcagctggcactacggactggcctaaaagtaataagaatgaaacatatgagatgtgatagtcagatggaattaatgatattaatttagaggtaatactttcgataagatggcaggagtgtttccaattcaactaagaggtagatttagattagcaaataactttaaatgagggaacctccctatgcatttataaatgactaagcaaataaagaatatgcaattagtctaacaacctgatcaactgaattactgaagcagataataaaaagggaagtttctaacaagcaaatgagcagtgcaagtccagaaatactagcattcatctgctgaaactgaactaacatatttggaagcactttactagtaacatgaatgaaaatcacgcgtataacaaggtgcagacgtgcagtgactcattattattttctacaattcactaccttcacaataaacagtacctaggacagacagcgccaactttatctctagtagtctagttggctaagaaacataagaattgcaaactattccgaacccaattaagaaaaacctcaaactattctcgcccttattatctcaataaaaaaaatctcaatcagaacaggggaagggactgaaaacacaactaaaattagagaccggatcatagataccttagagaaatcaaggacctcaagattgaggggttcagagaaggacaatccaagaaaaagaaagaggcgtcgttcttgatcctt

SEQ ID NO: 57731 - DNA, 676 bp, Oryza sativa
tgtttttcccaaaataaatttatttttgaacaatcatttcatccgagtttgtgaaaatagaagataaatgtattaggagtatataaagtagaaaataattgcattgagatttcacaaagtgagtgtattctggtccttttatatatatctatgtgggatgggtgaaaagtaaaattattttagaagaaagacagtagcattgacaaaatatacactttattaattgcattggttggagctaagaaaaattgaggagctaagcttcttgcgttgaggtcaagaggttcctcgtgttattggatactccctccgtcctaaaatattgtaacttaggataggattagagccatcttaataaagtgaattcggacagatattctgtttagttttattatgctacaattccgacctctctggagtaaatcagtctttcataactcttctcccgaaaacatcagcaccagctcaaatcaaagattttagaccaatttctctgctgcacagcgtaccaaagctaataagcaaggccctgaccaacagattgcagctcatcatcgactatctcattgaccctatgcaatcaagttttatcaaaaacaggtcaatctcagaaaatttcattctagcatcaaagatggttcaatctgcgctcaagagaaaggagccaatgatagtg

SEQ ID NO: 57732 - DNA, 1265 bp, Oryza sativa
cttggtgcgagaaggctggtttagcgatgtctgccctgctaaaccaaaggaagggtcttctttggcatatacccatggacaattcagggcatagtgtccttgttctctacaatcatgacaaatggggacatcctcttctggcattggaagctcattgacctagggggcaaatgctcgatcaaacacatactgattttggtcttgacttcgaaccaatggtagctgtgaactaagcagcatgcttggaatggaccaagggtctgcccttgttaactctcttgaggccagtggtggattgagttgaaaacttgagttactagaggcatacccgctgacattctttcctttttctctattaaacatctattacagggattgaggtgagagaggaaacaagccaggaaagaatagaccagaactagagacaggtccttaaaggaactaactcttcttgttgatgtgttgtttgcttcacttattctgcaagttgattaagcaaacaacttagcatggttacatcacaacccaccgatgcaaaccacgcgctacacacacaagcaaggaaacacatgacaaacgaaacactagagggtggcttaggttctgcgacgggttctccaagatcttcactgcttcttccactttgctaacaaacacaacagccttctggagcttcggcagacaactgacgatttcttcttcttcgctaagttgaccatctagtactagttgaaatccgaagaaggaagaagggagtaaaccttttgcaaatagcattaggggaaggagaaaaaaaaggaactttcgcatagttttatttataaaatatgcccttaggttttatccacttggcttatcctacagtcaacctggctctgataccagcttgtcgcgaccgagaaaaatattaatcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagtagcggactagcgggcctacggctccatcttcacaggctctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatatagtggt

SEQ ID NO: 57733 - DNA, 748 bp, Oryza sativa
tgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcagagatttgttgtggtagatgagcctggttctcgtttgcttactttgcaatttctgtgcactttgaaagaaatagaagatgtaatttcctttcgctttttccataaggagtatacacttacatggaaagggttaagcacacattttggttttcacgattcctgtaaaatcgatcttcagaaaggaatttttgggttcgagaaaaataggttttgggaagatatttttggtggtttaatttgcaagaaacctaggacgaatgatatccataatgctacacttagggtcatgcattaatggattgctatgactttggtttctagaggtgatcttagacccattaagggggatgaattggaccatgatgtttgccatggttagaaagataaaaattgctcctgtgaaataaacaca

SEQ ID NO: 57734 - DNA, 515 bp, Oryza sativa
ttttctgggatttatttgagctaaggaagtatttttaataaatggaattgcatttaagaaataatttaaattgaaaaagttttaaaaaaagtcttcttttggctttgggccgaaagtcggcccaaaaccgccttctctctcttctcggcccagccggcccagtccgctgccgcgcgcgcgcgcccgctgccgctgacaggtgggtcccgcctgtcaggaccttcgtcctcctcgcgccatcgccgccgaaaccctagctcgcgccgccgccgctgtttccttccaatccggccgcctctttccttctccggccgaattgattgaggggaaaccatctccgggatctcctctatctttttccctttggaatcatcggctaaatcgctttggaaagcgttggaatcgagttcgattcggatcgggttccctctctccaagccgaggtttccttcgcccgtgccgtcgccgtgggcctccgccgtcgtctccgagcccctttaaaagcttccccgtgc

SEQ ID NO: 57735 - DNA, 5873 bp, Oryza sativa
gccccaacatcccctccttgtgattttattttttgatgaatgttttaagagatttccttttgctgttttttcctctttttgattttccccttcctatgattgaatctgtgatgaattggctgcccaatgaggtgaatctgcgatgaatcggctacgaatccatgggtggtttattgggtttctctcttttttttacatcgctaacaaaatcggattaaattttcatcacttaaaaaatcagtaatcataaattttaaaccatttattaattttttttatccttctttatgcgtcgttgaactcaatagagactaaattagcaactaaagactaatattagctatgttttaacttgtaaaaaatatgttgttttcggtcctatcctgacctgcatggctgcatgtcaaccaaactgtcaaaaacaaattttaaaaaatttgcaatgcacattaaaacatcatatatcaattagaaaacataaagagtcaaattatatgtagaatatttaaaaaacaaataaaggctctatttccaaaataatattccacatgtttctcgtaaattgcaattctcacatgtgaacatggagatacgagaaaagaaagcaccatgagctatttttaccgtctcttacaatctttcttattacaaataattatcctgtaattatggtcagctagctagtactaaaatcaacccatatactatagtctaccctctccaatccccaaaactctcttgcttcttcttcttgccgcccaatttcatatgaccaaatattcatactagagatgatcttctttatgctagatggtgagtatgactttggtacaaatgctgcttcaccatcacgaacaataaggtcaaatggatggtcttaggccactcatacaacttgggaaggaaaaccttgttttgcatcgacttgaacttagtcttcctcatcattgttgtgtatgttcccgtgaacagcgcccgtccttcccaggtctctaacttgtcccactccatcgtcgtctcattgagcttagtgacatggataggtgcaccattgtagccgacgaggacagccatgagctcaccttggtccgactcaaagaggtggctgtcaacttgttggtggtcaataccaaagttgtcaggttaaccaagaagtctaaaattatcggtgtggctacatggatcatacaccgccagcttcccatctccaccaagaacgtacagcaagccatcgtggagcaccgggttgctgatcgcgccgccggaattagctgtgtccctgcttccacgttgaactccgttcggtcgagcgggtgagctgtagcgccagggtcgtgttgacgcagtacaccctccgcgagccatcgtcgtatacgatgaagtcgtaggagtaatggggcgtacacggcaactcgtatgcgacgctcgtcaagagatcgatttgggagatggagaaaggtgagaacaacgtgaggcgttgttcgttggagcagaagatcctggtggcatcattggacgacgccgccttctgcataataacctcgaagtaggggctgtagtacctgatgttggttcgaccgacgacatccgcgcagctgagtaggagcggggtgatccacgctggatagaagggcgacacggcggagcgccagtgccggcacgtcagcgcgaagccgggggtggctcgaccacccgagccgctcaaggacgagcgccagcatatccgacgggagagacgaccagtcccgttccgccgccatctcgcttccttttttttctttttcttttttcccgtacgtgggataaagttcacgagtacacgtgcgtgtcagcaatggacatggtacgtatatacgcagcgttttattatgcacaaacgctcgatgtatgggtcggtttcagcttgtaacccgtcgatcgggttcttattggttgccaaattaaaaaaacgctgctgcttccttttcctaatttaattaccggtgcagattatggttggtactaattgatctgatgtcgtgtaggcgtgcatatactttatattttccaagtgtaattcgatcgggtggattctttttctgtcatctttacaattgcagtctttgcaatagaaatcatgagacaacacgatcaggcaaccgcaaattaaactacccttatatatatcgtgtataagtaagacacggcacaaataccggccgtctctcacacaagaaaagatcgatcgatccgtcgaattcatggaggagaaagacaataatgaatgtccgtcgtcgttggatcccaagcttgctcctctgctgctgttcggcggcgacgacgacgacgacgccaccttcatgtacagcgtgcggacgagagccctgctgccgaggaggtcgacgacgacgacaacatggacgccacgacgagagcccaccggcggtggaccacggcacagggctggttgctcatggcgccgcgccgcggttcgccctcaccgtgcgcgacgactttcctatgggaccctttcaccggccgccggatcgccctgcctcccgaccacgacgcacggcacccttctcacccacagctgcgaccggatgtgcctcctgtcacgccgccggcccacggaccccggctgcgtcgtcgtcgtcgtcgacttcgacgacacggtgctctggtattgccgccccggagacctccatggggtggtgcatcactacctgcagcccgggacgcctcaccacgagcaccgtgactgcgtcggctgggcgataggaaatcttacggcgatcgatggcaagttctacaccgacttcaccgaccacgtcgccgtcctcgagttctcgccggagcccgtgttcaccgtgaccgccgtcgacggcgaccacggatgcccagcagggtacacgcggctcaccggtaacttggtagaatcaaacggggacctgcaccacgttttcttctctcaccccatcggttgcagccggatcgttgcgcgcgtgagcgtttacaaacttagcgtggcgacgcagaagcagagatcggcgtgggtgaaggtggattcactggatggcagagtattcttcgttgggatagacagcttgggagttggagcgtcacttgatgcaaaagaaaccggcttgaaagggaattgcatctattactggggtatcaatggcaaagtgttgaatgtatacgacatgaaacgaggaactacggttgtgatcaatcccggtgagaatcttccgccgcaagtcttgatgcctacccgatgagtgtttctatgttactccctctccctctccctctgttttaggttataaggtattttttactttggttgaagtcaaaatgtttcaaatttaactaagtttatagacaaatatagtaatgtttataatactaaattaatttcatcaaatcaataatttaatatattttcataataagttgtcttaggttaaaaatattactactttcttctacaaaacttggtcaaacttgtagtttgatttataatctctactacttaaaaaaaaactgtagtggtgatggtgaagccaacgtagacgtgcatccaacttagaaacgtatacacgtgacagtggaaaaaaaacgaacgcttcatatcgacgtgcaacagaaaagatccggaatcagcgcaacagaagcgcccccaatccatcttcgcgcatccccacatcgccgcgcccgcgattccgcgtcgatctcctctgcgtcccccttctgtggccagatcaagatcggcggcgagccccggcgaccaacggcggcgccctctgctccggcaacctcctccccgactgccgctctgcattgcagcgcccgcttcctccgcatccaacctcgcgccgccccccatcgccgcgcccatcctcctcgcctcgccacgcctccaccaccggcccaccgcaccgcctccccatcaccgcctccatccccagtgccccggccacccagccgagccacatgtggaccggggtcggcgaccaccgtgccgcgtgctcatcgtgagcaccgacgcaggggttagttcccagatggtgtgcttcgccacgtcccccagcaaggaatcaatcatccaccccctaaggagccccttcgtaaggccactgtagattggaatcagtggcggacccaggatttataccttgggtgtgcccacaaatacaagcactacacattggtctagagcatatacacaaaaatataggcaaaccgagcattttatacaccaaaatatggagccctgtacatggcctagacaaagcataatctggattttctaatgccttgctaaaagaagacaatgcccttgttcctcttcgtattaactgatttcagaattttcaatttttcaaccaatctctagctctcctttaaaagaaaattcagggagacaaagaaactaaaaatagtgagagactaaaagtcccaaagagtatatctgtatctgaagttttagatagatgatgcgaagctggacctgcttgcttgccttggtcaatgtggttgctgctggctgcattccttgcgttgctcacagactcaccgggcgcgcatcgacgttgcttcgccatgtctctaaatgctagtggctgcggctctcgtctccaccgtcggcgctccacactcgtcgtccaaccaatatcggtgctctggcctgttgaatgtcgtgctcttcggtgtcaccgccgccgctcgctgaatgtggaacaacgcctgatgccctgaccctagctacctttcatacgatgccaagtggatacgcgaatgcgaggtgaagcggggaacttgcacgatgcaaagcgcacaacacatcacacatgcatctatgatgggctggctcatgcgttcatacttattcaaacttttgccccaaactaatacatgctatatactataagtttttcgtttttttgggtgtgccggtgcatcctgggtccgcccctaattggaatacatattcgtatagtcttctagctctaggatgctgaatactcggttctacaatggattggaatcactattgtggtagccctcttatgattctctcagatgatgaatattcatcttagatgatggtcttttagatcttttttgtccccatcttaatttactgtcacaattagctcgatttaatcctgcgacagtttacaaactttgccaattgtagtttgtttaggagactagctaatggagtgttcttttgtttttgctggcaggtggagattcatgtgaggaagatttattgcatcaattaacctaatggatgcctcatgaagtgaggctaaaattgaaaaggctggacaggtatgtatatgcgatctacttgctttctgcttgcaggatcaacacaattttgtgttacaactattatgcctcaaaatattaaaatcatagcgatacagaagaaattaaccattgctgccatttcagactgaacagaaccttgacatgtagaatattttttggatttttcatgatgatttttatgccctaaaccgtaagtggttgagtcatgaatggtgagctaatttgtatcttaatcttaactacttcagtcacgtacctattttctccacctccccattgttttccatcattaggggttaaaatacaagtaactgcagcggcaccagcacgagcctcatgaatcactcgtggcgaactggggtagattacccttgatgctcatcctaatatgacatggtttgatcatgcagaatctgtttgttcacgagcccgcaggagtggggagtataggctgtcacacattatgaggttatatgtatgcgtgattcatgtgcctgttggtttctgtgtctatacagggtcattcgaggaaatttgagtgctcaagttgt

SEQ ID NO: 57736 - DNA, 18691 bp, Oryza sativa
  unsure (1)..(18691): unsure at all n locations
gcgcaggccgctggcagtcgccgatcgccgcttgtccgccgctggatgggaggggaagagggggaggagaggggagaggaggataatgaaggggaggaggggagagaaggagaggggagtgtaagaggaagagataagatcggatctgagggaaggagaagaggagatgttccgatcttatctaaatatttcgtctgggacttaactgattaaagatgggagaaaatatttactcccggttggtagtaccaaccaggactaaagatctaaatgatctttagttccggttgatagtaccaaccgggactaaagttgttatctttagtcccggttagttgtatcaaccgggactaaatatcctcggccccctggcaggcttttgacagggggatgaaccaggattaaagatcatctttagtacaccaaccgggactaaagatcaaaaattatttaaccgggactaaagattatctttagtcccggttctttttggaaccgggactattgtggaaatcgcccgaccctccaaagatcatttctccagtagtgtaattggcacatcttaaaagtgacaaataattaaatgtcccctttaattactgcctgatatatttcaaatctatacttctccgcagagggtgatacaatataagtggcaaaagcgtgatgattgttggcttagtgccaatcggacatgaaagaatttgctcgaattttttttttaaaaaaaaacagtaaacaggtatactccatcatgcaagtggaaatctcacataaaagaattcgtttatggcaaaaatgagatgtgtaaaaggagaattcttttaaacttcagtgcttcattttacttcaattcaattgtaaaaggagatgtgtcgataagtatgctgcagcagaaggtacattttcccttttgtgaggtgccataaatttctggtgtatgttgaaggacaaaaattataaatacactattgtgctctccagtgccaccctcttaggtaggtaaaaggaatttatacatgattttatgcaacagacaatggaagtatggtcacgcgcttctcattaggaatttttattatttttttgaacatttaaaattttaaatttaaaaataaaccatctcgatacttatttctaaatctgaaccttcttacccattgcgcctcgcctcgcttggcgaaacaatagtcacaccacccgcacttgcgcgtggcaaaaaaggaacatatttgaaaaactaaaaactaaaaggttcaaaaaatttaaaaaaaatctctgattggtcatatattatattttttatgttggatttcatatttcttacgagcacagagcttttcaacatgattagtccaattccctgttatactaccttggagttgtacgcttgtgtcatgctcaaacagctagattgttcaactcatccaattttcagatgatcttaacgattgattgttgcagggtagtggcatacaaagaacaaacaataattttgtttctaaaatagctcaaaagaatacttagtgcaattttatcagggtgaatatatatgttgggatcatgagctcccagtctcaaattccctcgccgcaccaactgtgccccttttcaatcaccggttcttaaaaatatatgtttgtgtgttttgggtgacacagcaggaaaatgcaatattttttttagtgtttttatatgtcaaaaacgtgtgcatgtagcaggctaaggatgaagcctgccgaaacacgagcacagcaatccccgtaagcaccggcaacttcgacaactgagccggccacctcttgcgtccactcagaaaagtcgaaagctgtcccgtcatctcccggggcgccctccgtgcgcgtgccgagatcgttgagggccagcctgagcgtgtaacaggcttgcttggcagattccgtcgccggcgccaggccgaaacgaggtgggcctcaagagacctgatcctctcttcggccgcagcaagctaacgatcatgctcggtgccccgcctgttcgccgactccagtttggcacagagggacttcttctcccccatcagggacttgttctccgcatttgccttcctcatggtgtccgccacgacgcgcctcttgtcctccttgtggcgaaggtcgtccttggccttccggagccgaagccgataaccatccagcctttcaaaggaagacttcttcgcactcaggtgcgcggcaagaccctagaaaagggagactgaaaccattacggcgtgacataagagagaagagaaaatttcgcacaaaaaataacacaaacaaacatacccgaacggacaagctctccacagctgcacagctttcgccgaactcgttcatctcggtgaagagaccaaggccttcggagggcgcgataacttggcacaccccatccacaaaaggggcgatctccggccgagtggcgaaatcggcgggaacgaagtacggggcggtaagcgtcacgtctgacatagtcgcttcgaccgccgaagccttcccttcccactggcgagctggcgaaggaatcgcttcaacccgttcgtcctgagagacgttcgccccggccgccggcgccgaagcactcccgcctgttgccgcttcggcgtcactagcaggtggaggtgacgtgcgcctcccccgagaaggagcgcgctgcagaaccagcgaagtcggtgtcccgtcagacccgtcgctgtccaaaaaggcacaaccaatctgtacgaccttccccttcttcttcttccctcgggcgactgatcccggcttcgccgcagtactagagatcgccagaagggtgttcgccacagcaacgtcttgctggcgaatgggtgaaacatgagagcccgccccagatttcactggggtcggactaggagtataaccgcgggagccatcgtcctcagacccggcctccctgtcgtcttcctcctcctcaccaccgctttcggccgtgtccttcgtggcacgatgagatcgcacttggccacccttcgcgaccgcctgcttacgctttctcgacgttccgacgtcgtcgtcaccagccttggcggggatcgatcgacctggtagttcgccaaagtgaactcggttcaccggccgtcgagctgacgcgaaagcaggcgggcaaattcggccgaggtaaggcccccaaccatcttcgacgcctccacttcagcctctccaagtgtgcgaactggacaaaaaaaaaccggaatgagtcgaaagatgtccacatgcatacagagggcgctgataaacacgaggaacttacgcttgactccaggaggaaaagcgaggcggggaagcccgagcacctcttcgtcctcactaacggacaccccccattcgcgagcaaggggagagatccgaagcaggcagaactcctcgcagaggtcgcgggtacatagccgccgcgcaaccttgcaaaggagaataagccgagactcaagaacgctgtcgacctccacactcggcttagcagcgatcgaaacagcaacgcgttcgaacctaagctagttcgccttgctatcttcagcagaatatggattattgatataaaaccatttttgcatccagtttcgctcccatttcgccatcgaggcaggcacccgccaggcgtctgagcgctcagggcggagtatgaaatttacgcacccaaacaccgtcctcttcggaccggccggtgtgctcacgtccttcgtcgtcgtgcacgccataaacagaatggcgaacagctcagcagtgggatcgaacccacacattcgacacacccacgcaaaaacagctaacttcgggaacgccgatgggctgagctgggaaagcctgacctcgtacatctccagaacggatagcagaaagtggtcgcaagggaggcgaagaaggcggcgaagacgacagtctggccgtcaccggacgaagggacgacggctttgcccctacaggtcgcctgccctacacgagaacgccagaaaggacaagctcggctaaggcggcctccttgacaagtgatttgccaaggaagcacgaccacccttcgccaaggctgccagggtcttcgccagtcaacccagccttcgtaggcttgcgaggagccatcgagtctgtggcgaaaggaagggactggtcgaaaggcacgagagcgcgcaaaggcgaaggtatcaaatcctaagggcgcgagcgtgtagtagcagtgaaagtaaaaagcgaggggagaaaagcggtaacccggggcgggattatataatcccgtcccacgacggttcggcttccgcccaatcagggcacgacacgtgtccaggggcagacgaaacggtaaattcctatcgggctgggccgcacagtacaggccgaaatccaagaggagcataccggcccacgaagggccccttactgtcgcatttcgggccaaaatcaaggcaatgcagtctcgccctttccgaaagggcgaatgctaaagttttctaaccaaaccatgaaaacaccaagtgttcacgttttttctgcaggactctaagaagaggtttcggcaggtacgtcggccgaaacggggcgcctcataccataccacatggtttgcatggtctcggccgaagctccttactcacccttgcccgtgaggggcttgttggcggtatgtcatcaggccctttggccgggcctgccgaaacctaagaaccagcgaggattcgagccaaagatatcagagccaattgggcgaagccctatggcgaaggccatgggcggagatggcgaaggctgacaagccgcgttgggtccatgcgaagcaaaggcatcttgggcgaacggcatatagcgaagggcatatggcgaagccacgaggcctccatcaggacgggttcaggctgcttcggcctgacgggcccattcaccataagccgggcccaatctattggcccattagaagcccatgtatgcgaatgacactgtgtaccgatgtaaatgtccctttcataagggcaaccatgtaaattcccctgtaaaacctaaaccctaatagggggacctgtaacagggttataaatagacccctagggccatgtaaagcggggacccaagaaaaattctcaaagttaatacagtttattgctttccaacattgttgagcaaccacatccttcaacgtatgcagttgttgtttcgacaacaacggtactttcctaactgggaagtaccgaggctagatagtaacagccgttggtgcggatgcgaacaaccagataattctagtagcttttgcttttgttgaaagtgagaactatgaaagctggttgtggttcttgcaacatctaaagtggggagtggtgcaaaaacgcacatcgatatgcatcatccatgaccggaatgtcggtctgttaaaggcaatcaaagagctccaggaggatgctgatggtgcatactactggcctgacatgcacagctgttggtgcatgcggcacatgggagccaattttttcaagcaattcaacagtcggcggctgatgaacatgttcaagcggttgtgcaaggaaaatcagtctacaaagttcgatgagctttggaaacaacttttcgaggggacaaggacacacatctggtcaaagcagagcaacaacaacccgcatgatgtacatgtcccccaggccctggaactaatggatgatcttattccatcaaatggaaataagcgtaggtcgtcaaagaatatcaaatgttttacccattggattgagtgcgagccgaatgataaatgggcactcctgcatgacactaatggggctaggcatggcataatgaccactaatcttgcagaggcgtacaatgcggttcttcccaaattaaggcctttacctccaactgctattgttgaaggcattatgcacaggacaacgatgtggatgaggacgaggcaggccgcggcgttgtaacaaatgtctaacacacaaacacctttctgcaaaaaaatggcagagtacctccaagagaaggctaagaaggcaagatttcacacggtcattaccactgggaacgtcagacgaaaatgggaagtcacatgtcgcactaaagggggttttggatcttctactggggtcatgactcatgaagttactctagggcacgaatctgataacacatgttcgtgctcttgcaataagccgaagcttcttcataagccatgtagccatgtcctggccgcgtgcgctaaaattaagcttgattcaacatcatacttgtcgatgttctacctaaaggatagagtgttgaatgcatagagtgctgagatcctcgggtggaggtccctccaacacctagttgaaagtgggggtgataaaaggatctatgtgccagacttggatttgttgaaggctggtaagggtagaagacaaacacgatgcttaagaaatgatatggatgcatccgaagcgggagggcctgtgcggcgatgtgaggactatcttcagtacgagcaccgcactagagactgcaagaataacaaggagggcacatcttctagcatggaatctaggcaacaacgtgcaatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtctttttccccccccttcccctcttgggccggctcggcccacctccctccctctctctcctctcccccgcggcccaatcggcctcctccccgcgcgcgtgctgctgacgggcgggcccgcccgccaccctcgctgacgggtggggcccacctgtcatccctatcctcccgccgctcctgccgcctcgcccgtgccctagcgccgccgccgccgcgaatcccgccgcctcccgccgtccccgcgcgcaataaagagggggaaatcactccccgtgattccctccctctttccccccacttttccctctctctctccctcggattcgttcggatttactcccgcgaacttcgccggcgcatcaatggagcccgagatcgccgcgccgatttccttcccctccggccggcctctctcactcccaaccctatttaaacgctccccgtgcctccctcctccgtttccgccactcgccgctttctctccccgtcggaatcgagcccgcgccgtcgtcctctctctccgccgtcgcagccgagctccggttcgccgccgtcgtcgccccggacctcctcccgctttggcatcgcctccttcggcttcgccgcgttctcgtcgacctcgtccactcctccgtttcgcccgccgaccgccggagcaccgccgtcctcgtcgacccgagccgcgccgccgcctctttccgcttcggtcgccgttcccgtcgtcgccgtcgacccggggtgagccgaggaccgccatttcgtttcccccttccctcccctctctcgggcgccgctccgtcgcgccggaggtcgccgccggcgaccatcggggcgcgggcgcgccgcctcccgtcggccgtgccggcgaggccgcctttgggcgcgccccgcggctgccatgtggggcccggccgtcagccgcccgcgccctcgggtgcggctgacgcgtgggacccacggcgccggccagcgcaagccgcgtgcgctcggtccaccgtggaccgtgaggctgccgcgtgggccccactcccgtggacccggtccgcgcgttcctcccctcggctcacgcaataaatccgattttaaattaaaatttaaatgaagaaattcgcaaatatccatttaaagagcatataaatttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttacaaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcctggtatcactagtatgattttaggtagatgctacgctgtttaattaggtaacattaaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaataactaaaatgtcgaatggttggcctgggttggcttgggacgagctgggacccagggtcgggttgccagttcggtctggatcatcgtaggccttgggttaaggcaggttcgtgagggttcacggccttgattaataatactgtgtagctctaggatcgtctttataaaatggctttgggcaactaagtgacttttaaatgttgttttctgcataacttaacccctatatcattaccccttgtacccccttgcattagtcgtgcatctgccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacatgcaaggaggaatagaaggggctctcaaggggctcacgatagggaggaaggaaacctactgtagttatcatctacactgtctggttatgtatgttcggtcatgatatatatgttgcattacgttgtagttcaataagtttgtaatatgtgtaatataagtatgtgtaatatttattttattctggtaatgttgtaatatttgattgtaaggtgttaccaagtttgtaacgtttttaaacctatttcgtaaggtgtgctcgagtttgtattcgtactctgagaaaattgtattccttttttttatgcattatgtactttttcgtatatgcacttgatgaaatttctaatttacctttcatgatgtacatgcagatatggaagaggagtggccttacccgttgcttagcaaagagatcgatgcacgacatcgtgcaaaaaagatatctgatggaaattcttgttctagtctagctgtcctgataccgcgtacagccggatggtgggtgattgatccacgatggaagccgaggtgcataaatggttaaagtttacaacataatgatatcgtactataacatatcctaatgtgacgcaggtcttcttacctaacataaatttcatcataggttgtcagctgcaggtcttcttaccttcgttcagatgacgcaggcaacgatgcattacgatgctagagaatctaaacaaaaacaaatgggggcacatagaaaacgacgacaaaatatcgacaagtccctacttatggcattggttgataggtggaggctagagacacatacattccatctaccgtgcggagaaatgatcataactttgtaggatgtgtctatgctcacggagttgcccatagccagccaggcaattgtacttccagacccttcggaagattggagagatgatattgtatcacgatatgcctgtattctgccacagtacgctaccggtgatacagacgatgatgaggataaaatatttttctctgaaaaataaactcatggccccacattgaagtggttgtcatagtttgaggtaattgaatatttttaattaaggcatattccattcacattcacatatctcacaacacattgtttttttaggtgcgatatatgcctgacaatgtccaggagtaccaactgacgttgtaccttgaggcttatctactttggctgtttggttgagtcatgttcaccggctcgcacgggaacactgtggacgccaggcttatcccccttgctcaccaaattgctgaaggtaatatagtgccatctgcacagtttagctggggatcagccgtccttgcagccacataccgtggattctgcgacgcttgtgttaagaccggacaaagggaggcgattttcacagggtgtccacttttggtcaagttgtggtcgtacgagcacttctcgttcggacatccatacatgagcgtggccgtggcccacaaggacgattacgctgacacagttgatgatcgtcctaccttcggtactcgctggtgctacggaccggtacgtatgcttgcattaaaggaatatttctgtcaattcaatgatactgcataactaaatctgcaatctccgatcgtgcagccacagtgggcgagaatccaggtgcacaatgtgtacaagtacttcaccgagacgttcgaaagccttagggaaaacgaagttcggtggacaccgtacacgaacgaagaggccattttgcgtggaccaaatggagttagcatcttatgctaccgcgatgaagcgtactggatgacatgaaaaatgctggtgtacgacatattcgtcgaggggtataatgttcaaagggtaatgcgtcagatgggactgtaccagcaagttccagttcctgttggacttcaccttccaccagatgtgcacacgtatgttgttattttacatcgctttaatttctgtgctctccaacattgtgagatataattaacagctaattgttgtatttttgtttcatgcaaaagaggcaagctgacaacaggtatcgtcgatctatgcacttaaggatgaccccatggatagaggcgtggtcgcaggccttgaatgatgtcgtccacgagaccagggcatacgatcacaacacttacgaacaatacatggcctggtactcatcgcagactcgcatccggctgcttgcacccgaggatcccgacgagcgaggtccacccactattgagcaaatatatgatctgtagctagcaccccccgctcacttgacggtactactcgcatttaaatattttattgcatcggtgtctccttatacatggggttccaatttctaacactgttgctccgttccatgcagaccgacattgcaggggagttagtaagggatgcgaaaactttgtgggagaagcttagagatggtatcgcgggtaccaaccaggaagttatggccacggtcgactccctccgtagaaaaggtaaacgaatcatgcggctcgcgtcgtgccgacattcctcgaacgtgtatactccggcaacatcaataaggacgttcgagcaaatgccggagcgtccctctacctcttcccggccatccacctcagcccgcccttcagcctccgcgcgatgatccagtgatgttcgtgctccagtaaggtcaacttcgtttcgtgaggcacctactattccgactatcccagaaatcactcaaatgtcggaacgcctaggaggcttcggttcaactcaacgtaaaatacgttattacacaatgccaaattaagtgccatttatattaacgactaatttatatgttcgcagcacaaccggaacgggtacccccacatagctctgcgcccatcacctctcaatggcagggtgggtttgcggcgttcgctggtacgggatagctcataaaaatgctgattttttttcccaattgtttatgtgaaatgactaaatgatgttttccaattgatgacagagggaacgcgaatggtccgtcccgtggctcagatgcctcatgcaaggccacatatgattcctcaaatgcctcccgatgtgccaacctcacactggcagggaggatttgcaccatttgcatgtccgtgtacattcagtaccatattgtcacgcatatgtccacacgtaattttacttgttgctaattaattgcatatacaaggactagccaaggtatccgtaccataccccgagtggaagcagaatttatcggtcaaggagggtttacgtcattaggcggtcagtctccacttacatctaatttcacattnnttattattcaatntnnataattttcatgtataggaaatctattgactatttacttttctgaaataacaggncctactcagtcggttccactgcatgcacctacatatggcaccaacccatggaaagcacaatccatagattcggtgggtacgcacanccatcactctctatacacatatatcgatggcatttccctgtcatacatgactcgcacttcaccaacggataataactccgtgacattttatatggatgcaaggcacgtcgtttggtggtggagtacatggttatatggacttgttgcaacaaggtgattggctatttggtcaatattcctcgcatcgtaatgaaattccatatatgcaagcaccgtcaacaggtttggatttttttttgtgttattgttgtttgctccagctttgataatttcattgatatctacattgcttatgtagggtcatttcgccctgaactaatgtcagggtttaggccttacactgcatcgtacggtgacatttccagcttcggtggagggtcatcattggtacccaatgagcttcgggcttcgcaaactgatgatgcaccccgggtgacacagcccacacaaccagaggttgacgatttacaaggaaacaacaatgacccgcatagatctaaccgtgagcgccatgagccaaaccgtctgtcactctcaggccctcgacatgccgcaggaggaaagaaaaaaactacaaaaaagcccgctggcatatctaggactatgactgaccatgatgacgagtagaggttaacattatgtctttaagttcactggcaaccctgtctgaaccttgctatgcttttggctttctattactagcagagaacattatttatttgtactggttattcttcatgttatgtacgatgtttcgtcgttcataaatatctcatatattttcgcccctattttgtacgcagttaacacatatgatttttgcttaactaataatttttcgtacgagagctaacaaaaataatagtctcacaaactaaattaatagtgcaatttcgatgttactcgtgcggttaaaattggatagttgtattactttttactactgtgacttaaattacatactaatttcttttcacagagatgcaatcatacgcacctaaaatggcatcctctctttccaatcatgggacatgtcacagagaatcaatcattcacaattaaacagtgaagattccactgcgccgaaagtgccttcgtcgcgtagtaattactaaagcaaacagttaagcagcatgtgccaccgaaagtgacggtgtccctttgtaattattcacttcacgagtgaaacagtccgacgcgccgtcgtctctttctaataattgtcactatgcgtagcttcttgcaatcccctataaataacaaccaaacctagcacacaactacatctcttcttcataaacgttccgctggttccaacttcgtgttgcatattcttaggcccgatcttgaggcaggaactgagtagttggtgaactcgctctatgttgttcattcactcgcgacacggttcctgtcccaagatcgggtctgtgaatatacaaatgtgattttttttaatacattcttacacccactctttttttcaagttccagcatccgtttgtgaatatgacctactactgcaaattcataaactcggtgttgcatattcttaggcccggtcttgtggcaagaactgagtagttcgttaactcgttacccggttcttgtcacaagaccgagtatatgaatatgcaaaggtaattttctctgtgaatatgacatattctaaattcctattctttgtcaactttgtaaaaattgctcccgaatgatctctctactcctttatatatttttcctatattctaaattcctatattgtttctttcctatttgtatagtcgcactccgtcgacaccatctcctcctgcctcaaggctggcatgtcgggtaatgaacctgcttgcgtcgccatctcctcctcttagcagtggctgctcgagctgttctaatcctcttgcgtggtgttgtgtggtgtgaattgcagtggcctgatatgatttcttgtggagagacgccgagtaccaccaggaaacccttgaaatcctcaagctcgccatcaagtccaccaagaagctctgggccgtgagtccccctcctcaccaccttcagatatactgcagttcgatttattcatggtcatggtctcttagtgttgcttttgttgtttttgcatactgacatttgcgttctgtactccattggcaggtcatgcttgacacagtcggcccagagttgcaggtggtgaacaagagcaaagcctccatctccctgttattctcaccccttaccaggggcaggaggcctcctcacatgtactgccaattaacttcgctgggcttgctaaggtaatacctttcagttctattttttccggaatcttattaggctgtgcatgaatgattgcaagcggataggtaatacctttttgtgcaaaattttattatgctgtgtacgaatggttgcaagcagacatgtccttcttttatagaacttactattttgtcactgtgatttccagcatatgctcagtttgatataaaaaatgacttttttttttgttctttgcaggctgtgaagccaagtgccacaatatttgttgggcaatgcttgttcacaggcaatgagactacttcaatttggttaagacgtaaaaaatattcggcatactgcacttagcgttctgcatttttttttccttatgtcattgtcagtagaatttactttctgcccaaattttctgataccaaaactctaatttgccttgtttaggtttcagaaaacaaagccgaatttacatgtctacactggtatctccgaagtgcctcgttttcaacgtcaagaatcgtcagatgctcaccaatctgaacggccatagcgttatgttccttagaggactactcgttaaggtgttcctacaagaactacctgttaaggtgtttgttagctttatggttcagtatttgtgtccagtatccaccatgcagctgtttcatgcaaatccttttgtataacaaatattctatagactcttagctttctaatattgctgctctttccatctaatagatttgtcagtttatagtcattcctatattacttacgctactgttccagcgtcagcatcccactgcagattaaaagggtgcattgtgtttcttattttactctgatttatatatgtgcatgtggcgtgggttagactgaatattttgtttcattcacttagaatgatttaagttagattaacagctttgtttttacacctttctttgaatgcccatttcgacgtctgttttattagttctagcagtcattctaccgttaattgaacatcagtccaaccaagatcgggctaaaagcatatggttctgggcctaaatacacactgcaaggacatattctgctaatcactcatcaatgcttgctaattacagcctattattacccaggatgacagcactctgatccgactgaatttcttccaggcggcgcgccaatggcgcgccccatcgtctagtttggtaatcctttttttctcgctgaacgatctagtgaatgatgcaactacggttacagattaataaagcgcgtcaaatggcttctctcaaaaaaaaaaattgatagggtgcggatgctgatgcaaataagattatttcggatattaaaaatggcacatacacgatgtgataatggattaaaattgtgaggtgttatgtatatacgcaatcaacacggttcataggtactattgatgtgtaggggtagtgttgttgtggaagttggggaagctacaaccgttgtcaatggagtcatgtgggctacgactgattaacgtcacctcgctgtcgtcggtttttttccttttgaaaactcatgtattaatttacattactgaggttacgtaatactaatacattagcaattacaatgcatagagcacacatatggactatggcacatcctagttttctagaggactttgaaagatttgaaaatagaaacaatcgagtccttagtaatgtaaattcaagaagcttgattccaatatagcttaaaataagatgagttgcacatgattgaaccactgtactatcccaaaagggatctcacacaaatggatttttaggcgatggcatacaatgtgatatttcagccacatcatagaagatttttgccaaagcattagccaaagaagacacaacagaagttgttccaaaggtctagccccaatccatgacaccagcgaagcaaacataataagcacagcaagatgcaaatgaacccgaagaccgtacccaaaaggggcctccatgcataggaggtcggggtcaacttgggttggctcgacaccattagtcacctcatgaagaacttccaccgaagatgaaaaaggccttcacccttggaatgagctcaccagagatataggtgtagaccggtgcaacctattctcgtgcagatctggaggcattctaaccagtagaaaggacccgtcgacgtagtgactcatcggtgggatcaaatcccatagtgaactccatgatggcagcaccaatgaccagctctagaacaacaagagcaagatcgactagattaatctagacaaacgggagaacccgactaaaacaacaactactagtaggatggtacctaacccctctttcactcttcgttggtgacaaatctccagagagaaggatgaagaggggtcggagggatgagagtgctactgttggggaaatttaggagagaccttgcatgtttcccttgtgggtttaccatccggggactaaattgcccgatggaagatctacttgttttggcattggaaccgttgttatcaagtgacagaagctaaaaggatgttgcctcgctatatggcgtcattgggaaatacgttgacatgggagtgtgggacattgtgttccattttgtgttggggcgcatcatcgtttgccactcagctcgatggagagcagagtgttttccttgggcgcacgtgtgagtgggcgcgctaacatgagaagttatgtagaggtgggattggagatcatgaggaggagacagagaggaaagatgagagctagctaggttgcaagagggcacacggaggtggatcgacttctccccaggcgtcgacagcgacacttgcaagagagcaagccgtctcgcgtgacgaatccaacggcgctcgaggctcttctctagtggcggcagcgactctcggcactagaggtcataggggacggtgaccctaatgacagtggtggcggccatagagggcaaatcatgatttgttcctgggtacatagggccacacataagcgttacatagggcaactctcaatgactcaagttagaagtcatacatagagcatcaggcatctgaaattggcccatttggctttccgcggacagcccatttggcggcccgacgcaggataagatgggatcgtccgatctaatggatggtctcaattgatcccaacctagataaatacccggtagccaaaaccctaaccctaaattcatttctcccgatccccttgctctctcactcccgtcatcgctgccggcaaagggagggggg

SEQ ID NO: 57737 - DNA, 1862 bp, Oryza sativa
  unsure (1)..(1862): unsure at all n locations
tgccccattganagtcacttctcctggtacagaagctcatcaacaagcgatagtgccaagcaaaataggtgtgcttttttcttgatctaccatgtatacatccaagtcacagctggtgacaacaaatgtcatgccctgtcgtgcaaaggtaaaagaatcccctggatttttccatgaaaagttgtagacatcaccaccggaatttatagggatgacatgggtggaggtgatcggaattaagttgaagtggataaaatagatattcagaccatctaccccaatatcaccaagaacctctgtcgatccattgttcaggaagagtttaggaggctgagtggccatgtcgcatgtgagactgaaatcgacatggcggaaacaaccttgtcctatgccaaagggataatcgaagctcaatttgccgcatctctttggacagcgagcgagtgtagaagtggagggtagggatgcattagaaggacttggattggtaccatgatccagtaggaaccttttctccaaccgtctggtcataccctctggatatggggtgatgagatggccataggagaggactggactgagtgcaaagcttctcttgacttgagctatccccaataacacgaatgaaagcaaaggtaacatggtgttgaggtggcccatctaaactctgccaagctgctaccctctcagaagtttaaatataagtgtgtctagagctatgcctttcagcctttgcctctgctcttacagttggccctctatttataacagaatgaaagctagtcaatttcagtgggtagtgacgaaattttctataaaattttcaatattgaggtggggaaggtgtttatacagtatgtggcgccacaagctcttgctacgtgtattggattattcaaactaccgaacgttgaattgtacttatatgctgttggcaaattagtacatgtagtggttggaaagaaggatgagtcactgcatttcttgggacaaaaatatgttaatgtctaccctcttcgttttatattataagatatttcaattttttaagttatatttgtttaaatttaatcaagtttatatatagaaaacactaaaattttcaacataatacaaacatatatattattcaaatatattcaatgctaatatgattagactaatttagtattatagacgttgctaataaatttatctgtaaatttggtcaatttaaaaaatgcgattagtgaaaacatataaaataaaatggagtgagtaaaacattttattatatttggcattggactaatggatttactgttatttactcaatccaggcagtgctatcttgccacccggtgtcaaaagagaagacttcaaacatgtcgatataaaaacaatgacacggagagttactatcaagcaggtgacaccgtgtaacacaaagcttctcttgacttgagctatccccaataacacaaatgaaagcaaaggtaacatggtgttgagatggcccatctaaactctttgccaagctgctaacctctcagaagtctaaatataagggcctgtttggtataactccaactcctaaatataactctaggagttgaatttggagtggagttgaacccnnccgtcctctgtattgagacccccgagaggctcgctgctaggctacgcgcatatgtgcncgatgtgaccccttcttataaaaaactccactactcccccaaaagtgtttcaaaaactatgtgtgtactacccccaacatggttaaaattatccgtttggttcaatactcggcaatatgttaatttttttgcgccgctgtctcctttggaggtttttttccccgatgaccaatttttcttttctcc

SEQ ID NO: 57738 - DNA, 10628 bp, Oryza sativa
  unsure (1)..(10628): unsure at all n locations
tctggcaccaggagtaggttctnctactgcaagnacctcatcatgaagtcatcctttgccacttagaagtagcatgttggattcctttttcttcattggaaatggtagtaatcccaagagaggtcactggcttaacaaaagagaactcgtcacctatgatcagtgtaagtagtgtatgtatgtgtgtcggcatccttcggggcgcttcctgcaatagcccgtaactagaaattcgtcgcgccaaatggcgcgccctttttagcatgttctatgcatatgaacgtagaattttcaaaagattttggtaggattagaccgacttcattaacttgttcatttaacatgtagatttattcaattaaaaatcatcatattttaatctatttatggcatagctattaaaaagtgtttttatgtaagtctacattatttaaaatgtacttattttaaaaaaatattgattatcaagctttatcttcagccaaataagccatggtctttaaaaataagctttacaaaatggattgttttttatgtaagtctacattatttaaaatgtacttattttaaaaatattaattatcaagctttatctttagctaaataagccatggtctttgaaaataagctttacaaaatggacatttttaaataacgaccgtactcgttttttacataaaaaaagaccaaatcgaatttatgataaaaaaaacaccttttcctcgttcaaaatataagcattcaaagtttatatcagaatatagcaagagtatccgtcccttatctcaaccaatcataatatttcttatttaatttttccacttactcacctagtttatatttggtcttcagctaagaactatgtaataatggctatagcttctattgaagtaaactggattttatccattttctaaaaaactcacctagtttattaatacttatacccaattccaaacatttttttagacctacaatgacggggcatttctcaccaaagtagaactaacaaaaaaaaatctactccaaccccgaaaactttatttctagcaattcttcattttgccaaagttatataaatatcgtaaaatattttacatgttaaatataactatatcttttggatccatcaaaacatgacaatttaaaagctgattccggctatcggttggcaaaagtgaagcatttattaactctctttattattttatttgtcgatacttatcaactgcattagtgcaaagagacaggtagagtaatgagttttctagagattctgatgtgcaagggacatcacaagagcttattctgattgacacgtggcaaaattttggtgatgtttagctaatttttcagtctgccacgtggcccaataacaagctagaatcatgaccctgaaatcggtattaaagaaagatttatcgggaagacattcaccttgggagattgcaaaggtcaggctccctgttttatagcgatatatgggagattgggaggtctcgggggcatatgttccaataatgaaagcgggagtgtggatgatcctgtcgcatgtcattagaaacaagggcatattgattggagtcggcatggactgtgtcccacacgacttagtcttttttgtaagtaaagattgactaatttgcatgggtatcccatattaacttgtaatctaaacaaaacttgcaaactgatatgaagaaatgaagctagataaataacatgtctgtgattcaggagtcgggaacattacactttacttcctctgtttttttaactaactaatgtcatgtaatgtaaataaaaatggagtgagtatctagctaggttcgatcatcatagaccaatttatccctgcaggggcgaaagaatgtcatcaagatgctgaaagaaatactcgatgagaggaagaacacacaagagccccatgaaagcgttgacttctttgatgtgatagaggaagttaaggccaagaatcctgatcaaatgaccgagaatgccgtgttggacttgctctttttgcttctatttgcaagcttggaaaccacatcatccggaataactgcaatgcttatatttttgacagataatcccgaagccttgcaagaactaatagtaagtactagtacaagtcatatgaactcctttaataaattcatactagaaaatcaataaggtcagatgttcaatatttccatcattgataccttaggattgagctatcatataggagtatgtgacaaccgatatgttaagacatatttaattaataagaacatatgtatacataagaattatagcaggaatgtgaatttgatatctacgaatgcatatctatgctccttataaaaagagtattggtggtggtggttctgacaccaccagaactcccaattttttatgagacaaaaaaaatagagcaccacaggtcaactacttgtctgaggtcaaaggatccacgtgtcgataacaaatatgtacaacaattaagatatgataataatgggttaatggtaatcttatttaattaaaatgctattggctattgcaacgcatgggctttacccaaaaaaagttaccgtggtaatgctatacatttccaaataatccaggatacgttttcttgaaaattaatgatgtttggtctttttaggaggagcataataacattcggaagagaaaggctgataagaactccgaaatcacgtgggaggaatacaagtctatgaaattcacatctcatgtatatgccttcaatttcttaacttcatttctacataaataattagcaatctacacatgtttatggttaaggccaaatcgtcgtacaatatatgcatacactcatctccttaattatttgtaaccttaattatgtgtaggttatacatgaagctttaaggctggcaagcatcgctccagtgatgtttagagaagccatagaggatgttcatataaaaggtaaaaatgaattgtttttaacaagaattagttatacaagtcataggtaaaagttctatacctcctttccgtattataggtagtttgacaagttcattgaaaaacatagtaactgttacaacatcaaattagttttatttaatcaaccattgacaatattttataatatatttgttttatgttggaatttttgctacatttttataaagtttgttaaatttgatgaaatttgacttataacaaacccaaaatatctcataatatggacggagggaatagtatcaaatttgtcaaaaaaaaaaacattgcagtatgtcttcttatgagatatattggtataatttatacaggttttgctatcccaaaaggatcaaaaattatgatttgtccttacactgttcacttaaaccctgtggtttataaggaccccaacacattcaatccttggagatggaaggtttgtgaaattcataaggagttaatttctatctgatataatacttaaccatgcattaatgtatatctatattcctcctagtgaaaaccaatattgagcaattaaggagccaacttttttgcatgtaaacacatgcaacattgtaatttcaaatgtgagcaggccaaatatttaagtatataggcaggattctcaagtgtagtatagttccatcaaacgggatgtccaacaattaacatgacgagccgctgaattgagttttattacattgagataatgtttgacatacttaattaggtggtttgttcacaacttacatgtttaaatatggtttaagttttgttattgtgctacataatttattagtgtaatctgaatatagcaagctaagatacccaaacaattgctattggctgataaataagagagtttactctactgatcttgctaagtactacacgttattgctagaaataatggagcaaaaagcccactgtttttgttaggcatcaggtcgaaggattaacatggtcatgtggatattttgtctacaaatagaattccaaacatagcttactcacactaacataaaggcttgcatgtgcttagatatcaaaaaataggattaaggagtgcggcctatacagcattaattccctccacaaagttttgatttgttgcatgcatgttgctatatatgtacggaatattcctgaacctgctagtggtgcctccaaggatttcatggcctttgaaggggggctgcgcttgtgtgttggtgctcattttgccaagctgcagatggcggttttcctccactgcctagtcacaagtccaggtaaatttttcactcctattcgtttcattctacattaagtatcaaatcctaactataaatctgaacatgtgaaagatttgattcttttttatggagggtgtacctttttcagaatccatctgagaacttagagatcattttcatctgtattaaaacatgtgtatacagcttttgcaaacattttgttatatatgcaagtaatgagtgtacttaggattaagagaaccacttacctatatatccatggacgcttaagtgcactgcaaaaaaaaaaattgatctttctgtctacgattgtcagttggaaagcaatcaaaggaggaagaatggccctttctcctggactacgatttcctgaaggttttcatatccaacttttcccaaaagcctgaagtacttggtccatttacttcttgctcctacacaataaataatgttcataagcatctatgtttcagatgcaaattgctcaatgctttgatgtaatttcttcacttcgctatatatgtcgtgtgtgtgccgcccaaactataaataaatatataatttatatatgtttgagtcctcgtaagtagtaacaagcaatttgctaatatgttgtcgcatactcgcacagtcttcacctatgtcctcgtatagtaagtactatgtggaaatgcataatgtatgtaaaatgagttcgattcataagaagcatatactccctctgttcaaaaacaaaggtattctagtttatttagcaaatgttaaggtttgagaacaaaatgctatgggctacctttgctaaatgagtactccatgcatgcgtctatataaaccataatcaattcagctttttaatgatatttcaatttcaggtttctacctaagttgcaacatatactcccacccgtttcacaatgtaagactttttagcattacccacattcatttaaatgttaatgaatctaaacacatacatatgtctatattaattaacatctgtatgtatgtgggcaatgctagaaagttcatttaaatgttaatgaatctaaacacatacatatgtctatattaattaacatctgtatgtatgtaggcaatgctagaaagtcttacattgtgaaacggagggagtagtatttatctgaagattcatattgttattgcatatctatagagaaaaaaattctttgtatctactatctccatttcttttttttaaggaaagcggcaagagtattgccgaatatattagaagaagagtaatatgcggtttacatgattacacgattacataattgatgcgacgtaatagcttagaagcatcccaaaaccatatattatggtttgatagggtaaaaatatacatcatggtggttgaaatacaaaactgctttattgaataacttagatgatctggtgtgctgtccgttgcacgtccggttcttctcctctgaagatctttgcattcctttggagccaaatatgccaccacgtcttgacaagaacacccacctttctccttactcncgtcttgttttcattctgcatgatacctgccatccattcttttatggaacataagtctggttattctgaataccttgaacagcagagacaagattccatgtttcttttaggaaatcacattgtcgaaacaagtggtcggtatcttcaaattctcctctacataaggggcaaatccagtcacactcccagtgccgaatcagcatgttttcagctgttagaaccttgtggtgtaggatgagccaacctaagaatttttgttttggaagcgccgacgccttccagttcaacaggaaaaccttgtcttgctgagaaccaatgaattggaagagataaggactttttgccgagtatgtggccacattattccttctccattagattgtgtcttctatttcatttagcaaagtaacactgctcaagagtcctagatcaatgagttcctggatctcttcaaaatttaaaacaacctccgtttcatgttattataagactttctagtattacccacattcatatagatgttaatgagtctaggcacacatatatgtctagattcattaacatatatatgaatataggcaatgctaaaaagtcttataatatgaaacggaggaagtagatttaaggaatcttaataatttcccttttttttcttatgcatattgtttagggcctattttgttttaaaatgaaaattgaattgtttaagatctcacataacaaataaatggatagttggggttgtgatgtttattggaaaagttcaactgctgaaagaaaatctgaaaaccaaataaataaagtacatgtcttggatttgtgcggaccacatctattcctaacattcttgtgcacgacctgcaagcctagcatttggaaggcccgcaggattggttattagcttagtggtagaatgaatcactgatattgcatcattgtgcctgggcaataagttctctcacctatatggatagttgaatgtactcattagcatggcatactcgtcctgtttaaatcagggtttgaaacatgtatttttctttttcctatgggcccatgtgggtggaagcaaataaaaatgagaaacatgttatccgctcccgcttcgcgttgccggtgcaatgctaataatttcccctttttcttatgcttattgttaatggcctcttttgtttgaaatcgataatacattttttttaggatctcacataacaaaaacatggatatttggggttatgatgtttattggaaaagttcaactgttgaaacaaaatctgaaatttgtacatatttatgatttataaaatttaaactgctgggcaaagccctggctgtactttcagtcaaaaaaaaaatctgaaagctaaatgaacaaagtacatgtcttttatttttgtggcccacatctgttcctaacattcttgtgcaagccctggaagactagcatttggaaggccccacataatgggctattagcttagtggtagagtgcagacaccactgatattgcaacgttttgcctgggcaataaggtctctcaccgtcaatgcactcatcagcgtatgacccaaagatatggatcatgtaagacgcattagcatgggcatacaagaaaatttcacaatgcaacttcaccatcccaaattcacccaaaaaaaattcatgctcacaaattgacaaaaaaaaaacagccaaggatgtcgtcgtagtgttggagttatcctccgtagtatcatcggctagcgtcttggggaagaagccgaagctgtgcacaagcatcggcgtcgacgagggagggcggaggccagccgcgacgagatccacttgaggccaggtggcagcgaatccactctcccgagggccagcggtggcggaaccgccatttgttgctgctcttgccgccgatgcatgagggagagagaaaggaggttgcgtcgacacagtcatcatcctctctgccagatccaccgttcacaggccaagccaccacaacccttgctctgttgcctgatccgcctcctaggccccgcctctcctcctcctcgtcgctgagatgccatcgatgctcctcctcatcatgactgagacattttcgccatcgctcctcctcggagccgccaccttttcacctccttgttagagccgtcgttgctcctcctcgtcaaagtcgccgccactgcaaccaagtggtgggtttagcatgagagagagagagataagtggcagggggaggggagagaaatgagtggtaaaggagaggataaggagatggggcttagattttttttatgctggggcatgaaattttcacgtacgaagtattgatttttacaagtggggctataactatagcagctcctgctatttttccaatcggtttataagtgggaattttatggtccacctggagaaatgaaagctaatgttgtaaacactagtacagattcggccatccttgacgagtcatatgtgtcgagcttatatgacctattttggatgacgcatctctaacggttcaaaaagtatcccatttaatacatgactatcagggatgatccgtcactgatataaatcatctttgtcaggtcatcgttctaacacatcacaggtaacctataacgggtcacaaccataccccttcaccgatttaaagtcatctttgtcgggtgaaagttctagcacgtcacggatgacctataatgggtcacaaccatacctcgtcattgatttaaagtcatctttgtcgggtcgtagttctaacacattgttgacggtcgttatcgaccagtttcggctgtcaatattacccaattaatgaggactaactatgcttgcaatgcattattccataaataaaatattctattccactatatgcttggaaaactaaccatgcaggagaagctatcaaaatggaggagaatcgacagtacaataatcgatcaatcaaacagacgttatcgagaatcagacttatggatggatgggccaagaactcagaaatgagctatcattctgacccaaaacattgtgtaccataaagtggggcccacatgacaacatcctgaagaaggttgtgggccaggggagccagccagggttcggctgaacccccaacttgcccaatccagcccattttcggccaggcagttactaccggcatcctatgacggttcgagctaattctacctgaagaaactgccatggacacatggcaagaggagatgaaatatgctctttggatgcttgaccatgtcacttgtcatgaggagagcaaagatgctcctaggattcttggagcatctccactctcccaaggcacctcatgggctataaatatcccttctctcattcattcccacacacacctcaaaaagaagatcaagagctctctcaagtattttttagtatttctagtgttagtggagtaggaaatagaatagtcttcatagtcctcgagtcttcaggagaattcgggtatggctttaataactttcctttcttcttttgtaagacttaatgaattaatagaatattcttctttatacaagtttggtattttattccattcatattacttgagtaccgactttactttatacttgaatcaatatagtcgcgtaactagctttccagataggtgtattggtgtgggtttagtgtccgattattcggatgctctatgtcggttgcaaggatgtagagtagtatttagtaatgtaagcgcggtgcttagattattagataccattaataggggttatatactgcggatgagaggtgggccgctgatggtgacagctcagtacgggtattcctctgcgctggtatataatcctaagttaattccctggggagggtactcctctgtatttagccccggttgtatggtcatgatgggctgtcgtaaggaactcggtagacaggggtggcttcttgaaacaccgagaggacactgggtacggggtattggttacatgactatataatagcaagtatagactaaagatgtatgtatactagaaggacaagaatgatgcttttcttattctttctccacttagcttagactatattttagtgagagtagttcttagttctttcttctctgtgtcaacctaccctttgaactgaactaactcctacatagactttgatggatacaagtaatatatgtattgttagcatagtactctcttatcatatcttcccttgggataaaataaatatgatacattggaatactcccgggtgaaatgctacaatggtatactcgtgagcttgcggatcacatctgtaaccataatataccaggattatttctagtgctacttctgggaattatatttctagtagtgtcgctaggaaataccaacacacagcatgaatgacccataacgggtaacaaccatgccccatcacagataacatgtcatccatgccaggtctaataagataacccatcaaaatgacagcactcatctatgacaaatcttaatgagataatctattctataccactgggtttgtgtgagttcaatgatttgccatcgacattgtatctttctataatataccggccactttatcaattgttctacaatacgccactgggttggacattcttttcaaaaatacccaaaatacccttatgaacatacaaggttaacaattgatttatctcactagaaattccaaaaaaatatgaaaacttttatgtggtctctttacacaacatggaaatttgtataggagtttcaagttttttacacttctttttttaaattataacttatatgctatattgtatataaaaatatttttttattatttgtaatataaaacaactttcacacacta

SEQ ID NO: 57739 - DNA, 3704 bp, Oryza sativa
  unsure (1)..(3704): unsure at all n locations
cccgcctcgcacgcgcacttctcaactctggcntttgctctctctcgcgccccntaccgttgtcgcgcgttgcgcgctcgtactgggttgttaattgtttgttcgcgccccccccacccccccagaacgttgatgacagtggttagnaccnactncatnaccaatggcatatcatagaacaattgctaaagttatcggtatattatagaaagagataatgtcgatggcaaatagttgaactcgaacaaactcgatggtatagatagattctctcaatcttaattaacacccttcacggataatgttaccctgaagggtgacaattacaaacctccacgcatgaggaaaaattcaaatttttgaaattttcaaacaacctcagattatgaaagttgtagatgtcaatgatatttataacttcaaaactgataacatttgaatttgagatagtttacatgcccgaatatctatacctatactaatttggcactttttaggagccctcacgttaataagaaagatccgaccgttgattagattgatcctattatcatgaccgtaaatcatacttaaaattatctcaaataaaatatgtagttttgcaatattatatgctcttttagttatacatacagtatgagctgtttttgtggtccaactatataaaatcaatatgtgtttgactgttattctatgataagcaattggcacctgagattattggttttgatatttggtgattattggcaaagtggttttggagataattggatttgtaggtgatgaatatggactgcttattgtcgtgtcgggttagaccaggcaggtgttgccggtcagaccggaggtatgcgtgcggtcagaccagcttgcccgcggtctaaccagccgactctgtgtcggtttcggtttcgggttgtttcattggatatccgtggatagttcatttttatggcttctagatggatactatgtgtatataatactgttgtttgctaagaatgagtcaaattggagatagctgggtctcggaatatagttttttttgtttgattcatgtgtaggtgtcttgatgcctcgaaagagtattgccgatgatggattaggagtcaacttggagataaggtgatgtctggacggtcacatatcatgcaagatacttgggctaaagatgaatgcacgtggttggtgaagattccatatggcatacgatggagatattgtgtgtgtattggatgcggagtcaaatttggaagtagtccaaatttggtacaattggagtttgtaaagttggtttcttatacaggaaagtttcctagagggatttggacttctggtatgagtttggttcgtggctttaggctgcctacctcatgtataaatagagagggagggtgaggcctcccggtatcgctttagagagcattgagttgtgagaatagtttaggtttcgggtttaatggagattttcgtgaggagtgctgttgctgcactttgtaaacatagagagaagtaataaagttatcatctactttgggtgttcttcaatttgtgtttggtcgggttcggcggtctaacccgcgagacaccggcggttagaccagtgggtacacggcggtcagaccggcatcagtgacaggaagcataggcgatttcgggatggttagaccgggtgatctactccggtcagaccgacgacttccaggcggtcagaccggcggatcaactgccgtcagaccgcgtttcatcgattcaacggtaacttttaattccactcaaagttttggtttttgggtaccgtactacaaccattcaccctttctggttggcttagtagaaaagtaaccagcatagtttggttacaattaaaaattaatattttaacatgacccgtgtaatgcatgggttggtgacaactgcattataagtggtgagagctattttgaaatacataattttgaatttttcaaatgatctcaaatggagacatggcctatatcaaagtcaaagggtttgatgagatctacaactttctaattgaaaatattttcatttaagattgttttcttctccgaataagtgttacaagtgatgtgatctatttcaaaaatattttaatttaatgtgtttttcaaacaaccttggatggagatataccctacactaaagctgtagagctcgacgagatatgcaactttgtagttcaaagcattgtcatttgaagtcacctagcatttcaattttgtgttttatatttggatataaatagttaaaaaataacatctgattaccaatcaacatgtggtatgtaggtgggatggtaagattggtttgcatgtgttgagaggtcttaggtttgaatctcatgtatgacatgtatgcatttaccacttgaaaaataaataatttctaagtagtgatatgtgaccattgttagaatatccatgcaatattttaaaaaaaaataggatcttttaggtttgaatctcatggatgactctcattggtgacggatcaaaactaccacctgtcacggatgagcgtgacggtcttttatttaggtccgataaagatgattgtcatctgtgacggtggccgatccgacacatatgacatttcacaccacttacctttgttttgtgacggtacccctcaccgacataggtgagccttcccgcccgttatagatgagctatcccgtgctattaaaaaaaaagttttctagaagtgtgttgtcctcgctgtacaactaaacttaaaatctgcttctaaaaagtcaaaaaaaaaataaattgaaaatgttctggtatatgaaacactatgagtcatatagtagcacacaaaaaataaactcaaaatttgatctacacatattgaggagaaaaaaaaagataaatctcttgtgaatagtaatgtgaactatttgaaaatcttctttcttctggtttacataaaatttgagatgatttttagtgtggtacatatatgtaatagtgtttcgcatctgagaatgttttttcaccattttttgtggctttttggggtgcgcaccttttaaatttggtagatataccacagcactgtttgggttctctcgatcaacctcaccctcccgttgagcacacgtacgatttgcagaaagtgtttcgaaatggccctctacattgtttgccttcacacgcaaataacttccatcgcagctttcgtgcttgactacgggtgtgttttagttcatttcaaaattagaactttggttgaaatttaaatgatgtgatagaaaagttgaaaatttgtgtgtgtagaaaagttttgatgtgatggaaaagttggaagtttgaagaaatattttgcaactaaatattttgaagaaataacttcatttcacaagttagggcatgtttaggtcatgcatgaaaattttggcgtgtcacatcggatatacacatatatatttgaaatattaaacatggactaataacaaaacaaattacagattccgcctagaaactgcgaggtgaatttattaagcccaaataatctgtcattagcaaatactgtagcatcacgttgttaaatcatggcacaattgcttaaaagattcgtttcgcaatttacacgcaatttgtgtaattagtttttttttccatatttaatactctatacatgtgttcaaatattcgatgtgacatattaaaaaattattg

SEQ ID NO: 57740 - DNA, 6484 bp, Oryza sativa
  unsure (1)..(6484): unsure at all n locations
ctgtggactgattgcacctacgagatggcacagnagttcatcattttagacgcaacgtcttttcccaagctttctcctcaatatcaagagatgttgttaactccttaacgaagtactctgtctattgcttttaactacattacccgaacttctatatgaagaaggtagctttacaataaaacgcacatccacaaataattcacttgtagttcaacgagacaattttaaattgatggtaaaacaacagatgtatatactacttagctagctatagcgataagtacttggaagagagaattccttatatactattggaatttggcctgatccctgatatgccacacaaaattggctcttcccttatatgccattgggtcaaatttgagcaccctcttatgtcacttccatgagttgaccgtgttgactgttaacttgatagtaaaaagacgtatttacccctgagttgttagacatgcagtaccaatatatgacatttttttttaatttggttgacatgtacatgtatatacaacatttcagcatgcattacattgaatatatgaataaatttcagcattatattgattatatgaataattttcagcattatattcattatatgaatactgtatatacaagatttcctgtgttgccacaatctagggttttctatcattgatgaggagaaatattgggcttggccatttgggccatattctcaagtttgggccagaggttattttggtcatttatgcaaaaaaaaaaaaactgacagatcaataggtgctaacatcagtcaacacacggtcaactcacgagagtggcaagaaggtgctcaaatttgactcaattgcatataagggaagagccaattttgtatggcatattagggatcataccaaattccaatggcatataagggattctctctacttgaaaatagatttgaaatagatagagtagttcatttttgccatggaaatattgaccgtcactcgcctattgacctctttcttaaatcatcaactccctgcagcaaagagagcaggatcatatatatcaatatttgacgtatcattggatatatatagatgagaacatatcatatacacctaatcttctagtgcatactctgtacacatcaattagcaaatgtcatgtaaaatgccgtcatctcctgcacccgggctgttaattgccttgcgtgaggccctcagatcccgctgggttctttcctgatgaaagggtgttagtgcattacggtccggattggttgctgttaattctagacagaatgaatgacgacgagcggctccagtttctcctgctcatttggcgtgcatcatggcacctgaggaatgatagtctgttcggctcaggtaagagtccaatccaagcttcggtggtctttctgcagggtctgtgggagtctgttgttcagatcagaagcaatggagctgtggatagtaaaggtaaacggcctgccctgatacacaacagtacattccaagggaaatagatctgtgcaagcagtctgaaaccaaatggcaggctcctccgtcgggttgggccaaaataaacgtcgatggagccttcgtttcacagaccagcaaaggtagtgtggggattgttattcgagaccatgaatgcaatgtccttctctctgcttggagcgtcatgagatattgcacgtcggcagaggaagtggaagctacagcttgccgtgacgtgatggtgttaattaagctggcgaatgaatggatcaagatgccgctgatcctcgaaacggactgtgcaaatgttagcagtgtcctgaaggcgacagaagaagatagatcccagctctggaatatttttcaggaagcaagattagctttagctttgtctcacaagtatcagattgtctccgtaccaattcgtccacggtatggcgtgcccaggccccagggagtgtgtctgagctgctggctctggattgtaatcatgttaacttgaattaataaagctccctgttttccttgaaaaaaaaaagtattacacctatgtgaaatcttatcttcaaatccattatattttagccataacaagaaaaagacaaaaattgtaatagatatttaccttaaaactgtcatattttttgactttttttacgactaaaatataacgaatttgaatatgaaactttgtaaatatgtgtaatcctattaggagtaaatgtccattttttaaagaatttttcgtgacatttgctagttaatgtgcacggagtgtgcacgagatgtttgtgtacataggatatgtactctatgggcctgttcattttgatgtcattttcaaccttaccaaattttggtaaagttgccaaaaaagtggctacatttagtttactaccaaattttggtaactatataagaaatcctgtcaaaattttggccaaaattttggcaactataccaaaatttggcaatgccaaaatttggtaaggttttttttggcatcaaactgaacaggccctatattgattgactggtagtcgtgtacttcacgcgtatgatttccaactgttaaatggtaatgttttttttgtttttttaagaaagttttttaaaaaataatattaaattattttttaaacttttaaagctaatacttaattaatcatacattaattagtagctttgttttgtgtgcctacggaaaacttcccatcaccacctacccaacacaccctttgtgtatactttaaaatagagagagaagatccaacaatgcgatctataaatagccccatccaaagaaagccaacccaaccggccgtttgctgagcacacggttcacctacacatggagggagtacagctactactccctgtggcacaaggggcgaacccttgcattgcacttgttactgccggcatggccgtgttagcaactgcctgctggttggtgatccgtttggtctttgtgaaagggaacaccgatcgtcgcccatgcgaagcagacgggatgaggatggtgccggggtccaggggcctccctatcatcggcgagacgctcgagttcctcgccctgagcccctcccttcagatccccgccttcttccaacgccgttttgatatgtaataaatctatatctatctatatctatatctatacctaattaaaaaataagtaacgcttccggttaattttttcgtccatcattaagagtgggcccacacgctaatccacgatccgaaagcgtggccacgatctcttacgcctgcaaataaaggagaaaagaaaaataaaaagagaaaaccttgtttatggagcagcccatccaaagcagcccagattggattagtgacgaggcagcccatccaaagcagctgcagaccggcccagatagcagccgcagcctaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaatgaattatttaccgacaaaataaattcttttttaaaaataaaaataatcacatgtgtctttctttttttttggaaaaaggaatcaccaacaaattgaatcatgtttatatttggatttttttcgctcatcaattgctcattcgccacaggacacctaatcacatcacttttttttattcattgtataatttcttctattatttagagtgaaagttattctgcgatataccacatttttttctttccttctgattatttaagtgagtggttatgcaattggagtgcagtgaggttgatatgatagctagcaaaaaaatatttcttatattatggctactctttacaatatgaaaaaaagtgcttatcaatatcgagtaccaaaaaaaataacaaagtactgcaattgactcataataatacatgacaaaaaagtaaatattttttgtggtttcaaagtttagtatccatgtcagtggatttagagcaacaaataattatatcatgttagcgtcttatttgcactagaaagattcgattcgactataaagaccccaatgaacctggtgggttttatactcccacacactaattactatttttttcttcccccaatgcaacgcatgggcattttgctagtaaaggaaaacaggtagcacggtatatttataaacgaaaaatattttttgataaatcttttatatatgtgttcttatcaatttaaaagtaaaggctgaaaaatgaactttgataaaaaaaacacctcaatatcaactacaaatttaagcttgaaattcaaattttgggtaataaaaataagcgaaaagatgaggctctaaatatagctatacatgtgtactccattcaaaaatctcaggtgtactttttatcaagattaatgagaaattaacttaccacgtatgtaatgaaaaccaatgattttatggatctacataaccaacgcagatatataaggtgtcataaatgctcgagtggattgataagccttataccgattttaattttgaaccaacaaatatgaggcgttacatattttgtgttctgtactagtgaggacctacggctcaatctgtaattttggtgcaaaataatgaaccatgagatacaatggagtcaccctatccgaaataatccatttttatcccttttatgctagggaaaaatcgttgttccatctattaagggcatcaccaatgtatatggcaaagtgtagtttttacctatggcaatcttcacaatgtatatggatacaaggtatcattaggagaagagagaagagtagagatatataatataatttatttcatatgggtagtccatatccatatggataccttttgttattttttctatatggactagttgcacaatggcaataggtggctgaatggaatattctattgcttatggactacttttacaacacattgtggatacccttagtacgttttatgtcagtaactgactcgatacatcccaaactataaatttttaacatttctataagtgattaagaataaagtgaaaaccaatatgagaaaattaaatgaggggtgtttatattttggtaatgttggattaatttaaatgaaggtgtggtgggagatggatggagtagcttaaattaatgtgggaatttctaaatattttttggaatttatagatttttattttaaaattgggatatgagagcctactatatatataaatattactaaagacaggttaataaggggcatcatatatcactcaacaataccatataatatacaatccctcagtttcaatttagttgccattcgagcattcaattttgtttttcaaaaataattattgttctgatcttcctacccttcataaaaatagtcatacttcctcataacgagttttaaaacatgcttttgggaaagataatgagtacggagtatatagttaatcagggtagcagcgtgtgtaatccaagatggcaggaatgtaatttgctgaacctatctcctaattaatttagtgattgctagaacgataattaaattgaaacagagagagtaatccaaaacatatgcatattaacatccaaatacgctactttctggtatggtccacttttcaaaactaacatgattatggaagacctgattgtttccctcgatccggaggtgaccaactttgtgttccaacaagaagaaaggcttttccagatgtggtatccggactcgttcatcaggatcattggcaccgacagtctgatcaggacacacgggttgttacacaggcatatcaagaacctggccctccggcttttcggccctgaaaatctcaggcgagaaattatccatgatgtgcagaaaacggtggaggctagcctttcctcatggcttaatcagccaagcatcgagctcaaggaggcagtctcaagcgtatgtttgatctgttaatcctaaaatactactacttcaatgtttgaaaatatggtgctgctcattttatttggtcaaaaatttaaaaattgaactatcaacgcctctcaaaatacatagattatttctatagtatattttatttataagtaattttagaatattataattttgtaacatattatcattatattctaatagaaaattaacagtcccaattacaccaaagattcaacagggtgatatatatatagagagagagataactacaaaggtaattatttagctaatacagaacaactcacctcatctataattacctcagcggaaaaaaaatcaaaatcctagctataaagctacctagataagaatatttgcagatccaataccatgatttgatttattttggagacccgaggtatattcaattcaaggtttaatttcacctactatttatttggggatgatattccaggggttccggcaaggatgttaat

SEQ ID NO: 57741 - DNA, 2107 bp, Oryza sativa
acatgttgtttccctccgacatactagctcactggatacgatttttgagtactttatactaagcattccatcttaccattaaagagggaaagcataaagtgtttaccttatcaacttaccctgaacttaccatataaaggacagggaaatgaaacccctaatctttggatccctagatcttctttttggcggcgcacatgtgctccccctgtggatgatcacttttggctcgtgccattgccaggggtttaggctagctactttgggctagagattcctaggtcacaagtcacaacccacaccgtccacatggcaaaaactataatcatcacggcacaattctgcatagactagaggatgatcattcctggtacgttgcagtgttgctgaaagattttgtgtcgtgtgcaatggatctgtgctctaccacactcttggagaaatgcaggattacctaactggcagaggaggagttaccatgtaccgataggaagaccgataactgcggtaatcgcgcggttaccacagtgaagtgataaaacgaagcggaattgataaaaaaattgaattgttatttaaatttctttaattaaattggtagcgttgtggggcacttgtttttaccagtaacggacggtaaggcagaccctatagataaatgatgttggacaactaatataaaaaaaagtctctattgatattttcatagattagagtcattactttcagtcatgtaaaattccatttaaattttgttgcatggcttggtcagacataggcacttttttattagattttcagcggcatgtgaaacgagttaagccattagcacatgattaaatcgatttctaccttagaatgtatttatttatttattgattagaatggatttatttattgattgattaaacttattgtcagtatcatgagtatgggatgcctaatatattaagcttagcgggacgcaccatataccaagctttatacaaaatttaacctcatatacaaaatggtttcggataagaaaagataaatagagttctagttggacaccacaatgtctactcgaattgtattcatacttgactctctaattctccttaaacaagaggacactcgagggtaaaaatacaagactctctaagaggagatgggccacaacaacataggttaaggcaaactaacacaaatcagcacaagccaagccaagcttatagcgccacagaagccatggcaataaaagacatctccaatctctccaagttcatatttgagtaagtcgaccatcactaaccatcgacgggccaccgctaagccaacaacggagctacaacgggatcacccaaaaccctatcctaacaaccaacacttactacactctatccacatctttgagatttagggagagagagtgagggagaaggatggaaccgctctcctgtaggctccccgacatggccaacttttataagttagggcgccgacacaagatgaccgaaatctagagcgagcttgcaccgcttgtcagggaggtttcaataagggggttgctagacgacatctccagagagaggagcgacgaaagcactgtcgtcgccgtttgtcgaggtctcaaggagatcgagactgggttttcacccggcaaccccactagaggagatgagatcacatccctcaaaagggaaatgacgtttggaaacatcatcgttgccggcccagtcgagactggtctaggttttcacccgctgtttgtatatctgcagctgatgtactattgctccaccacggttagccctcgttggcgcatgggcaaggctgcaccggtgccccccgccggctagcctccgcatgccttcatgcggccaccctcatgtcgaccactggatctagccaaggggtgacctcctgcacgactgggttgaccccaagcctctgcagcagccgcttcaccacgtggataagcagcacccgcgcctctcgagcactagcaccgggctctccacatagccctcagcaccttcgccgcttcctgctgttgctgttgtcgttgcgctgccaccgctgcgaccccaccacctacatccttctctttggcggcgccgcgtgt

SEQ ID NO: 57742 - DNA, 4791 bp, Oryza sativa
ctgtcacctaaaggctcaattaccctcttatatgcattcctaaacatctgcacagtgtagtacctatcaacaaaatcttcaatgtgcacatctctgctttgctgtgaagtaatcaaggccagtgcatgctggcagggcttccctgtatgctgccactcctcacaagagcaatattgcaggcatgctttcacaatgtacttcccatgtatgctgctgttatcaacaacttcagcagtgaaactatcagctttaacaactgagaggtgacctaatccccttgtcattgctaccagttgcttgttgacagcaggtaaaattttccctgtcatcctctctgctatcctccttctcttattccatagcaccatcactttttctctatacttgtcagctaactcacagacaggcaggtccttataatccttaatccagttattgaagctctctgcaaggttgttggtgacataatcacacttgatttcagggttgaatgcacttctcatccacattaaaggatggtaggtctcaagccactctagcacaccaggacatgatattacatgtttcatgtgttcttgccacactgttttcctataggttctagcagttgggtacatatgggagtggccatcactaccaaatcttttaacaaaatttttcattaggtgccaaaaacactccctctgctcagctttttcaaatacattatgcacagctttctctagccctttacatgcatcagtacaaattgctaagggatcaacatctcctatagctgtcttcaattgttccatgaaccatacccagttatcctcagtctcagcatctatgaaaccaaatgctaaggggtacatctaattgtgtccatctatacctgttgcagcagccatatgaccattccaacttccattgagagcagtggaatctatactaatatatggtctgcaaccctccaagaaaccatctatgcaaggcttaagggcacaaaaaaattctgtggaagtgcacatggccatcaacctccttggtgccaatctctacaacactaccaggacaagtccttaagacctgtgctctccacctatacaacatgtggaagctttcttcccatgacccatacaactctaacaaagccctctgtctacccttgcaaactgtgtcatacttaattgtacacttgtgatcttcttgcaaccttatcatcaagcttttagggcccatacctggattagtctttaagatcttcacagcctttgaagcaacccatttggtagttggtgtagtggtcctccttctgctgctagatgtacaggtatgaaaatctgttaacacagtcacctgccaattaattgaacaaatacattataaaccaaaccataaaagtaatataaataacaaaattcaaattaaccttaattgtcttcaagtcagcctgcctacttccaacaatatgccaaacacaaccatccactttacaacctcctatatatcttgttgggtcagtcttcaccacatccaattcaaattcgttgttaatagcaaactgtctcattgccaatctaaactcctccatgctggggtatgcagttccaagatccatgcaagggttgtcagggtcatatgccatcacattttcaccaggaattgaatcatccactggaagtgcagcatccatgtcatctgggcctcctactccagcaacattgacatcagggtctcctccttcaacattttgagctgcatttggggctgcttctccaccagcagcctgcctattcctatcagcttgctcatcctcagccctcaatcccaacaactcataaaacttgtcatcatccactatttctagcctcccttcttcctcattctgggccaaaacctctaggctatcccaatccacagcaggaggtgcatcaacagctggcccatgaggtggcgctggttcgacaactccatcagatgcgacatagaaaatggtttcaactcctgcatcagcatctaccgctcccgcatcaccaactacaacatctaaactacgttcaggctcctcctcgagcctggtaagatagaaaaaaatacgcaagttaaatgatgcgcaaactacaacgaactcgcccacactcgcaacatcaacaacattcaaatcgccaaaggtttgagaatggattcacttatccggcgacgagttcatgccaagtacactccatattcgccaccctcaccaccccgggatgcagtgcgacggcggcgcctacatgcggtgtgtcgacggtgagctccttccgcgacgagccgtcttcatgaccagatcgatttcttcgccgacgagcagacaggatggagcggcggaggaagagagagacggccaagaacccacctctggatctcaatcccctttctacccgaccgcaggggcaatttcgtcaggtcaactcgcatagaagggaaaatcatttcgaaaatgagcaaaaggaggaaaatggcaaagtggcgagtgcggcgcgcttcatcctggcattttagcgaatcccgttttcgggatggcattctggcgaagcccagttttgaacgtggcttaatgtccattttctcatttacccgccaaacagctcaaagaaacccaaccattcgcgcgctttctgaaacaccccgcgaggccgcgacctttcgtcttcccctttcaccgcgaagagcaatccgccgcgagcacgatccgctgcttccgcggccaccgtcgccaccaccgccggcgttcgtggcaatggcgaggcctactgaatcctctgcctccatcgctagcggcgggctcgccgcaccggctcccccaaccaatcctcgcaacgctatccccgctgcgaacccggcggcgaatcccatctccggcgcggctcactccgctccggcgaacgctcctcacccgcgaccgagtgtcagtcccgccgccgccgcctctccccaggtggtccgaggtcgacgaggagaggatcctcgagatcctctgcgaccacctccgccgccacgacgacctgccgcaaggcgtcgacctcctcatggccgtctacggcctcctcactcgtacggactacagcctcgcggagctcgaggggctcgtcaccgtgctccggcggcgtttcgaggagaacgacgcggtgctctgcagcgggagcggcggccctgctccggggcaccagctccggctctacaccctctccctcgaggtgtggggcgccgctccgacggccgtcgcgccgcccaaacccgccgccgcggccacacccaccacggcgcccgccaagaacgcgccggggacaagctatccggcccggcaggcgggccgcccccgccaagcggcggcgccgccggctaagaaggtgcggtacgaggagatgcgcgtgcagtacccgaggctggcggcgaaggtggacgagatggcgaggaaggcactcgagggcgtcagcgacatgacggcgtggtcgctggagctgaggctgcagaaccagcagctcgccggtggcacgccggaggcgcgcaccgatgaccgggcgaaggagctgacaggcttgatctcaaccctgatttgatttgagactcatcgaatctcttgcttgctactgttagaactccagtttcgtggcgtcaatggtgtcagacatgtgctgctgatgttcatgtgggatttgttcttgattagaacagtactgcctacatcattttgcaatgtcattttcttttgttgtgtttccttgttgtcccgtcctgaactcagtcttttcatcagatatctcttttttctctaatcctctgcctgccaaatattgtcattgttttcacaggcataatttacactacgattgtacgacacaaggttttaggtgtattgtatcatcagatatttttactaaatcagatatttgtcaggttttgttttgtttttttgtttttctgtatataactcttcttttttaatatatataactactgggcaaagccctggtagtaatttgcataaaaaaaattctcttggatttcattctttgttatcatttcactcatttccaagaatgctaacttccactagttccgacaatacctttgtatttcgctttggtagattggcactttgatgtaaccctgtattggtaactgtcgaccagaatggtcagaaaacacgttgagagtttggacatctttttaaatattttgtcacagatgaccccatgtattctggataaatcataacatttctcacggattatagcatttggttagtcttacattaactgatgtaataaataggccgtaaaactgaagttctttatttcttggtgtgaatggcaaagcgttttaattatcaggttaattcacaataatctttttcaggttaattctccacatctagatttgatacggcgtggttattagaaagcttctgtgggttggatgctaaacaaattgaccatttcttggattttgttagggcatgcccaagtcttctttttttttttctcagattcaagttatagcaattgctatggtttggatgataaaaacaactagtcaattgttggatttataaaaacatacccaatttattatttttttgatgggaacatacccaaattattgaaaataaattgtccaagacctagaaaatataggacttagttaaatttttagctgatcctaagcattgcaaaaattttgatcttacataggaccgaaagttcggatatgtcgaaataattttgtctgaaatctctagtacagaaaccgccaaaggtgccagttgga

SEQ ID NO: 57743 - DNA, 948 bp, Oryza sativa
caggcgggagcccgctgcctccccactagctcccctggcgccggatctagcggaggggagctcgccgcctcccctcctgccggatctggcggaggggagggtgtggccgccgccgccgccgccacctcagccagccagccgccggtcatgggaggggagcccaccgcctccccactgcctccccgccgccgccgcctctgccagccagccaccagccatgggaggggtgcccgccgccgccgccgccgccacctctgccagcctgcgcccggccatgggaggggagcgacgcgagagagagggagggagagcgatgcgagagagagagaggggagggagagtcggagagagaaacacgagaagggatgtgatcgatgtgtagataaggaccgtgtggtgtggacgactagataaggacgttcggtgggtgtggaccgtgtggtgctgctgagtcgctgatggctcggctcgtcggctcggcttaagctataggtgccggttaaaaaaccggcacctataatatatatgtgccggttttttcgctagaaccgacacctatagtgtttaaaggtgtcggttctatatttttccatcacagggaggtgggaaattgtctattggtgctggttttaaaccgacatctatgagccgatccctacgagggattttgctaagttaacaaaaagtaggaagatctggagaatagtttcctattggggtgtgggtgtgtgtgtgggtggggtggtgttccgcaattttggacccttctgagaaatagcaaaaatcttgaatgaaatggatgaacgtgatgacaaattgaatttaagtggcctcaaaacgaaaaactgaattgtacatgagaattatattaccattcaaaaactctttacacaagtacctggaaatggaatctcagacttggatacatgaagcttatgtcacttcttt

SEQ ID NO: 57744 - DNA, 1439 bp, Oryza sativa
gttactaatatacagagtagtggtggtaactgcaaaggtcccataaaatcattgcagcaaatgatcaaatcacatctgctttccacacaaagcacctacctagattaagatcaagtttaataaataatgataaaggataacaacatggagaaaacattaccatcaatttcatacttttcgcttcctttaactgccttcaatgcacttgatctttcagcaaaatgaacaaacccaaaatctctcttattcccagccttagcaggcggtaaaacgacttttgtgacctctccatgaatttcaaagatctccttaatcttctctttagaagcattctctggtaagttcttcacatatatagtcttcacctgtaaaagaaaaggccaatcagacaaatgttcctagggctcaacaaaacaaaattatatgacatttccaagctaattatctctatgaatataaaaaaatcaacaagctaagggtgccttgtacgaataggacaatccatccataacagaaacaaccttgcacaggttgagccagcgggcagtggtattgaatgagtagaataacttccaagtcaaacactcaatctaactagtatttcagattgctttaatctacatacaacaaagtgtcagattgctttaatctacatacaacaaagtgttgtcagttatacaatccttaaagtgccatgtagaaactaaaatcatgatgcagctgcatcctggaaatacatcaataaaatgatggttattttggttcaacaatggtaatcagtagttccagataacaaaaactaatgtgaatgagaaatgattaacataagaattacaaaatatttcatgtttctttgatcatttgccagttcctttagcaaattatggcacaaaagaaacaaatccaattcctcttttacaagtgagttaccccaataaaatagcaatataaacagttttttttcccaagggaccctagttcaatttgcagagctgcagtgcatccgttgagcatagaaagcgctgacttttcatttacagtgtatacctgggcagctgcagaagaagaatctgatgatgatgaacccttaggttcagcccagctgacggtcaactggctaccatcaaccttaaagtttggtgctgacaatttctgcttggcatagtctgcacaagcatggttataatactcaacaaagaggaacccacggttacggcttggatcatgtaaatcctgcaggaccaaaacaaggtctcaattagcaaattcggggccttcttagtgcaaagtacaaccatgaaatcacagacacgccttgaacatctcaatgttcacaacacctgggcccttcccctggattatgtttctcagctcgtcctcactcaaccccttgggtacattgccaacaaatagcctgtgctttgcctgtgacaatgagc

SEQ ID NO: 57745 - DNA, 1786 bp, Oryza sativa
aaatattttatatttctatacattggcccgtttggcttatctcaaactcctaaatttaacttcaggagttggatctagagtggagttgtggagtagcccgaaaccagctcctcttctctagtttattttacaaaagcactctagttagctccgatccctttttgtgtaaagctgaaactgtttggttgggctccagctccaagatgagctggagcgagagatagagaaagaggtggtgacgtgccaaacaggcccacacaccagcaaaaatgcccgtgcattacaatgtatcaagtcaacccttcgctcattcatcttctcatacattgcaacaagaaaaactaatattataataaaaatcacatgattaggttatgatatcgatgtcaatatagttttgaagatgatgcggtgaatttgtttggacaatggattaaattcctgcctttacttcaaataagctacaaccacttattataaaattctttcaaagagagcaaacatgcagaccacttcatagcgacgggcgtgtccagcaagaacagatccaatatacatcgtcaccacggagaccaacaccatgtaaacttctcacagcatgactgccagcaggcaccacatgtaggcgtaagcgttaacgaaggaacgttaacatagagatcaaactaagaaggcaggtagatcgccactacccaccttgcagcacgggatgacttattgttgacttccccgaccatgatgggcgttgaacggttggagtccgatgaccattattggtggcactagcattatactccctctaatgttttaacttttttctaagttaaacttctgtatatttgatcaaatctatgaaaaaatatagtaacattttcaatacaaaataaaccaatttaataaaaccaattatattcaatgctagatttaataaaagcattttggtgttgtaggtgttgctatatttcgttataaatttaattaaaattaaataagcttaacataggaaaaaaaatcaaagtgtataatatggtacagcagcagccgccgcagtctccgtgcatcttcatatgtgatttcctttgccttcaacggagggcggcccgaggggtggcgaagatggatgtgaagtgtcactcgaactcctagaagtggtaagagtcgaagcgctagaacatatgcgcaagtatatagtgggtacttcggtgacctaccacaaaaagcttcgaatcgtttaagcctaattgtgccataatttgacaatgtggtgctacagtaaatatttgctaatgatggattaattaggcttaataaattcgtctcgcagttttctggcggaatctgtaatttgttttgttattagactacgtttaatacttcaaatatatgtccgtatatccgattcgacaaccaaacccaaaatttttcccttatttggggctgatggatggtgtactctagtgatgtacaggatccggcatgcaatttggatgaactacagttattacattcaagaatcaagatggaaattgctgttctttttccgaatacatcgcaccatgtcgtctgaagaagctgatgcttgttcagtcttacagccacttgtttaatgcttcagttcagtaaaagaatactgacctcctaactaacttgatcttaagggtcaacactttccagatttccagttaattagatcatctgatctttacaaaataagtacttactccctccgtattttaatgtatgacgccgttgactttttgattaacgtttgaccattcgtcttatt

SEQ ID NO: 57746 - DNA, 594 bp, Oryza sativa
attcctggacgaggattttatgcacaaataagttcggttaattactagtgaatttccgggcgtgacattatgtcgtgggcttagcctaaggggatgtgtgccctagggcaaccctaggatgtccctaatcatatttattcagtagctgtcatagtttagagtcgagttttgtttagattgatctgtcaagaacagttttgccgctaaatcagtttgtgaaaccccaaattcgagtgcttaatcattcatatgctattgtgttgcaatctatcttgtttttacttgtgttcttcaatttgtatacaggaattagccttctcggcgaggtcaaccgggttttggcacggctgataaccagaggagacgttgtgctgcgattgcggggctcaagagcgtgttcgttcagaagccggatcgagttgtgtcacaacaccactaaatcgactgtttatcaatacctatcagaagatcgggacctaacatcctcatcagttggtatcaaagcgccagattgatcattaggtaatttatctacccataaccagacaattgccacacaaaaatattgcatccattacctagccaatttgagtt

SEQ ID NO: 57747 - DNA, 704 bp, Oryza sativa
atcacatcaaatgtttagacacacatatatagagtattgaatggtacactttatactcaaactgaaaatcaacagtactgaaatttcagacaggtatatatggctcttcctaccatgtgccttgtatttatagacatcaggctgcagtcataataagtaaagactacatgataagaacactactacaaatatagtactactctggaaaacctctatattaaataacaagaattgagcatttctgatagtgctacattctatgggggcgctttttaactagcagcctctgggtattgggacagcttacagatacaacagtgccacaaatctgcattccccgttaccttctgtttgtgaccaaaggggtacacatggacaaggcacaaggccggaacaagggctctccgtgaactgtgtgaatggggaaattgggaaaaaggagccaggcagcagcagtacattccgagccgcagaattgcaacgaagcaaaactgattccgaagcaaaactgatggccaaaccatgcctagagtatcctgaccatcgagagaggccattggaggcttcttgtcgaggatcactcgccatctccgttgccaaaaactccgacgcgctgcctcctcttatcgaaaactgccctgaaggattcaccttcgtcacgaagttgttcgctgaatcgcttctttgtatcggtgttgattacc

SEQ ID NO: 57748 - DNA, 675 bp, Oryza sativa
ccgcgatgggtgaaggggcgcagtgacgatggccgacggcgcgggacgtgatcgctccggcctcgagccggggaagaggaggaagacgtgcgcccggagtccacgtcacgcgtcctcgctcgtgccgactcctccgacacgcgcgacgacgaacggcgacggcgaacagggcagggctgcaatggcgcggcggctaacagggcagggctgcaatggcgcggcggctcggagcgaaacagggggatcgagcaagagggggaggggcggcttttatggggtggttatgtcggtttgggaggagaggaaattgacctcgagtggcactaggcgagggagcttcgaggggaagggatgggctcacgggcgcggggtcaaacggcatgggcgatggctggcgcggctgctcctctgcgtccatggcgcgggaaccgagcggtggcgcagtgggagggcgaggcgtcggtctgggagaggaaagcgggaaatggagggggagaaagagagctcgagccatgtcgatttggggagggagagagatgggagcgagaggcgctgcctcccgattttggacggacgcgggcggcgcggctcgggcacgcgcgctggcttgcggggccgagcggcagcgcggccacgggcacggcagggcagcggggcttaggcgcggcacgggcg

SEQ ID NO: 57749 - DNA, 14076 bp, Oryza sativa
gactttggcaggggaatttgatttgggaaggatttgaattcggaatttgaatttggcgatagatcggggattttagatccggaatggcacggagacttgacaacacacaaagagacgaatttcgcaatagggtttttagaatttaatttttcccgctaggcgccacgacggaacgggcgctgcacatcgcgccgtcgaccttctctacggcgggagggctcgggcgtctccgcctccctcaccgatgatgttaccgatgccacggatggggtcaaagatggcggcggtggccgatatggtcgaagacaaaggtggcaatggcggtggctcccaagccctcccgccatgaaggaggtagatgacagcccatcatgatagtctccctcaccgtcgtcaatctcctctgcggtgggagggttcgggcgccttcgcttccctcgccgatgatgtcaccgatgccgcggatggggtcaaagacggtggcggaggtctatggggtcgaagacaacggtggcgacaatggtggttcccgaaccctcctgtcgtgaaggaggtcgaaagacagcccgccacaaaggaggtcgatggtggtgtgacggcggtggcttccgagccctctcgccatggaggttgacgacggctgcggcagtggctcccaagccctcacgccatggatgggatcgacgatggtggcggctccaagccctcccagtggtggaggatgatgaccatcggagatagagtgaatagaggcaagggaaagaggtgaagaaaatggaactgatagttaagtcccatatacagttggggttaacggagatttttgacagaaaacgtgatggagtggcatggttctaattttccgaaatcccagtggcacgcagctgatatcataaatagtagtgacattttttttaatcagcatatttgtagtggcatggatcaccatgaagcgtgatcagctggacacctgggccaatcaacaggcggcccaagtagggtatgggagggtggggcgatgcgggctgtagctgggccagttgacccaccatgcccattgagcgctgctatacatacgaacttctgtttacgatggttgtacgatgaaactttgcactacgtggcgctggcgatgacgacgacatgcatcagaacgaggcaagtccacgttagccgtccgtttgatcgtaggaagatcgtactcaaaatgtcgtacgtatagtaattttcatgtccaatgggtggttccgccactggatccaattaacccaaatttaaaagtcaagattcaaaagacataaacaaagcccatatcgagaaaaggtcctcttcaccacatgcacaggtacgcaaccatgcaaaagcaggctgaaaaaaaaaagcatgaatgctaattcgtgtatacgcacgacaagcgccgagttagggttagggttttagagggatggcctagggaggcggtgggtggcggcgacgccgaagcggcgaggtcagcagcaggtggtgggccagtgttggtggcaggggcaaaacgaggtgaagaggagggctggtgttttcctcgttttccgtcggttgccgatgcctgaagaattcaagagaaaataactgaatatacctcctcaagactcaaagttaagatcatatggtagactagtcttatgatatgtatctgaagttctgaacttcttcttgacagagttctgatttctgaacctctgaagtctgaacacttgtatgaaatgatccaccggtgatgttcttttcagacttgatagttggaagtagctggctgcaaacctgtgtcatacgtagtctgaaactgaaagaaaggcaatcacatactcacacgtagtctgaacttctgatcgattatgcgaaatgaaggtaactggggaagttcaatgtcagtctgaactctgaaccaaagcaaagtaaatcatgtggaagatggataatgatatttcacactcaccactacaaatgatctcgcacacaacaggtaaaaatgaaccaagaatcacagatatgcacagctacattcaatcctatatgcaagcgtataatatatcaatggtgtgcaaataccagaagctatggtagtttactctgcaaaacgattgtaagtaccccctccgtttttgaagatgacactttgacttttgaacattcatcttactaaaaatattacataaatatcacttatttagttgtgtttcggtttatgagtaatcacactttaagtatgacttatatttttcatatttgcacattttctttagtttggacaaatggtcaaacatgtgtccaaaaatcaatggaatcatctattataaaccaaagtaaagtacattttatccaaaaaaaaaattggtagtctactttcatcgcattttcagatttgcctgaacattcattgaggaacctgatcagtaaccaggcaggcagcaagctggtgaagtttcagtattctagtttgatttcaccacaacatgagagctagttactattcagagcgaaatgaagtactagaaagtaacatcaatacttggctgaaatataggaacatgtacattgactgatggtcagacacataagtacattaatgttatgtatcataaatacataattcaaacttgagaagaatacatattcttcttagtttcttcagacagcaaagcaatagatcagcattgtagatcagtttcaccagaaagcgtgaaattcaacagaaattagtcatgattatgaaacatgaatacttttctaacataattgggcgcgccctgtacagaaactcagatacatatcataatgctagatgactctatcatgagatatcttcactcttaatttctaagattagtccttttttgtgggagttcttttccttcaattcttgtgtagaaaaacatcaggaacagcagctgggtcgagctcatagcagtcatggagctttccacctttctcttttgtgagacaaaacgatggtattcgatgagaaaacctcaggttctctttcacaggaatcttcagaattccccttcgtacatcaggcttgaacacagagatgtaaccatcaactttagtcagataaccaaataatgtgaaagcttcagtggagtcgacgatcttgccaatagcatacttagtaccacgagtgctgcgggaaggaacccacttatttgaccagttcttgtagatggcccagacctcacctatctttggatgaatttgaaccttgcactttgctccaatttgtttggtttctattaaatgggagaatgcacaattttcattaaactttgtttccatgttttggatttcaaatgtaccacagctcacaggtacatcatgctccaaccacagcttctcctgcgctcgttgagggcaagcctcaagccaggccaaatccacgttgaacggttccatctcaactttgcttacccaaccatagaagttgggaaatttatcagtatcactgtaaagagcccaaatctggccagcttcaaacttatcatgcgagcggtcttgttcgaagttgtagaattctgaatcagggcatacataactgattaattcgatatttgttttgttgtcaagagccatgtaggattcaagagtaatggaagtaaatgccgaatccaagtcacttggaagagctgcagtgtctagttccaggaacccttctgcaacacctaccctttcatttccgttcgttttatagaaggggatactgtgagaaaaatgaagtacctcacatgatgatatcgaaaaacatgactcgttcttcactttcgcaaatagactgacaaaccctgcaatcctgaccagcggtgaaaccgtgacaccatcatccattgagccactagaaaggacttgcacaatatcatacccatatgattgatatctatctgcatgagagctcaactgcatgctccatcctttataaagagcccacacctcacccatgttaggatttatatcacaggagttcccatttttgcctgtcgatgaaacactgtgggataagtaccttgatggattgtgcaatacatctgtttctcctaagcagaagttcccacaagcaaatggcagtttttcattggtcgatttggaattttgttcatttactgtgttgtgcaccagccaagtgaactgcactttgaggttggaaggatcgacatgatttattcaggcataagctctaggcatgcaatcatgaccttaatatactgcccagatctgatcaaccgcaatttgggacacatctctggacttgtcaaaatcaaagaagtctgtagaagagtaggcaatcacaggattggcagaattctgagaagaagtatcagtatcatctttcctatgactttgttgattgtctccatgtttttcatttccttcctcttcactgtccacttcggtggggacatgttgtttggcaaattgattctcagtaacagcaacatcatcattacatgtttgctcagtactccaatcagcatcagatggagaattatacttcattttcctctcaatattagagttcatagcacggttgctgtcagagctatcacagagctttctccgacccaatatctgaagactggatgatcctggagcatttgtctctgctgatacactttctccagtcaaattctgcacagcggtggagtttggatcaggactccttggtaccaaagttccgggtatatcgttgtcagcaggaggcacatgagatttagcttggctaatttctgaaaattgaactctgtcacttcttgtcaccaggcctttacctgccatgtcaccagcccagccatattgttttatggattcatcagtttcttcagcatctctggacttgcaaaaatcaaagtctggataagggtaggcaatcaccgaattgacagacttctgagaagcagtatcagtaacatttttcttacaagtttgttggttgcttccatgtcttgcatttctttcctcttcactgtccacttcgatgggaacattctgtccagtagattgattatcaggaacagcaacatcatcattacatatctgctcattactcgaatcagaatcggatggacaagtatacttcctttgcctcttaatattggagttcataccatggctgctgtcagaggtaacataaagctttctcttacccaatatctgaagactggatgattctgcagcattttcctctgcaggtgcactttctctagtcaaattcttaactgagatggacttaagatcagaactctttggtaccaaagttccaggcttatcattgtcaaaagcgcagatgtgagatttagtttgcttcattgctgaaaattgaatggcctcgcttcttgtaaccaagcatttaccttgttgatgctgattggggacactacttcgttgaaatgataacatttctgacgttgaaagctgagacttttttgcagcagttgataggattctcgagggaacagactgctcatgcagtttgattgcgaagaacctcttaccacaatcactgcagcgggccaaaaagttccgttggtagtacagaaatcgcttctgacaatgcggacatattgtccagaatacaagcacagaagcagatggtgtcatggatccagccacattgcttatgtttgaatcagtcttgtttggtggctgtgtagcctccttggccacttctcttgaagcacactgtcttttggtgtcatacagagacctcttcacatgatcactcaatattgcatgagcttctgaaacaaacctgaatgcggcttcggcaccaaacagagtattattatcaggatgaagccgatacgaaagtatgttgtattgccttcttattactgtttcgtctgccattttatccacctgaagaacaccataccaatccaactctccagagatctttgcctcagctgaagaaagaacttcacagataattaacagctgggagatgttctcaagctcaggaaaaagcctttgagctttaatcgcgatcttgcgggcgccgacaaagtctctattttccagcttctttacagcaatttctctggccctgaaggcctcctctctgttgcattccatcaaagtattccagaaatttgaccaagaaacccttcacatatacttgttccagaatggcattaacatgctctacctatcatgttatcaagaacaataaaatgtgagaagaactttcagtgcatcaggccctgcatgcatacaaaaggacatttttattaacagaagaaatatatatggcaaaattatgaatactctgggaaaaaaagaaatcacatttgggtatactcttgtagtcttattcacttgagaaaattgtaatttggaaaattgacatacagttccttcaaaacaaaaggcatccattttgaaatgttttttttttaaaaaaaactggatggcatctttccaaaccaccacattttgaagtggcatacatgcataaaaatctttaaaaaaattgcagaaaaagaaagaggggaaatatttcgatcctacttgatgtctactaccctagcctcctagggcacccaaatcaagagctctgcacgatcaaatctctggccattatcctcgcgaagaacacactaacccccgaaacgcaaaaccaaacctccgatccaaaaaaaaaaccctaacacgcacgcataacccggcttcagccaacctacccaagaaggggaagaccggaagaacaagggggcaatggaccgcaaatgcgtgaacggatggtacctccgagctgagctggggctggaacgtgatccgcggcggccggcgccggcgagccaccgtggtgggcggtgggcgtggttaggttcttggaggaagagcagaggcagaggtgaggtgagtgagtaggagactggtcgagttagacacgtgtcatgctgggaagtgaagtcttgagatcaaggacaggtgtctttttctaataggagtatatatttttttcattggccgtacttgtgagtatactgactgcctgcctgacgttttctatgattacttgtggatttaatagttgggtttcttctgcaataatttgtatcgtgaattcgtgatgtataattaagaaaagaaaagaatgtgactgagagaaaaaaaacgaatataattgagagaaaaaaaatgaagaactccctccgtcccaaaatataagtatttttaattttgatatagtttttgagatggtatgttaaacaacaatatctataaaagtaagatattttaaataaaaagagttgtatattatgatagtttgttgaatgataaatctaataacatcaaacttacatgattaatgtttttttgctattaataatcaaagctaaaaatgtttgacttggcactattctaaaaatgattgtattttgaaatggagggagtagtgtttactcatattcttccttatacttaacatgtatacgttatatctacgttgtaacaggctatgcccatatatgtagggataggttatagggtgatttggtataaaacattgatccgatggttatgggaggcggtgcgcacgggtcagtaccacatgtacattgtaacgggtcgggataacagaactaggaatgtgctatggggtgatttgagataaaaacattgatttggtggttgcctacattgtaacaggctatgcccatataagtagggataggttatagggtgatttgacataaaacattgatccggtggttatggaggcggtgcgcgcggttggaggataggaggacaatttcgctattaaggtagtagcaatattggaccaatataagccatctagagaaagggaattgtccatgctaaatgctaatacttatctctttcttgccgattaaataggccacgtatagtgacgagtgggtctaatggacgaatgttcacgcgcgaacacttaatttcggcccagcgcagatgtgtctagtccaacataaaaagctatttcagaaaattttgatatgcacaaacttttaattaaaaaatgaatgcaaatcgaacatataaacttctgtaataaatttacttaaaaatagaaactgtgcggtgccaaaacaataaaggaaaaaacatgtgtttggagtgtcgtctaagccgcacgcaaacatttattccctccgccccaacatataatcatttctagagtttggacacggttcttaagaaagtatgtagaattaaatagggaaatgttgtgattggatgaaatgtagaggtatgtagaaaaattaaatggtggagggttctgattagttgagaagagaatgttggtgtagaagttattatattttgggacaaattctagagactagaaattgttatattttgggacgggggggggggggggggggggggaatacatgatagtatttccggaccgcacactacacgtgctcaagaaataaagagaatgctctttgtttatgtgtagcagaaactcctatatataaaatttaatattccatatttcatttgtatagacctgtggtcattgtctgtctcactgtctgcatgaggaaactccttactgaatattgaatccactggtggagaaaccctttgtagtcccggttcgtaacccccctttagtcccggtttccaaaccgggagtaccaatccgggactaaagatcgctatctttagtcccgggtgaaataaccgggagtaaagatcaccaaccgggactaaagatggctcagccaccaaccgggactaaagatggctcagcacaccaaccgggactaaagatagagctgaccttttttttttttgcatgcccctgttgctgcatggtttatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagcttagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctcttttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgttagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccatctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagttgggttgagcgttccaccgtgagcatagtaccagaacttcgatcgttccggccaattggctgttgccggttcgatgcccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgctagtacaccgtactgacatgcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttctttattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattttccttctaggactagctcttccactcaggcttgacggacgactccgacaacacgtcttttctgcaagataaaaaaaatgtattaggataaatgcgaagtaacatatatatatatatatatacatgtatatatatatatacatgtatatatatatatacatgtatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggcggtattgcgcgcgcggcggcgaaggcggcggcggcgtggcgtcagcggcgacggcgtggcgttggcatgcggcgacggcgttgcgcggcgtcgaagacggcggcgtcgaaggcgacggatagagatcgagatcgaagagatcgaaatgcat

SEQ ID NO: 57750 - DNA, 1027 bp, Oryza sativa
cctgcagccctgtccttcaaatccaacatactaagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccatcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttatttcagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgcttgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgct

SEQ ID NO: 57751 - DNA, 27984 bp, Oryza sativa
  unsure (1)..(27984): unsure at all n locations
accaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgatcaccagttcaccaccatatggcactaacactgagacctcatcaggtagtagcactatagttttctctgtgtaaacatgaatgatgaattgcacaaaaagttagcatgaccagacgaatctatatttgggtaaattcagataaatcaggtgtttgaacagctgaaatttgggtggtaatcctccattccttctgcagaaaaacgtcaggaacaaaagcagactcgagctcatacaagtcactgaatttcaaacccttttctttttttttttgggaagggggggggggaagaaccttcggtccctcgcgtcgctctcgcgcaggcggctcgggggggtgaaaaaccctagccgcccgcgcctccactccctccccaccgcctcaccgccgccggagctcgccggcggcaaagccggcagcgagcagggaaggcggcgacgagacccttccttcctggcgactcccccctggcgcgacgtggacgggacgacgccggcgaagtccctccaccacggtcggaggtggcgacggcggcgcgatgcggggaggcagcagatccggcgcctccaaggccggatccggccaccccgcgcctggatctggtgcgacggcggcgtgaggtggctggggggcggcggcaacagctcagcggcggcgtggccggcccggtgcggcagcgtgggcgcggtggcggcggctcgacggctgggacggtggcagcctggaggcggtggcggctgggagcggcggcagcagcacgggcggcccggtgcggctgcccgggcgcggcggctgggaggcggcagctcagcgtggggccggttcgggctgcccgggctcgcacggctcggcagtgcggccgtccgaatggcagcccatggcgcggctcggcggtgcggccgcgagcccccatggcgcgggtaggcctcggcagccgggcagccagggtgccgctgcagtgccctcctcggccaggtgggctgtgcggcgcggccagatggggtgcggcgaccgggtgacggggcgccggtgggttgtgccggagccgaagcagcagtagcttcactggcgtcggctcaagcccagatggcagtgtaaagggagctggtggcggttggtcgtcttctccgttgccggtcggcaccctcgcccttcctggagctcctccccttctctgtggggagtttctgggttggattgaggcggcaactcgtcagcgggggaagcctaggctgccaaagcaatgccatccagtcccgggttctcctttcgtccaaagttggcgaggaggccggcgggtggtggaacggaggggtcctgggccagctctcaggggcggtggttgatgttggctgacggaggggcgtcagtgcagtgtggttcgatgaagtcagccgacggaggagcgttggtgcagtatggcggaagctacgtgctgccatttgtctgtgtggtggttctgagttggtggacggtgatctgcagtcaaggttgtagggtcccaggcgaaagcctagtctggtggtgcaccgggccagcagcggctacgtcttcgggcgtcgtaaccttcttggggcattgtcgaggggtaccctcttcctttcttgatgagcttctctgggtgaaaactacatcttttttagataggcgatgacggcatcctggatgtcgtgaccaccgtggtggcatcgttttcggagtcttgtctctgtggtgttgccataggcctagcggcattcggccacgcttagcgggggtcgtttggtgctaggcttcaccctcagcggtttgtgcttgggtggtagtgcgtggtgtgttgtcatgcaccttggtgcattgtgatgttttttttttataatttttactcttctttaatacattcggatggcctccttcggccttcccggcgaaaaaaaaaacccttttcttttgccagagagaacgaaggtatctgctgcgaaaacctgaggttctctttctcaggtatctccagtatctccttcccaatgtgaggcttgaacacaagctatgtccatctagtcatctactttactcagaggagaaaacagtgtgctgccttcagagcacctgatgatcttgccaatggcatactcaagacacagctactgattgtgggaggagcccaatcaggtgaaccagttcttgcagatggctcaaatctcacctacctttgggaaaaaaaataatttgccgatttgaatcgcacatggatttgcagtttccaattttaaagatgccacaactgatcatggtgtatcctgctccaaccattgcttctcctgttcgggttcagggcaaacctctagctatatcaaatgcaatctgagtggctccagctttgatttcggctatccagagatagagattggggaacttatcatggtcactgtgcagtgcccaaatttgttcatgttcaaacttatcacatgaccggacttgtggaattcagaaacaggatacacgcaactagtgaattcagtgttctgtctcgtgtcgagagaaatgtaatggatgagagcaatagaaggaaatgttgaatccaactcacttggaagagctgcagtatctagttccagtaacccttctacaatgcatgtttctccgaagcaaaagcttcggcgagcaacaggcaattcttgatcagtccatttcgcctcttgcgcattcatagctttgtgctccagccagccaagtgaactgaactttgaggctggatgtatcaatgtgatctattcgagcatagactcttggcatgaaatcgtggtcgtcatacagtgcccagatctgatcaacttcaatccagttgacatctctaaacttgccaaaatcacagaggtctggatagtggtaggcaatcacaggattgttcagtcctgacttttttgggaatatgcgaggagcgcatcattgtattaagaaggaataaaagtatgtacaaagtgggtcagaaataaaaaacgaaagggacaagatataggaggggaaacgaagaacaaaagcctaatctccaactaaatttggcgacccttctccattcacaatgactaccacaacagggattgcggctttagccagccgccaaagctccgcttcacccgtcataacccttgcaatctccgcccatgttctgctcttctggttgaagacccaattgtttctttccttccaaatcgtccacgctaccagtgttgcgatggtgtcgaatccccggcgatgttccttgaccatcttcttatggctgtcatacaaccaagaatgaaaagagggctcattgagcggtaaacattgggaatgcccaatagctctaagagcaatccaccaaagttgccgaagaagcagtatcaccagcttctttttggtaattctgttgatctcctattctccttcatgttctgcatttctttccccatggatgtccaatttgatggggacatgatgttcagtagatagacttacagctgaattatcaatatttgcacataattagaaccagcactaggagctcaagctgcagctggtgaaggcaccatgatctgctcaacatttgaacttgtttctgtatccatgtgttccctcggttgaagaaagcttaatgtactgggtctgctgtgatatcggcgccaaaacgcttctgacgaagttcggtaatcgcttgctgaagctaaaaggaatctcgacggcacagcctgctcatgcagcttgaatgcaaagaagttcttactcccttttgtttgagagatgtttagatttgtgtgctgctttcatggaagcatactcccttttgctgtcatactacaaagatctcttcatatgatcacacagtattagatgagcttctgaaaccaagttgagagcagattcagcaccagaaaagagtgtttttatcaggataaaagccacagggcaaagtttgtcatgttgatattttaatgtggtgtcatctgctgttgcctccacttgaagaacaccataccagtccaaagtctcagtaggttttcgcctctgctgaagaatgaacttcgcagacagttagcagctgataaatgttgtcaagatctggaaaaggcctttggcacaaaaattgtccttgttttccaacttcttcactgcaatttatctggcccttacagcctcttctctgttgcattccaatatgtaaaaaaaataaaatttagtgcatcagttcctgcatacatacaaaaaaaatcactaatagagaaatgtcaactgtgtgacacatgcacccaaaaaacaaggcaaaatttcttgtgcacaaacaccacctcctatttcaaagattgactaggaaacaatcttacaatactacatggataccaacatcgcatacatgtagtagtgtagcttggaaacaatcttaataaaaaaatcactaattatcttgatatgttctgggttattagtaatttatgagtcattccatttatcattctctgccaaacctagcaagtaggatgtgttccaagtcaatggtattggagtcgacacagaaaaataaaaaggtgtattttcgggacaagtaacagaatgacagaactacagaaagccaaaaatgagtagcgtgcatcttcgatgttcttacgtttccaattaaatcactgaacacactaaaaactgtgtagagtactacagttcctggccttatctttttctggcaaaattgggtacactaatttattgattacaatgtactgaaagaaagaaaaaagatactgactgcaagtctgcaacccttccatgggcattgttcagtaatcagtagcagaggcctctgcaatggaatgtcaggatgggttttgaacataacttatccctgggtaaaacattgatggtattaaggttaatacagaaagtacaggttcatacatacaggagcatgctgccagacaacactatatgctgacaacagttccaacaggagtcagggctcaggagccaaacacaacttatgtcattttgacaggatttcacaatagcatttgaaattaggaaaatcactgaacacataaaacacttgtagaaaagttgtactgattgcagtgcagccccttccacagggtggcagccagcagaggcaactgtaatagaatgcatgttatgatggttttgaacagggcttatccttggcaaaacatggcatttgacaagtaagagaggccacataattagaatgttagtaacaggtttctgaatagattacaggtaaggcatatatgtacacagaaaatgagtagaaccatacatcaagatatatcataattaagaccaaatttcagttctactgtctcaagagtctgctatggcattcgtaagtcatggagtgtctgttatgggtggaattaaagtgcttggtgaggttgcgaaggagtggtggatgggtggctgaggccctagcactcatggataccagagcgtcagccgccactgctgcctttgtgcctggcacacctctcatgccactccagcccataacagtgttcctatacaggaaaacatcaggaacagaagctggatcgagctcatagaagccacggagcctgccacctctttcttctgtcaaaaggaaggaggggattcggtgagaaaacctcaaacgatctcttgtaggtatctccacaactgtatttcgcttgtcaggcatgaacactgctctgaagccattaagttgggtcagaggagagatttttatactttcttccgtgcgcccaacaatctcaccgatgacaaactcgcaagtatctacgctgggaggagtccagttcttgtagatgcaccaaatttcacctacttgcggaagaatttcaatctgccggtttgagccattctgtcctgtatgtactaaatgagagaaagaataatttctctcatacctggctttccagtcccggattttaaatttaccacaagagactggtaagtcctgctccaaccaccgtttctcctgctcatattcaggagaagcctcaagccagatcaaatgcactatgaatggttgtcgctcgactttgcttatccaaccatagaacttggggaatttatcaacatcactgtataaagcccaaatctacccaggttcaaacttctcatatgtgcggtcatcttcgaagttatggaattctggatcaggatatgaaaaaatagttggggttggggaagggcagcctggcccagaattatttttttttagataatggaatataatatcccggcctttactcaaaagagctacagccaattattacatagtagttttcatgaacatagtgtaaatctaaatgaatagaacacaccgaagatcactattattgaaactagcctaacgtaaggagatcacaattattgaagtctatttgtaaatctccaaccataattggcaaatagttgcataaccgtggtctccaactttcggcatgcaaccttcagaaactcttcatcttcatcacacctttgtagttgtgcccaaaaccagagccaatgagttgccctgaaaataacctgcatataggaaaatgatggtgatttgtcaaaaaccatatcgttcctactcagccatattattgcccagaattattgccaaaaccattggcaacgtggccatttttgggcaaggatgagtttttttcagaagaaagactctccttttgtgcttcagaaagattctccgtttgttcatttccaggatcctttctactacttctactgtcagtcgtcaaatcaatgagtgtactgccctttttcttgccaagggagatgtaagagtccagggtgacagaaggaaatatcatatccatgtcaatggggagacaagaagtgtcaagttccataaaccctgccggggcacctactttttcatttccagttgtcctgtaacaggggatattatgagaaaatcgaagcaactcactcgatgctatcacaactgcagatttgtctttagctgccgcaaataaactcacaaagcctttaatcctgactaatgggataacagtgataccatcattaactgagaaacctgacaatatttcaacaacttcataatcataagaccgatggctgtctgcatctgaattccactgcatgctccaatccttataaagagcccataactcacccttattaagatatacttcataggcaatcctctttttgccttttgtccatgaaacaatgtgagagaacatgagtctgtcatgttgaccctaagcaaaacttaccacaagcaacaggttgttcttcatcagcccatttcttctcttcttcacttgctgcattgtactccaaccaagtgagatgagctttgaagctggatgcatcaaaatgttcaattcgagcataaaatcttggcatgccatcaaggtcgtcgtaaagggcccatatctgaccaagtgagaacatattaatatccctgagcttctcaaaatcatagaaatctggatatggggacggaagttctaaagaacaggaatgctcattctgacgaacagtattagtagcttcagcattggcattgtccttatcatctgtgtctgaagtttttcctttaccttgaatgtctacttttcttgtcataggaggtggattatattgtctgtcagctctatgggcagtatcaccgaacgttttcttacgattcaagtgaacagaaaatggaagatcattcttcttttacttccttttaccattggagttcagtctactgttgccatcaacatctttctttctgttagctggtctggagacaccagaggaggccgcatatatactgtgggagagacagattggctgagaggaatcaccaaacctgttggaactatcactattcttctgaaaggttacctttttttgcaaagaaagatcttcatgatgttctgcagacagcaggcgacaaacatgtgcttcagactgattcacctttagccgaatagctacacgatttgccattctttcctcatggctgtccactttgctggtgactttatgtccagcgggggatgattgtgacacatgaaacttgcgagctttttttgtctttggaccttctgaatgatcaccaactgatgacaaccctttgcaaccatcattgttattttcttccctattgaggaaaatgtcaggaacagaaccaggatcaagctctaagaagccacaaagctcaccacctctttcctctgtcaaacggaaggagagtatttgatgagaaaacctcaaacgatcttttataggtatcttcagaactcccctacgctggtcagaaggaaacttttatagttgcttccgtgcgctcaacgatctcaccgatggtgaactcgcatgtagctttgctggaaggagtccagtcaaatgtccagttcatgtagatggaccaaatttcacctacttacggaaggatttcaatctgccaatttgagtcaatatgtcccgtatttactaaatgagagaaaacatcatttccgtgatacttggttttccagttccgaattttaaatttaccacagctgataggtatatcctgctctaaccaccgcttctcctgctcctgttgaggacaaggctcaagccaggtcaaaagcactgtgaatggctgtagcttgacttttcttatccaaccatataacttggggaatttatcaacttcactatataaagcccaaatttgtccacactcaaacttcttacatgagcgtccttcttcaaagttgtggaaatctgaattaggaattgcaaaataagtggaggaataccttggcacagtgaaattgttaaaaccattggcattataaccagtttttttcatggatgtgtctgtttagaagaaagatccatctgatcttctgtagacagcgggcagcaattatgtgccttagagtgattctgcttctgccgaatggctgtatgtgttgcatttccttcctcatggtggtccactttgctgggtactctatgtccagcaggggatgatcgtggcacaggacacctccgagctcttttcttctttatatcttgttaatactcatcaaataaagaccactcatcgcagccatcgttgtcattttcttctctatccttaccacgaactttagttgggacaatatcaggaaaatcaatgtgtcctctcttccttgccagcatattcccttgagaccttgaagaacctatagcttttgcagcggagctcttcttcccaagtgcttcttttcgtctatgaggtgcctcatcggtggatgcttggatcttccattgataaaaaaaagctaatttcagtaacaataaacagaagacaaattccaaatgggcagggaaaataatttccctgcattaaatatactatgacacagtcagttaaacccacctttttgtgacaagtcttctcttcagtgaaagcaagttcctgtgtggtcaagcaaattgtagtgaaaactaaatgaaatagctaagtgcaacaaccagaaaacttatgcatcacctcttcctcgtccttgtgaagatctggatacagcgtcaaaattaaagcatcaaaattaggatcaaccttcaaggaatgactacttgcaggggtgcggcatgctgggcattcatcatttctgtaaaaacaatgtgccactcagattatcataaaaagtaagtaccacattctatttcaaaaccccagtcaggtctattctttcgaaatgacattgacagaattttagatgaataatgttagggaccatacccaagccgcatggatttttctatgcagtccctacagaaccggtgcaaacactccgtaattatccttgccttctggataatacctgcaatagggccgtaatgcattcagatgatcagctatgcacagtttgtgcagagatgctagttaaaatttcacagatgagaagcttactcaacctagcgtaataaactctgtctagttgtgcttctctaaaatatgtagaacatgagcatagtgatgtagcttttaccaaagtaaaacaggtatgttctctagtcatcttgttatttatcagtggacagcaattatacacaatatttttttatgcgaactatatacatacttggataacagaaatatgtggactactaactttgctgcttcacttttataaaaaatagtgattaaaaaatcttacatctacagaacaatatccaacatgccaatgacaatatgaagtgaaactgtaaagagggaattgtgcaaagtaaagagggtttttatctctacatctggaagcaagttagggaaagcatattcttacctaagcatatagggcactgcacttccttccgtatatccattaacttcactagtataaacctgtatgagaaacaatatttagataccaacttagcccgcgcgaatgcgcgggcatgcatcgtagatttgtttgatacacttataaaatgaaaacatttgttgcacatcaaaaatatgatttctccatatgtttttgatcagtatttcttgcgtgaataattctcagcaattatttataatcttcttcatcgtcttttttagactttttttcattggaaaacatatataccattttttttgcgaggaacatatataccaaatcaagtgtaacataaaagtggtgtttttcttttttaaaaaaattggattactgatataatgttgtcaattttttattaatggatggattgggtgggacatgaggcttttttagcctaacatgaatacgctaggatggctaaatataattggacaatattatttttggaatatgatatatcatcaatacatgctagaataaaataaatagcggaaggtggagaggaggggatttgttttcttatatatataaatctactattataaaaatttaagatgtttttgccgaacaaaatttcgtaagtcgctcctactccgatttcaattgcccgtgtcgtgtgtcttcctttccgaaaacattaaaaacgaaatctgctctcaaactttttcgttggtgcatctcgaaagtcgtatgtcaagtccgcctgcgcgtcactcggatctccccagcacgtgcccgcgcatgacgtgcccaatgtcgtgttcttgttcccagacccagccgtgtgcctgtgtccagtgtggtttgacaggaagataaacaacttagtgtgtccgtatgtaatttggattaaggctgtgttcatttggttttgttcggaacaaatctcccgttcatgaaaaatagagtggtccattagagtgtgattaattaagtatttattattttttaaaaaaaaattggatctgccaatactttggtacgtcatctgtgtctgagtcagtttttaagttagtttgcttttggaaatacatatttgtatttgagttaatttttaatttttaagttcgttcgcttttgaaaatttagaaggagttgtataagaaatttcttagaaaaactcgcatactaacttgaaacgatcggattcctaattgcagctcataattttctaaaaacagaatatatatccaagcgaattctcacagaactaaaataatattcacccgttacaacgcacgggcatttgttctagtatatataaagtacatctaatggtgagaaataatgggtccatcggtttatatgataaggatggcaagatgtttttttttcttggaaatcttaggatattctctaatttatatagtgttatgcagtgtttgtaaaggtaacatatgctggctttatactgaaaggaatcatcatctaaagtcgattagatactatgtagaatatagaagatcatttggcttgtttggattatttgaacatgctatttttttaaagaaaaggacaattgcttattttaccctacttttataagcccaaaataccaatctaaccatatttttataagttttctcacttgaaaacagagtcagatggtaactctaattttgaaaagcacagtaaaatgagcttgaaaaaattggggtcatagttaggtttctaaacacgcacggataaaagaacatttgccccttttaaaaaaaaacaaagtaatcagaccgttttctctaaccaaggcttcatattatttttataaaatagcaactcttcatcttcatatttgagataattctttttcatatttttttaggcaattcggataaaatgtaaaagaacagcggtttgtttgaccatccaaattattttttaatgtagtgtcttagactattcatatttttactattttttaatgtctagtttagttatacatgtttgcaaaacaatatataatggcgcaacatgtgttgttgaattatttcttagtttttatggcaagtccgatagtatgtaaaatggcaacggtgttgtccatcaataaaaacattgattgaaacatgaaattacaatgtttctttggataatattgatttaatatagatatccatgtttgtagattgatgtataatgacaaaatatgtgttgacaattttttatagtattccattgctatttggatgacataccaaatgcatgggtcgagtgtgcctaaatgtcatattattcttttatatagaaaaatatagacatgtgtattttaaattgctggtttaaatattaatagagtaacatttggattatgattttggatcagaaatcatacatgtagtataaaattacgatctttcaatatctataattatttgttgtttcggttttagtttgacagctaaagatgaggagggagagactgggaaagaagaaataatgtagagctcgagcgagagattggaaggggttcgtaatactgtgtgcccatgatggactgatgggatgtacaggtggagaaaatatattaggtcggggaactctgtttttcaaatctttctaaaaatctaagtgaaaaccaatggttttttttctcagatttcaattcttttctaatatttaaaacatgatgtgatggattcggatttccggagaagatctaatgcttaaaaatagtagatctatcaatttatttttttcctttaaatttctgaaaaaaatttctaacttgaaaatgtgatacgtggtaatttcatagatatttgttatgaaaagtgaatttaagataacataatagatattgtcatctttttattattttgttcttatttgatttgtcatacagaggacaacggttttagttgaaaatagtagacttaatttcttagaaatagacttaataggttcactggtttcaactatgcttatctttctaatggttaaaataataggtccgaaaatcaataattcgacttttatttttttcttcataatatttgttctgtactaaactactttttagttaccctaacaaatttgttagctacaatagaaaggtgagatggaggaagcgtacgtacacgcacgtctggcctggactggtgggaaacagagagggagagaggagattgtggggtcctttttttcctctaaaaataaatctaatattagaaacagtgggtccactaatttattagattgccacgtggtggtttaggagcgtttgtaggaatgtcacgtagcgtcttaggagcgtttgtagaaagtttaatggatttttaatatataatagatagaagatagatttcatgcattggctaaaatcaaggtcaagtaaacactatccattattgcattggttactcatcaatattctacaatatatggaaaacagggaagtgtaccacaagattcttttcatttcattaaaacagaagaattaatagctactattcactgaaacctggctagaaggtattcacaaggtgactatacaaagacagaataaaaatatgattccattaggcattagcacatcataagtaaattgagactataagggcatgcacagcggtcatcaatgtgctgtcttagcaagtgtctcgttcaatagttgctaacatggaggggagaaaatagagttgtatcttcacaaaacaacaacatgagcgtgcaggttaagaaaaagtagagaggataaaataatctaagattgaactccatgttatatactatggtcatctgtccatgctgtcttttgagctagcttagttgacacgtacctataaaatgtggcagtggtctcaaatgttgaacatgccctaaagggcccttaattgaaagcttgtgaagtaacaattcacaggctgaaaaaacaaaatgcgcactagcagattcacgatgactgaaaagttcaatgaattcaattaaccagcagaggcatctatgcaggaccaacaaaatcgtaaaaaaataaggcaatacgaggtctacaggaattgcctgcacaagaactcagtttgtgcaaaacattcacctcatatttcggagaattgcctaaactgtcacatgtactatgtggtttgtaatgttacaataaaactagtactttcacacagataccatcaattaagcactcataatcttaacaactccctacattacgaatcttggggggtaaaaaaagaggggttttctccctatccgttcctccttgcgaccttgcatgccatcgttttctagattttctaccaaatcctatttaaaagaaatgttgcacaaaatttctaattaccgcgcaacctccaactgctaccccaaaaccccaggaaatcaaacaggaacagcatgagctgcacggaatcgaccccaatattcccaataaaaaggaataacgggagagagaaagagagaaagggatctagagcatagaaacaacagtcacctgagctagggggctaacaaggtcgtcggcggcggccggagccctgggacccaccagcggcgaggtggattggggcgggtccccgtggcactgtgaggagtgagggcgtggatagtgtggctagtgggcagaacttcaagtaggaggctgtgttccatggtaaaatgtagcgtcgcattagcatgattaataatgtattaattaaaaaataacaataaattaataagtttttctaaaataattttttgtgatactttcaaaaaatacatacagtttaacagtgttagaatcgtgcgcgcaaaaaacgatgggtagaagttgagaaagtgttcaaagaacactgttgtggtaaactcgtaatcccctccaaagtccaacagggtattttgatgggaaaaattatattgtttcatataataggaatttaactaacatttactatgttaaaaatataattttgcaatataaattgttagatttgtattcaaaagtcttgtactaattttttgtaatatatgatgaagttgagttttctttaataaatgaccaatgataattattcagctatatgatttatttaagtaaaatgaaatgagcgtcactagaattgtcattaaaaagtgattactatgtttgtctatttgcacaaatatttgttgtcttgtattttttgacagagggagtaatttgttaaggactacattaaatctttcagaagtcgtttacgaaaaactttaagatgtatataattgtagtataattatattgtacctctactgtaattacattgtgactaagtattaaatcgactagaaaccacgtctaagccctacgagcccttgctcatgagaggaagatattgtcatcagctttctagcaaatccataaaagaaatgctttgaactggagtgtcaaataaaaacgacgggagagggagtacttttttttctcataatgcaagaccaggaatattttaaattttaaattttatttattaaaatatttacaaaaatatatataaagttttataaatctacacccctaataccctttgagagggtattttttaaaagtcattccaaaggactttttttttataatgtggcacacgtccgttgacgtattctaatagtcacatgaagggtggccagtcattttgcagacaaccgcttgtcacctttccaaagagctacaaggaagccagttgcaaaataattgagacaggctatttataggcaggcccttgccgccctcccagagaacgttggagtagtagatttgtaaaactttaaccataaattaatttttaaaatattttaataaataaaattaaaagtttaaaaaattcttgttccaagccagtttgctttatcctccattcctcccaatagcaaacacgtgtcgtaatctacggcacgtgattcctctttgggcacttggtcacaaaggtgctatagtcatgctgtgttctgaaattcaaatttacaggaatatggaattttcactggaggctgaccgaaatttattaaatggggagatagacttatcatcatatagtcatagagattccgtcacgtacaatgatttagctatagttactaggggtactgtagcttgtagaaaaaaaaaaccatttatacaaagggcgaatcaggatttggccaacccatgcattatacctttcatttctccaatctcagagaacaccacttaaaatttgaaatgaagaaaaagctcgtgcactgatctcacgcgaaactgagtacgacgaaagtgcatcggataacagaatacctatggaatttcaataaaactcttagttgcaaatgctcagcagacaccagcataggctaacatacttcttccagcgaagagataatgcttcttttctagttttatcagctgaacatttagaacgttggcaccgaaaatattcacaggtgtacccaagttcatgtgaaaacatcactcgtaaatatgcagtgcgatgtatgtacagcagcagaattcatacattgcagccaaattttagaacagattatgtcacagaaagtagaaacttgatggtacatacaatggtcatgcagacaatgctgcacagtttcaacggtagtcaggagccaaagttatgtaagacccacatgactctaggaaaaacaataaacacatataacttcagaaagagcaatactaattgcttgcaagttgcaacccatatattatgatggttttgaacaggtcttatccttgggcaaaaccgcaaaacatgacaattgccaagtagcataggctatagaatttcaaaagttagtagcaggattctgaataaacaacagatcaggcatacatgtacacagaaaatggatagcagcatatatcaggatatattataattaagaccagatttcagttctactacttcaagagtctgctttgacgttggcaagtcatggggtgtccctgtagaggaaaacgtcaggaacagaggctggatcaagctcatagaagccacggagcttgccacctctttcttctgtcagacggaaggatggtatttgatgagaaaacttcaaacgatctcttttaggtatctccagaactccactttgcctgtcaggcttaaacaccgctctgtagccattaacttgggtcagcagagaaacttttataagtgcttccgtgcactcaatgatctcgccgatggcgaactcgcacatatctatgctggaaggagtccagtcagatgtccagttcatgtagatacaccaaatttcgcctacttgtggaagaatgtcaatctgccatgttgagtccctctgtcccgtgtgcactaaatgagagaaagtatcagttgtctcatattgggctttccaggtccgaattttaaatttgccacagcagactggtatgtcctgatccaaccactgtttctcctgctcctgttcaggacaagcttcaagccagatcaaatgtactctgaatggttgtagctcgactttgcttatccaaccatagaacttgggaaatttatcagcatcactgtataaagcccaaatttgtccaggttcaaacttctcacatgtgcggccttcctcgaagttatggaattctgaatcaggatatgaataaatacttggggagggacagcttggctcagaagaattgccaaaaccgttggcatcatggccatttttgggcaaggatgtgtttttctcataagaaagactttcatgattttctgtagacactgggcggcaaatatgtgcttcaggcagattctcctttttctcatttccaggatccattctactacttgtactatcattggtcaaatcaatgatcgtactgtcctctttcttgccaagggagatgtaagattccagggggacagaaggaaatattatatccatgtcattggggagacaagcagtgtcaagttctataaaccctgctggggaacctactttctcatttccatttgtcctataagaggggatactgtgagaaaatcgaagcaactcactcgacactatcacatttgtggatttgtctttagccgccgcaaataaactcacaaagcctttaatcctgactaatgggacaacagtgataccatcattaactgagaaatctgacaagatttcaacaacttcatactcataagaccgatggctgtctgcatctgaattccactgcatgctccaatccttataaagcgcccatacctcacccttattaggatatacttcataggcattcctctttttgccttttgtccatgaaacaatgtgagagaacatgagtctgtcatgtgatacctctgttgaccctaagcaaaacttaccacaagcaacaggtagttcttcatcagtccatttcttctcttcttcacttgctgcattgtactccaaccaagtgagatgagctttgaagttggatgcatcaaaatgtttaattcgagcataaaatcttggcatgccatcaaggtcatcataaagggcccatatctgaccaactgcgaacatattgatatccctgagcttctcaaaatcatagaaatctggatcagggaatgatagtttttcaaagcaggaaggcacattccaaccagcagtatcagtagattctgccttggtcttactatctgcatctgtaacttttgttttatcttgaatgtctactgtgctcgacacatgaggtggagcagattgtttgtcaccactagtgccattattgttgaatatttgctggcaattcaagtcaacatcagatagcacattattcttcttttgcttctttctgaccttggagttcatgctgccgttgtcaccagcatcttgctttctcctagctgatctccggagactggagggtactgcagaattgggcactggaaatgaatcttctgtaccaaagttctttctgtcaaaaacatttggatcagcatggtctggcttgaatcttccactggcattctcatttgcagtttgggcagaagattttctttgattcatcattgactggtttgctttcttttcaacacttgcactgctatcctcttttgtggtttccttccattgtgccacatttacccgtggtttggcatttgtgcctccacctgtcgaatgaagcttcgaatgaccaggcacattcatagcaggtgcaacagatgcatcttctctacccaacttttgcctgtcaatagtgtctggacaatcaggaactggtattgaacatccacctgaattcccatttgctgttggtacagaatatttatcttgattccttgctggaaattgatctttcccccttgtcatctctgactgaatagttctctcatcactgcctggccagctatatgtccccggcctcacatctgtgtttccacctgtgcaagaaagcttcacagggtggccctgtcgactgatgggatcacgccgttgatttggaaacatgtttgctggaaattgagaactataaggtacatttggtgtaggcacaggctgttcttgcaggttgtatgcaaaaaaattccttctgcagttcatacaacagacagtagtatttatggcattgttgtagtactgatatcgcatctgacaatgtgggcacattgtccaaaatgcatgtaagtatacaggtacactgtatttgtttgcctgagttttctttgtgggccgtgtagcttgctttggagcctttctgggaatattattccttttgatgtcataaataggacgttttgttggatcacacaatagtgaatgagcttcagcaaccaacttgaaagcagcttcagcgccagcgaaactatttttgtcaggatgaagtgaaaaggcaagcttgcggtattgctttcttatggtagcctcatctgctgtcgcctccacttgaaggattccataccagtccgtctgtccatttaccgttgcttctgctgcacaatgtacatgacagatatttaacagctgggatatgttctcaagctctgggaaaagcttttgagctttaagaacaatcttttgggcaccattgaagtctttgttttccatctttcttaaagcaatttccctggccctaaaggcctcttcgcggttgcactccatcatagtcttgcacaatacaccacagaatacctcacatgaaatgatctttcctggaaatgagtatccactgacacatgctctacatcaaatactatttgaaagtagatgtacagctacacccatgacacactagtccctgcaaatttagagtagaaaataattcataaactggaaatatccccctaccataccatcagtggtacaatgtaatacagatatgttgattctatgaataatattacaatgtacaattaaaactgaaggaacaataaaaaaataagcacataaggatagccagattaaacaatgaaggaaatgacttatacaacattaataagcagactctattgctggctccactctattaatagtagaggtaaaagatataaatcatatggcaggatcagacattcaagaatgttcatgattctatctggaggccgcacgattcatacaccaaataattctcttcgtgtaaacaggaaagtatatgttgaatgtacatagcattgaaaaccaatgcagaaactgaccaaccatcaggtgagcaaattggagcttatagtctgcatataaacctattaacaatacacaccattctcaataaaaaaatgttttctgacacgtccagttacaccccacaatgaaggcagtattacatagtcgatagctgcaatctgtctcatgaagttctccaaacacgcgccagtataaaacggtagtaactccacatggcctaaatcatcaaagcgttccgaaaacactaccaaacaggccgggtttttccttttagcgacagtactgtgttggtgtgactaggcttgaaagcattagataacaacaacgattaattcacatccaaatcagtcatttacaacccacaaatcggcagcctactatgactatgagcaaacaaatcagtaactatgactatgagcaacgaagcaaaagctactgagttagtcactgaccttcaatgttcaatcgcctgctgccgcgagactgaagaggattaagcaatcagaggatttggaggagaccagatcgagaggccgagacagcggcgggggtctgcaccagtgaactcgatttcagactggataaaacatcgagtaaaggaggcaccacgcacaatctcactaactgcacatatcaaacgaaatccgcgacaaacatttcacatatcggcaagaacacagaacgatttgggtttcggtcgcggcgcacaccaaaacccacccccaccccccaaaagcaaaagctagagagttcccttaccagcgcaagagaaacgagaagacgacgacgggggtgtgtgtgagggggggagaaggatcctcggaggagggggttcgctccggcggcgggaaggaggcggatgctcgctcgccggaggacggcggcgcgggcggagggggaggggaggaggttttcgaacgaaattttggtggtggcgccctcgtcccggagttcccgcctctcgccgccgccagatgaaagggaaaatggggaatagcgagaggggaaggggattgaaatatctagggcaaaatgggcaatttgggtatttcacattggtgtggttttttcaaaaatgaccctcaaaactactcgaaattgtattaacgtagatttatttccagagatgctaggtgacgtgattaatgctcccagagatgttaggtgtggtgaataatgtgccttgaagtaaagtgatcggtacatagagtttgtagcgtaacgtgtgactagtcaaatagcttaaaatcactctatgacacttctaactcttatatagtaataaatcgatagaaataagttcttttttcgaaacacgatacagtcgcagaccctgaaagacacgtgtgtgcatccctaaaaacagtggtggagccagaaattatataagactagggctaaagtagggctcgactaacggagtattagttttctgaaaaatttacatggtgaatcaacaaaatttaagcaagtttttaaaggcaagcctagggcccaagccctagccgccctgcctaaaaacgtcatacatgcatacattacctatatgagcacattctccaaagactgaactgatatatcttaagattgacaaagttattacagccatcatgttaccaatggattacctattactctctctgtcccaaaatataataactttagcactaaggatttgtcacaaaatataacaacttctccaccatttacttttcccacctacccccacttctcaagcaatcacaaccccttcctgttgatgcaaaaaaacatacggcctgggagatctgcttagctccagtgtaggtccaagatgttgatgagatgcggacgtgccagtcagtttgatcctgcaactgacaagacatgtaaacatcaaataagacagtcgatcggctgacaagccgatggaataattctagtcgatagccgatattagctgataccgattccagccgatgtcgatagggttttgagcaatcggctatatgtccaatgcagataatgatataaagacaatcggttgatgataataaaaaggggaaattgcaattttaccactgctttgaatcgttattgcaaaactgccactagaaaattgcaaaaatgccactagaactggcattcgagtggcatccttgcaaaattgaaaaaaacggtggcaaatttgcaaatgccccaacaataatataatccaatagaaaccaatcgactaataataatatgatatgataagtattgattcgatggttaaagcatacatcggctaaaattccgatgtcataaaatccaatcaatttagataaacagtgaaacctttgttgcaatcggctaaatccaatttgtatgtaatctttgtaagccgatgcaatgtccagataacttatcggctagcaccccgataaaacactagcattaacttatcggctagcaccctgataaaacattagcatcaacctatcggcttaacaagatttctattatcaacaacaatctagtaggtcggacctaaccgatgagccgatagatctatctaatgtgatgaatataacaaatctgtttataacaacattgtaattatagagatatatcggctaagacagaagatcggatctaaccaagacaatcccaactaaaccgatgcgcctctaaacacaatgcaagagatataattgagatatcaggtaggcaaatatatcaaccaaaccagagcgatccaagagatcgaagcgatgcagccttgaacaacaccaatgtagccgatagattcaccagggccgacggaacgtaggacttacccctttgtcgaagatcgaactgaaccgatgcagccccgtgtcaggtgccaaattccgccggttgataagtaaaacctcagaaaggagggtggtgatgcgccggagtagtattgatcgagagataaattacaatgaccccgggtatacatatttatacccatgagtagtatagtccttgtaagataagaaagaaactttactaaagataaagggaaaacataaactccttatcggatactaaagacactttcctaaagataaaaggaaactaaaccctacctaattaatagataaactgccatgtcgcatcctccttgaacttggactcttctagataagcttcatttaattgatctttacccgaatccatcaagaatacaactgttggcgattgatagtttccatcggtcgattctaggattttgaagtcaatactgactctaagccgatgattgctccgggcttaccaaattttgtcgttaacacttcctatttaattctacttactttcttaataaccgtgtccaactctaaaactctctatattctgaaacggagggcgtattaaaataataaataaccgtaaatgtgccaagtcaacttatagacagatttcatcaaaaaaacataaccaactaagctaggcacacttcgtgcaataggaagattttaaagaagttagaatcgaatcctcatgattatccaattttaaccaaatttcattagctacttgctagttgctatgtgttgcttagcctcgattcccgtatctaaaatgtgggtcgtagagagtgttcaaatggctaatggaggtatcgatatttttgctgcactttcacaagtacaatttctaaaaaccttttcattctagtattgcgtggacaactttttaaaaagttatttgctaacttgtaatatttaattaatctacgagactttttttcctttgttcgaaatctatcaatcatctagttagaatgcgcccttacccctttcttttctagcaccacattgatcatggccttatttacttaaaaaaaatatgaggatgaataatgaagttgtatactggcgtatcattttcatatatttctttataaggcataccttctcataactattcctattatcatatcatgcataaaaaaatcactatccattagaaccaatcaaaactgttgttacacattggatttttctattgtacttcaaaagctatatagttcaaaaatcaaaacataatggcggatgaagattaagtgcaggcacccaaaacgagaaagtatttagcacatgattaatggagttttaattattttaaatttgaaaaatagatttatttgatatttaaagcaacttttatatataaaaattttgcacaaaatgcatcgtttataacgaaactgaggtagaatttgtatcttcatcataaaagaacgggccttaatatgatattcccttgttacttccttcttaagtgtatcattgagaaaaaaatgcttttgtattggagaaggtaacatcaagaaagattagaactaatgggaggcatacacaattgtagtaatgggtaggaaagtggcatgaagatgtgggattaatctatatatcccatggaccactgcacatgccatgcacacaccacaaaaagcttgtgtccaatatgttccttttttatttctatggcccatagcacatgttaagcacacaccacaaaaggacaaattctttgtttgggtttaggtttgttagcttataattttaacctgacattttggcatataagttttataagccgatggtttttaagccattaagtttaatggtggggtcctacctttacttcacgtaaggacaaaactactctaatctagattttggcttaacagtataagaatggtttatggcttttaaaaaactactcgatgatacatttttcaaggaaattactcgatgccctattcttttcaaggaatacatgaaacatacgtttccagagtatcaagcatttttatgaaaaaactttctatttatacaaatttcttagaaaattgttttaaatccattttcaactttacaatatttaatttatttttaatccttgaataatttcacaaatcattcctctatttagctatttagcacaacagtatagggtgatatagagaaaaaaaaccattccatgtgagcatcatgcccaattctatcggaacaacaacaacaaaaagaaaagatagcagctagggaaaaaaatcattttgatgataagcccaattctatcgaaatatggaagaacaaatccttctaagagctactaactctgtcccatattatagctgcctttgctattcaaattttaatagcaaaggtgctataatatagaacggaagtagtataaccattttaatacattggcatgatgaattgatgatacaccaagaacaatgcaaagacatcagctcaaccatgcaacccccccccccgantggcnaaaatntaaaaggggctgtccaggcaccaaaatctttctactggaccaaacctaaaataaaagagaggccttcgttgttgaaacctcagaccaccagtaaacatggaaaatatagcacagcagcacacttatattggttcatctccctggctgatcatctctccgtggccctcctgctggctttgccatgaatgatctgcgtaattcatgagagaaaacattagcatgtactttttatattacatttaaccatcatcttattaaaaaaatagtgtaaactagctgaatgcccgtgcgttgcgatgggaattaaataagagaaccctatcatacactttaaagcctcgaaaattaaaataaaattattctcattgtaaaatatttagatcatattatttgtcattatttttacctcacttcaaaggaaatttccctgtttgatggcttgaggttagggaatggacaaaagtccacttacctcatgttcaggggatccacatgacagtggtggtgggtggtggcaaattcaccacttaccaccaccattagggtcttttaaagagtacatatatgcaaaaatagaagtaacgcttaaagtttctttatgagaaagcatgtcacaacaaaataattaaaacttatataattttgtttaatgagacaaattctcaaacgtcaagccaaaagtcaacatcgtcatgtattaaaaaaaatggagagagtatatgagaatgatttctacttcgtttttaacacagccaacaacataagatagcactcttacggtcttacctggccaacccgcagaacggtacatgcagcatctgcagagtattttagagaacaaaaactgatgagtgaaaagaaggcacatgataagaggtgggctaaaacaagcttaagtcctggcagtagacaaggaaatataaaaattgaattagacgcatggatatcatgaaaagtaacaaagggaaaaacattgcatgtgcttcccacatagtaagtacacctattctgccgtactagaaggtatggacacatagacttactttgtaagttgtaacatagaggtcccatattttcatgatcgagacatccttgcaaacaccttccaaatcaataccagctttcgtgtttcaaccagcatgctcggtataaacagaagatattaactccagagcactaagcccagcattttcagcctgggttcttggaaccatttcaaaacttcaagcaaattttgcaatggcatagtggtccaacctgcataactgttaaccatcaatataggaagcaaaaaccgaaaaatgtatgtactaaggacattgcataacaatcataaaccaaggtacataaacagaagctcatgaatcaaatgtgtcaggcataataacgcataaaactttaaaaaacaacaagtgaatacattaaaaaaataatctggatgggtaagacagtatggacaccttaatatacaattaagctatacctggactttatatagtttcattgccatagaacaggagaatgttagcgacagagcatattatatttattgccaatg

SEQ ID NO: 57752 - DNA, 17237 bp, Oryza sativa
  unsure (1)..(17237): unsure at all n locations
tatatttattgacaatggactggagatggaacatcttttttggccctgttctttacagctactagctactcctaaacgttatattttttggaaaaaagtttacatggaaaaaattgcttagaatacatttaaaaattcattttcaactttttaatattttttttatttatttgtgccctcgaaaagctataaaaaatcagaataatctttaatctataagctattatctacttcgaatggggcctttatcatcatgttccatgcatgaaaattatttggtgtaacaaatatactaccctgtttccttcagagagaattccttcaatctctttgccaattctatttctgttgctgcggcaccaggaataatccgactatccctgcacattgactgtataaacaccaatagtccgataatatctcagcaaattaaacattaaaacagcaggtgtgttccaaaacaatgacaggaagctgatttacacacataccttgtaagtgttgacaccgtcatcaacagctcttccgagatcatccagtatactatcagtgctgcctcttaagacagcaatagccaccgagtttcgaccttcttcattcttgagaacagttacccacaaagaactaaacatggtaagaagaatgaggtcatgtctattggaaaaagagcagaggcatgaaatgtactcgaacacctccaatatcttccagcgaaacagagtctgcatatcctaattcatccgcatttggctggctcagtttcaactgttttttggaagagcactggcatcagcatatacacatagtactgtgaaattgagcaaaagcttgagatcagaacttacaagtgcaatagcccccgtagtacgacaaaacattctcagtttaaattttgaattcattttcctaataataatattagcctgaaaataaaaggaaaagtaagtactcctctaaaacagaaccaaatcaagcatgaagtacccaactttgagatgccttttaatattagaacttccagggtttcagttgagtagagtatttacaatatttccaattttgaagtgtagataagaaagatgcaaagcactgacttgttcacaaaaagtagaagtggagtattgcaaccatccagcaaattcacagaagcacaaaatagtgtaaccaaagtacgtgaattacatattttaatcactctaaaaaagaacaggtccacaaggttgctgtttattgcaatgtaggtgtacagcctctacttgatcatgtactcaatagtccatgacaagggcagtccatatgttagattattgagcacatcaacagcaaaaggaaggaattgtaagaaataccatgagtattctaaagcaggtttacaactactatgccatataacaagagaagaagagtgttatcatacagtgccaattaggccataagatcataactaggtggagacaattgaataccggctaccaattttagaaccctgctacagtgctaccttctaagccttcaaagcttattgacaagatatattccactaaatctaaccaccaaataaaggcaagccttaagaaaaccatttacaccatcagagtgcaataacaaagaaaaatgagtatcatatctcaaataaaaatttcaagaagatgaatcattgagttactagaaactcccgattcatagtggaaagctacaaagataagaacaaaaatatttgatctcagatgatgatatacttcatccatgaaagggacgacaaaggaaaatagaattatcaccacctaatgtatgctactatacagtgtgggaacagccctgactaaacagtatcatcaaatcaagaatagataatgtatcaacagactggcaaagacacaccacaaattaagtgtaacattttgttctcacctttgccttctccaccctttttgacgatgctcccaacagcgccatttttcagaaccagcccgtgaactacagaagagttatgcaaacctaaccacctcgaagtagcttctcaactctaacattgtcaacgttgaagacttgaagttagcaggatttttgggcagacttgcttacaggcctgaaaaaccgtagtacaaaaacccagctactagttttcatccatgagcgcaaaaaggtccctctcacgtaagaatgcaagatggtaacttacatcagctagaagacggcacaatatatcctcctggcctgaatttcttgatcgcgactgtagatcttatccgcaacacaacctcctccttgttcctcacatccatgttctctgaacctttctccaccagatcttccaagatctcaataagcatgaataaatagcctgccatcaggcaacagggttaacaatacaaggccagctcaatcaagagggtaagtaaccttattgatggccttggtgtacacagcgcgacgatcacacttggatgcaaccccatcctgacaagctccttagccttctcaagcagccccatcagcaaaagatatggtgaggttagctccatcaccaatctcctattgctgagcaagtaccaggatcttagcagcagggtgctggacctcaagctcgttcacaattgttgcagcagcgtttgtgacaaagagcttgtcgagatggtcaatgaccatcttattcaatcctaccacaacagaacaacaacaacatactccctccatccctaaatgtttaacgttgttgacttttttaaacatgtttgaccattcatcttattcaaaaatttaagtaattattaattcttttcctatcatttaattcattgttaaatatacttttatgtatacatatagttttacatatttcgcaaaaatctttgaataagacgaacggtcaaacgtatttaaaaaagtcaacggcgtcaaacatttaggtacgaagggagtagttaagaaactagcttctggtgcttatttgaacctgtcaaatgttatacatccacagacaaaatgtagcagaagagcatgtttacgcggagcaacatttggcaatcaatagcgggaaatttaactgaactcaacctcaaaccgcaagacaaaagcaaaccatttttttactacccaaaaggccatagaattttcctcagcgccattatactaacccaatgagctcccacaatattatcttcaactcatcgctaataactaataactaatgtcttaacaatcaaaatccgggctcttctgcagctatgacactaatccaagttggatgcagtagcagtaacacggccacaaccctaacccgtttctaccaccacgccacaacactcacctcctgagctgcgggtaacgagaaaaacctggacatgaagcggggaaggaaggggagggggcctcaccgctgctcgccggcgctggggacgagggaggtggagctcgcggcggcgtcgatgtttgagggcggcctcctcttctcgatcgagaccggaggggggggggtgcttgtgcccctcgcctcgagcatggtgctcagtccaaccatcgccggcggcggacgcgagaggtgacggcggcgttggaggagtatgcgacggcggcggcgtcgcgatgatctcggcgatggcggcgaagcgcgccgaccttgtgggcctccattttgggcctggcccatgaggtccaaagctgcttactactctaggcccaaaatcttaatgggctaaatttggggcctgaaatttagttgactgacaataaagtgacctaatgctttttaaaaagtaaatttcacaaaactttaatatatttaaagtgactagcaaaaatgcccgtgcgttgcaacaggtgaaaaaattctaatgataatatacatttttcatgcataatgatttcaatgacaatatttgtattttaatgagcggcttgtttttttttataaacagtgttcgcgattttctcaaaccattttttaaaatggcacatttctttctaatattttttcttagcatgttttttttttgctttttttactgacgacgaaaaccatatttttctccctctttttttgcttttttttctcgtgtgttttttgcctattttttctgacaattattttctcacgcgttttttttgcttttattttcgaatgttcttttttgcttttttccaatacaggagaatgtatgacgaaataaaagccgtgtagtagatggcaaaaaattgatggattctatccgactcaagcgcccatcaatttagcgtttttctgatagtttttcagagcgatttgttttttaatagacggtgttttttttcttgcgaggttttctcaaaccattttttagaaatggcatgtttttctggcaattttttcctcgcatgtttttttaaaaaaaatttaccgacgatggaaataacttttctcgcatgtttttttatttttcttatggaagatgtaaaacctttttacagtgtttttttttttgcgcttttttctgacttttttctcacgcgtttttttgaactgtttttattttctcacgcgttagagtacattagagatagagaagagatatatactgattagaaatcagattttgtttcacccattttatttttttctcacgtgcactttttaattcatacgaactagctttttattttttacgaaccatttttttgccattttcttagggaatcggacgaacttttttagatgtttttttcagatttttttttcgcctttataggaatcagacttttttttccgtttttaaaggaattggatctagcttttttttaccactttttgtttgccttttataggaataggattttttttgttcggatctatggttttttttggccacataggggaaacagacttttgttgttgttgttgttgtttttctttttttctttatttttttgtggcttttatttttctttttatgcacctttcttcctttgttatctcccttttattatttttttaaaaaaacgacctcaagtaccttattgcaagattatagggacttaaatgtaaatataaaaattacagggactcaaatgcaaaattacataccaaaaattaaaatcatataaaaatagaatgctctcgacatgtaggttccatttttgcaaacagatctccaatctggcacatcaatttttttcaccaagatgtatgggatatcacggtatagattaaaaccgtatggagtggtgcccggatcttggacaagcctagaggagtggtgccttttattttttgtttttaaggggaatcggatttagagttggatttttttcgtttagagataaagaatcggacagattctttttttttatatatttttttcgtccttatttttacccggagtcggattcgtttttttccttttttcgcctttttttttggatcggacaggtttaggttttttttttcacccggttttttctggatcggatagaattggttttttcgcccggttttttgttttttcgccctttttattggacaggtttggtttttttcctttttttccgcttggtttttttacggacagatttggtttttttgtcccgtttttttacggacgatggaagcacctcttatttttttaagtagtagagatatatcaaaagactacaaattgaacaataaaatcataaactacaagttgaaggcaaagtatcacataactactgatttagtaataaaattatcactgaactatagattttagtgcttaaatccttagcactaatattatgtttgagttaaaaatatgagaaaatttcttatttgccattgaaagttcacaagtttccttatatgccatcgaaaagttgctattcctttatatgccactacttgaactttttctttccctatatgccatccatgtcatcatcttgtgtaatagggatgcaaaagtacaatattacccttttaccttttaatccctcgaggggttgttcacttgttttttttttttgcatgtcatccccataattataaatttttttactaacaaagaataatatgtaatatatcactacacaaatatgaaagtttaaatttcacttttacaattttttttaaaaaaatcaaatttggttatagcacacgtatactagtttcgattaaatttattattttcattacaacttgtgaagatcaaatttgaatttgaatttttgactgatatatcaaatattaatctatcttatcatttaatttttttaaatatttataacaattttaatgacggtaataatgacatccttggatggactagcaaaatttgacaaatcaactgcaagataaaatcgttatgctcaagtgtgtacgttgataatgagtgaataaaagcagtcagaagaacacacgagggtagttttgtcattttgttaaaaaactgacaaggtcaaagcggtttgacctcgatagtggcatataaaggatggaaattttcgttggatggcatataaggaaatagcaactttccaatggcatataaggaagtccgtaaactttgagtggcatataaagaattttctctaaaaatattcaattttggtgattgaattgatattaaacttgtcgtttcgtgataactttgttactaaatttatagttttgtactatccgccttaaatctatagttctgtgataaatctagtgttaaatatatgattttgtgatacattatgttaaatatacagtcttgtaacaatttggtgaaggtatctttaattttgtgaaatttacttttatttaaaagaaaaaactgtggcctatacttaatcgagaactatgcctaaattttctacagccttcttggttagtgaatagctgattgattataaggcaacagaatagtttattagagaaaaaataatttttaagtaaaacttttataaatgtgttattaacgacttaaaaaccaaattatagatgtgttatcaactgtaaaattaagttttaaaatttaaattttaataacggctgaattatttttaaggaaaacgatgaggccccctagctttataagcagaaacaatacactactcatataaacgagcagaaataaccaaagtatagtggtacaaattttcataggcttcacctatctacagcctctgcatacatttcacctttcaccgtatctaattaagtttcagaccaacgcaaggagcgcggccaccacggccgccgcgcacgccaccgccgcggcggcggcaacggcggcgcccaccaatgccgcggcggcgacctgcacgctgaagttgcaggcgccctgcgccacgtccctgtcgtcttcggtgacgacggcgagcccctggaagtcgcacgccgcgtcggcctgcccctgcgcctggtagtacacgttgaacgcgtacgacgcgttcccacgcgcgtcgagcgcgccgcagctgcacccgtagccgagcgccgtgcagtcggagtgcgagcacgcgtacccgacgttgtcggcgagccggccggcgtcgtcgtccgtcacgttcgggttcagcacgcaccaccgccgtggcaggtacttgacgcccttcgccggcaccggcatcgccggccgcccggcgccgcggaggtcgagcgggaacttgggccggccgtcgaacgtgaagatgccccagtggcgctcgaagttgcccggcgccacgctcttggtgtcctcgtccatcagcccgaacaggtacacctcgatgcgcgcgcgcggccggagcggcgtgccgcgccgcgccgccagccgcttgagcaggccggagtagaaccgctgcgcgtacggcacggtggcgtgcttgtcgccgtccgtcggccacccgacctcgccgatcacgatcgggaggctcccgaacccgatcctcttcagcgccgacaccagcgtgtcgaagttggcgtcgaacacgttggtgtagttgatgccgttgtccaccaccggccgcggcggcggcccgccgtcgaagaaggcgtagtcgagcgggaagtcgtcgttgccgtagaggctgaggaaggggtagatgttgactgtgagcggcgcgccgctgcggttgaggaacctgaccatgtcggccatggtgccggcgacgtcgtcgcggaacctccccgccgacggcaccgggttgctcgccggcgagtcgtacacgtcggcgttcaccggcaccgtcgccttgatccgcttcccgtacccggcctcgtcgagcgcgcgctggatgttcctcagcgccggcacggtggcgcggtcgaactggccgttgtacgccttgaggaacggctcgttgccgacggcgacgtacctgatgtcgacgccgccgtcgaagctgtacctcgtgacgttctccttcacccactccctggcgcggccgtagtcgccgacggcggcgagcatgtcgttggggacggcgatcatcgcctcgatgccggtgccggcgagccccgacatggtcgtcgcgtcggcgtcgaagatcttcaccttcttgaacccgttgtccttgagcagccgcgccatcaccttgggcggcagccggtgcgtcgccattgtgccccagttcaccccgagcccatccaccaccgccgccgccgccatgatcaccactccgaccaccaccgcgcaacgccacaccgtcgccgccgccatcgccgacgtatcgatccgatccaagaaacttcagtacgcttaaaaaggaagcaattcgatcaaccgatcgaccgacacggcggagtaacgccgagtacggatcaagcgaatgaattggaacgcaacaaccgcaactttttttttttttttgctccgaaagaaaagtagatcaccgctccggcattcaattggaaggtggcaatcataagctggagcaatcaattcgcgaggtttctggtggttttgaggttaattagtggaagaagaacacgcagttagttcagtactacgtgggtaaacaatctgagccttgaactgaaactaaaggggaaatttttcaaatttggcgggagtcctgcactgatgtttgactactctgcagccgtcggatcgcgcgccaacggctgatcagagtggatcacaaaacttgcatacacaatgaggattgacagtaagtgcacggcttcagttcgacagttttgtggtttgattaattagctaagataattgtatgattatgaatacaatcaaatcaattgacaattgctacatgtataggcgtatagcctaagcatatacagagaaactttagggactaaagtagctattctcccggtagggtttggaggacatgatgcgctgtttagtacagtttcttttatttatgcatcaaacaacaccaataaatagttaactaccacctcattactaaccaactaaacatcactaggagaacatggggatacctaacacataatgccctatgcacactactacagtactacctggggcggatccaacgtgggtgcagggggacttgagtcccccctacaccataagacctatggataccctccgaagcatccccttnnnnnnnnnnnnnnnnnnnnnnaaactaaaagttcctaacgggtcgaggttgaagaaaatgtgcccccccccccccccccccccaaaaaaaaagttcctggatccgccctgtactactatggagacaccattgatcgatcaagttcatttgccaacagaggagaaaaatactgcaaagactagagaagaagaagcggttaagtaagcattgtatgaattgtactcaattcagtaaaagatcagtcatctagacatattcaccatcatatttgacactaaagacaagaaatgagagcaagctgtaaagtagatcagtcatctagacctattcaccatcattcctgtggaagtcaagatcacaatagcatcctactgctgctgatgataatatctcctgtggaactctagatcactgtcttttagaaatctcgcattgcacaagttgcatttggttcccgcattctgatgtattgtttggcaatgatgtattatctgagttataagaagaaggttaggatttttttcttgaaataagatgtgcatatttataattcagaaaataacataacttacctttcctgaagccattgcgatagtagaatatctctcaaagaagcagatgacacatagttcctgatcctttgggatcttagcctgttctcttctgtatgattggtgcgaatgctccacctcgtatgggtcaaacttatttgctgcatcaacgatctaccaattcaaaacaaattagctaagcaggagaaaattaaacattttaacaaaaagaacagcaatacgcaataataaaattacctccacaagtctatttactggagtcacaacactttgtccaatagctggcctgtgtaaagcgctatagccataccgagtggcttgctgatttacgatccgcggatcaggagggggctgtatggatagtagaaatcagcagatcaggaggagatatgcacagttagcgcaaatgagaggcatatgcatagcaaacagaaatagtgttttaccttgtataaagagggatcagagatctttggaaccaaaatcttaggaacgtcctgtactgagttctgataattggaggtgcctgcaatttcatcattgaattgtccaatttttactgtattatgatattgttagtaagcaaaatacaatacatttaccaactaacagaacatatttggaaatggaagcatattgttctagcacaagactagacttagtaattctcaagagaagatatctaaaaaaatcacattaaaaatgaattcatcagagtaacaaataaacaaaagagttttattggttgtcaggaatagttacaacataggacaatagcttccctatacactaagaaacattgaacaacattatgttacagaacatggatcacacctttgaatatctaatgtgaacttctagagtatggaggtgatgatgcttcactgcaggctataaactaaaagttcaattaccaattccatctaagcgcatgtatatttacttccattctgattatattgaattaaactcaaatagcttctgtatttgagtaaaacttatgtgggttaatcttgccaggcagtcagcaattaggccccaagtatatttggtttgagaagtgaaaactgattaaaattatcaagatctctgaaaaaaaatggaaacaaagaaaattaggcaataagtgagatataatttgttttgcatgacaacaaaacaaagctcatggaagagtcagtttcatgagtttaataaatattcataacactgtctgtataaaggaatatagattgcatagttctaataccaaataaccatgcaatatcagaacagaactcaagatataagtgtgcgtttctttcttaatttcactgttacagtatataaagtgggagtgctatttattaatctggactgctattccagaattatactgtaattatcgtaacttaagatgggaaaaagacgttgaaatcaagaggtcaccttttgtttctagtgtcgctgaaggcttcaccccattgtcctccacatcaatcaattccaaatctgaggggttagcattttcaacgaggacctcactgcaccaattaataaacatgtgagttcattgcataactaacaaaaaaagaggctaatttaacaagagtaattgcattatgcacagtccattattgaaattcaattgctcagaatcactatttttcccgttcatcagttgcaatgcgttttcaccataagcaacagagaactcaagtcaaccatcaaatactaagggacttcttggcatccataatgtccagctagtaaatactgtcttctaattagaccacatagaaatagtagggtgaccgcccccaaggcccaagaacctgaaatatgttacgctgtttctcattgttttcattatttttcgcacttgtttcaataacctgagtgatttctgcgttctgatgcaaagtttcagcactgaaagtaagtagtggagccgtgcaatacattgtacataaatcaaaaccattcagataattggaacaagtgcaaatggtaatgaaaaactcaagaattattgctaaaactttgggagagtatatttgattacttcaacaacaaagtaggttgaaggatgggtaaactataaaaaggtagggttgtttgtgaagaaattagcctaatgctgtgatacattaaatcaagatgcatacatttataactataacttcagcacacaattttagtttgacggaaagctagtagccaatcgccatgacactactaacagttgcaccctgtagctctgccaaaccaatcaacgaaaaaagacatagaatcttacaagatggctgagagaaggctgcagacaaagctaaacagcaactctaccgaaaacaacaaaaagtagtgcaggactgctcaggccttacaaaagcaatgaactagactgcagtaataaagatcttgttgcatagggcccttagaaaccaaacttgcagtaataaagcaatgaataaagggcatagcaaactgcagacaaacctttctggaattaactgaggtattttccttaaccaaacttgcaatattagatataaagctaactgctattcattgatcttacacttaccaactcagaaagatattgtctttatgacatcatgaaagtacactatacttttctacactacacaatttgtttataattcccttataggaaaaaaaaaagttagccattccctttgtcaggttacattataaacaaaccgaaagtgaaagagcctgcacaagtggatcataatttaacagcaaaacatgcaaccatattgttgaaacatcagataagaaacatgaaaacaaattgcaggaccagtatacattcaatataataatgtaaacagactaaaccagtcagacaacaaaaaaaaggagagatggttctttttaccttcttttatcttctccagcaattaagttgtcagaatacgaaagctgtaaggaatttcaatatattattgttttaacttcatgtaaaacaattaacaaaatgcaactacatcttacaaattatcgtgcaaaaaacctttaagtttgttgtatgcatgttttgcttatcagtctttgaatcaagttccaaactagcgttccactcaggcgaacaacaaccattcataaatatatcatcaatatctttgttggtaatgtttggacgggaagtaatttcaccctgacttatgcatttcttgagctccctctggaaagatggttatatgtgagcacacgacatgagcaaacagttgattagctggaaaacaaaagaaacttcagatgtaaacaaacccatcggtggaatcgaagaaggggcaacacgaattctcggtaatcagtgcatgaacttttgaggagcttatgacacatttcctgaataattttacaagcaacatggaactgcaaaataaaaccaggataagaataactgtaagcactataatggacatcaggatgaaatgttgaactcaaaccatattgtgtaaaagtaccagacctcattacttgatctatccgaaggtaaattccgcaacttcttcttgactgccttgatgatgtcatttccttcttttcgtttctccctttgcagttcagcagcatcagctacttcctttgcagtaaatggactgaggagaaaggatccaaatgcaccttccacattcatgaaacaaaataagtcatgctgacttgagtccttgcacacatctatgacgtctaaggaacaacaatgctcccccatcacatcctcacacaggtttggatctgaaacttcaagtagtttctcccctagtgaaccaaaatgggaattacacaagtgagtccataacatgacagtgctgtcgaatgtaatgttagagcatcctcaatgggggcatttcctcagaatccatgatttgctactactcacgaaatgatgagcatctgttagagacttggatagtgaacggttgattttgctgtagtattcgcaaagaacatcaagcctcacagataggatcattcgttgcttttcacttgttataaggctccaatcacgtcttgcgaatagtacaagagtttgtagaagcccatggatctgtttctttacaaagcaaatccgatcatcatattcatcccctttggtagaccctacagggatgtcgtgactgcttggatcgtcagccttctcaatgggctcgacaacactcatcctcagctgcagcataatcatggaggacagccatcagtcctgcacgaaacagtgcgatcacaagagagtgatctgatatttttgcagcactgtccatgattttcagggcacattgtaggacctcctccttatcagcatctggttcaatactcttggcaaggtccagtgccacataggttggcagaaattgcgcacgagctgacttagggaatgtggttgcaacagctgcggccctatgcaccgcatacgcgactcctgagctctttgcaatgctgagaacacgctccacatcgacttcacaacaagcattgttgtttatatcgattgctcgttggagcctttctcttgctgcagtgattctttggctcttagaggctttttcaggtagggatactccatatgaaatgttatggatggcaggatctaatggtcgtgcaattgatagtgctctgttgaactgggattccgccaaactgtactccttagatgcagaaagagactcaccgtgggcggtagttgtctcaatgcaatctggaactgcttttgcagcagaaccatacatatcagtagcaattcatagagacatttctgggctgcccttggccgctcgggagtgaaatgccttcatattcaggtcccctacgaggttgtagatcatgggacatggagaggcgttgaagaggctcatagcgcgatcaagcgccatgtctagatcgccattcctctgtaaatccagaacttcggcagcttccctccgtaacctcatttcatcctccttttgtcccctcttggaccggctggccctggcctcctttcctctgtccattctgccgcacccgcaagctgttcgtcaaaatgccgcagtgggagcgagagcgaagcaacgattttacgaggaaggagatgtcacgtgtagtagttggaggacggcggcgacgcgtgggccgcttgggagcggtaggagaagcgaagcggcgaggcttggaggaggtgtcgagcgcggcgaggcctggagacggtgtcgaacgcggcgaggcctggaggcggcagcgcgacgagtcctggaggcggcgaggcgcggaggaggccgcgagcgcggcgaggaacggaggcgaaggcgagggcggcgaggtgcgtgggcttggaggtgcgcgacgggcgatggccgaggccgcgagggttttcgtgggatgttgggtgaggtgagtcgtgcagggccaaagggcctaaaggggaggaagtaggtgaagcggagaacgcgtgtcctccgcgctgttgtccgatcatagccgttcctttgaatagacgatcaagatgtgctaaaagagggataaaattttagcagtaaccacttgaacctctgaatattctgcattttttaacagaaaaactggttgatggcagtggcacgtaaaaatagtcatgtgaagcaatcacgcaggcaaatgatgtgtattagtagtagtgtatatgtgtgcgtgtctgtaacataataatcttagaaaagagaaaatagccattagctatggatgtgtgcatacccatcatccatgaccatgatcccaccaagcttccgccacccgagtctgcttatttgagcttaccaatttaggtggtgtttggttcggatgtggtaacgtaaacgctaatggtattgcctccagccgtaacggataccaatttatccgattacatgattagtttggttgcaggcggtaacgtcatttatttacattactgcgtttggttgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaatttcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatgtagattgtcatggttcaagcaaataaagctgaagtactgaaactaaacatccttaggacataggtagtctccaatccccaaggcctatgcttatatggaattctaataattcaaaaacaaataatgaacatcttgtagatcatgcttgacagccagcacatcagtacatcaatttttctttgcctcatctgataacaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttcctgttgcatttgcaacactacaagattgatcaagtgaattaccagcaagtattttcagtacgtactccctcctgagagactctggaagagcgagaagcatactcatttgagccggcacttttacaaaagcagctgcagcattgacaacttcagtaccagtcaatc

SEQ ID NO: 57753 - DNA, 4984 bp, Oryza sativa
agtatatatatataaagccatttattaatattgatcgactatttacaagtcctatagaattcatataaaattttggtgggatgaggctcaaccgtcgtagtataacgaaggctcaacatcatcatgaaaattcctaaattctaataaaaattccgataaacggaatttacctcttacaatctctttttttcctgcactacatccaaccgatcaatgctgcattttttaaggaactgtctaggtgtttttgacaattaaaaaaaccctcaaatcttacaaattctggaccattggatcattttgagatttgtgcaacatacctaagccctacatttcctcctccacatcacagtctgcccactgccacctccactttcacgcgtgtgaacgagcgcgagcgctcctctgcctcttgtgaagtcgctgtgccaccaccctgcctcgctggctagtcgaaaggggtcaacggtgcagacgaggctccctcggccagcctcctctccctcccccttctcttccacaaggtggcgacgtcgagtgtccccaccccgttgtcttccccgtctccggcggctccccaccgccagatccgccaccaccagcctccacctcctaaccagtttcgttgttttcccccgccaccaacgcatgtcctccgcccactgccaaccccgtggctccagcgccgcgtcgacacctcttcgcccgcccgtgtccaccacccacagccatcactctaagccatggggaaccctccccctctcctccaaccccaaaccctaatccatatgctccctgctggagttggggggtgtcgtcgcgccggagaagagggggagcctgccgaagttggaggggaagaagccgatgcacgaatcttggcacggatccaacggtccaaaatatgtaagatttcatcactaaatttctatcgaatggtatatagaaattccaatttttcaaacctattaaagtgcattctttgcatgatctcgtatttccgtatcatttgtaagttccaaacacaccatcaatacattcacaagtatatatgcattttacaatctgaatcagcaagtgccaaagggcttgtttaggggagctttagattctgagaagcaactgtttggtagccagcttctgagaatctggaaaaactctgaaacccagcttctccagcttctggcttcttagttcatttttcagaatctgtaactacagattctcagaagccgtggaatgtttggggcagcttctagcagaagcagcttttgggaaaaactgcagctgggacaagtttccccaaacagggccaaagtgagatgccccatttattttcactacctgttatattcttccattctattctagactttcacacgtcacactaaaaatcgttttcccatatggccaaagatcattttcccaggggggagaagacccgcctgtacgcataagcctgcgaaaaatagttgattttcgcaggcgacacctctatctttgcagacatcgtatccacccgcctgcgaaaatactttggacgaataaaaaaaatatatcgccaccccacccctcgcccaacccacctccgggtgcgccgttgccatcacccctcccccctccgtccagatctagaagggagggaggggatccgccatcgggaaccgtcaccgcctggagccgcgccaccaccgtcgggagggagggagggaggggagggaagtcgcgcccgggaaggaagccgccaccgcctggagccgtcgccgcctccaccagatctgggagtaagccgccgcctcctccaccctctgcgccgtcaccgcccttccctctaccccttcctgccagttcttggaggagggaggagaatcgccgccgccaccaccctcccccctcccggcggagccgccgccacctccaccctccgtgccaacgctgcctccaccgtatttgggagggagctgccgcctcctctaccctccgcgccaccaccaccgccctcccctctccctcctcatgccagatatgggagggagggaggggaaccgccgccaccaccgccctccccctcctagcgggagccgccgtcgcctccttcaccctccgcgctgccaccgccctgcggtcggatcccgcgccgggagaggagaggtgaggtgtgaggggaggggagggagaggtggaagggcgaagtgctcggacttagtattttgatggataggtggtgtttttaacatgtttaacctttttgcaggtggaccttttaaggtaccacctacgaaaatctattttcgtggatggaccacttaagaggtccgtctgtaaaaatagattttcgcaggcggataacgatctcgctccacggttgtcatttttacaggcggctatttagctccgagagccgagagctcgttgtgatcgtcgatcgtttccgtacttccagatgttggctcctcagatttcttctttaattgttccatgctttacaaagaatggcattttttcatgctctccccaacacgtacgtaaatttgataatacctcaacccaagaggctagagctgatttgaggatgatccatttaaggccgatatgctcgccgtcttacttttcgtcctttgtttaattagtgcagtggaaagtatcgttcattttatattaagaattttagaaacatttcaacaacggaggtcttttgcaggtctaatgatttcaaagacttaatctaaatgaaatactaaattgaaccaactggcattcttgaatcctaagaagtgcctccaggcccgtttgacactcacgtcggattaagtctaaatactaaattaaggcaatttaaatatttatatttgtgaagtgagcgtagcttaactggttagattccttgtgatggaaccaatccagccgagttcaagtacagacttgacatggattctcgtatttacgataaattattcttacgtcaatggcgaggtgccctctccgattcatgtattttaaaggaacccttagagcaagtactataaggccatctccaaccctccatgtcatctagtgcctatattatttaatacattatcacataagtaaaaatctgatgtggcaagggagttaatgaggtgagaggtaaaaagataatgaaaccatttctcatgcaagaaaccatttatacacaagaaccaagaatgaaaacaaggagatagatggataaaagaaaagaaaatagaagtgattgaatgagaatttaatttgaagacaccatcaattattagatatatagtttatgtacatagtgtctatatgacatggcaagtatggaactaattggtagtttctgggttagtgatggcctaagtacttaagcgcttgcctctagatgccatatagactcatttactaatgtggaagataaaagagaggagtgagtgaatgagccacccctcatacaagtggtaatctctacacaaacttcaataaaatgtgattatatttattagagttataggagtttgggtgttagagacaaaatattttatacgtttcctcttgatttatagagagatgatatagataaaattagaggtgacaaccacctctactgtaaaactactcatggagttgaaagaaagttgtcccacacattgacgagtgccagctcatctagacttgtttaaaattgttgaagataaagaataaattagtgcacataaaacgagaaaaccattagcacatatgattaattaagttttaattattataaacttgataaatggatgtatttgatattttaaatcaacttctatgtagaaagttttcgcacgaaacacaccgtttaatagtttgaaaagcgtgctaacagagaaacggaggtaaaatcttaatcttaatgtcaaaaagaatactagtgcacgctacatgacaataatcagatcaagctacatggattgcatagcattttgtcaccaacaaatgaacaagaaaagcatatatagcctgaaaagggaatggtaccaccacacctataacattcccttcccctcttcccttcccacacacagcgtatatccatccatcctaatcaaaagtgtcattttctcccacagctatctgtccccaaacacatctaattaaaagagtactattaatatatataaatgttgtaatggattcatattaattaattgattaattaaacattaattcagatctagatcgtcctcttaattggagtgctaaattaaatggcatatggttaatttcttaatccaccaagtggattgccgcacattctacacggcaccttggatactgagtactcctcccgggagtattttgatgcaataaataactaaataaatgcaactatccagtcttgcacaactatcaagggattaaattttgtcttggaacagaacagagatgcacctaagccaaagagagggcaggcaaagtcatactcctactaactcgtagggctgtcaacgagccgagctcaagtgagcttgcctgtctagatacaagcctgatacaagctctgagccgagtctataaaatgtttgagttttcagacatattcggttcgagcttgactactgagcttttaatttttaagtagaacaatgtatatttcaaagataatttttaaaaaatagtacatcatattaatagaagaaaaaaaaataaaataaactatatgacgccaatacaagtcatacaaataatatactcctaatttattaaataacaacaaaaatcatatattagtagctcgttggaagcttgaggttggctcaacaaagctccacgagctttgggagaggctcgggttcagctcgtttgaagctcaagtctagaacaagtcgagctcaagcagcttgcgagcctcagagctttttttttttttttttgtgatagccctacttgcaagagcctgaatcaatatagtgcaattatatcctggatgaattgacacatttcgatttat

SEQ ID NO: 57754 - DNA, 7154 bp, Oryza sativa
catttggttaatttcttaatccaccaatgggattgccgcacattctacaagacaccttggatactgagtactatttcgatgcaaggaataactaaataaatgtaactagccaattacgatgatgatgccggcgacacgtgagtgtgataccagccgccagtcatattgctttttcctggaaaaccattgccccaagctgtcaagttcactgctctagattctccccggtgtggtcaaatggataagggaggggtaaatgtgcttaagccacatctagggttttcagtgaattccagctgatatctatcgattcggtgacgcagctcgccggatttgtagagttcctgagagagattatgagaccagagactgatcgtttgtggaagtggtgatggatttccgtcctttctcaaccgcacaacgagcaaattaaatccgggcgaacaagcaccgagtgatggaaggagggaaccacgaagctaattagagtcccattggttggtttaattagtcaaagcaaaagctaacactcaaacttaaatttaattttaaagttgattttaagatatttttaatataatttctttttaatattgatttttaagtcgctgcgaataaatataaaaaagttttacttataaattaatttttatttcctattaaaccaaaataacttatgagaaaaatgagcaaccgatgaggctcttgcaagaaaaggagctgcacagataacttcgtgtcttttatagtagtatattgctagatggcaagagtgaggcatgtttaatctgaaagcctcgaaactaccgtattatactaactaaggtgtgtttagattcagggagtaaagttttggcgtgtcacatcggatattatataggatatcgtatggggtgttggggcattaataaaaaaaactaattatataatccgtcagtaaaccgtgaggcaaatttattaagcatatttaatccgtcattagcaaatgtttactgtagcatcacattgtcaaattatggagcaattaggtttaaaatatccgtctcgcaaattagtcgcaatctgtataattagttattttttagcctatatttaatactttatacatgtgttcaaacattaaatgtgacgaggtgtaaaattttgggtaggatttaaacaccccctaacgatgatattatttaatgggaaagcggtgccgaaataaaggcaaacccaacacaacaccaaagccaaagaaatgcgccgtcgatatgataaggtcctttcatcatgcacaaggcgctcacgctccatctttgcttcagaagtcccaactgatgtttatattggtagagtacgcagcccggctcatcaatcgtgggctatccaggttatattgggtctgctccaccacagatctaaccagagcaacaactttatcccgagcctacacaaccaaaaaaaactagtctgatgggtgaggaccgcccacattttaagtcgtgctcctccatcatcaattaccgatgtgggactaaacctaacaatctcccccgtcacatcaacccatgtgaccccgaagacttgttatccgacctccccaccatatgaccaatagaaatcgttccggttccaaacctgggctcttataccacttgttagagtgcgtagcctagcccaccaaccgtaggccacccaggttacattgggcttgctccaccacaggcccaaccggagccacgcaactttaggtcatgggcccccacaacccaaaattggttatatagcatcgaaagttcacgttttttttattttgtaacacagaatcattataatatattttaataataaattgagaaaatatatatgctattatatgatagaaaatataatgatactatccgcgtaatttgcgcggaccaccatgctagttgtaataatgataactaatgcgccgctaattaggacagaccgctagcgcgagggccatggggagcgcacggctgtaatagttaattaagcaggtggtgcgtgcccactatgaaccccctatacataacctgtatttggttttgtggatgttgtgctttatgctacacgaatctcagaacatgtatggacggctggcatcaatggcggatttgccatggtcggcggggtctcgatcccctactaccggcgttgcaatcatgggagcccctattaataagccctcactaaaatttgttgccatacatgtattataggagggggttataattttgtatagtttgttcagtccctactattagttcttcttggatccgcccttggctggcatactgcgtgtataaaacccggtcctgttgatgaagaaataaaatcgatccttatttgtgctgtcgtgagaggagaggggagggttgtcaaccgtgagaattgctacctgctgcttactcccactgcatgccatggccggatggtagcagctaccagctgctgctgtatcggggtaggcggatcacattggcaagtttggtagagctaagaagagatggccgacgtcacgtttggcgccgtgaaattggtgctgggcctcatccaggatgaggcccggctgctcagcggcgtccgtgaggacctgcgcttcatcatgcaagagatggagagcatgaacaacgtgctccgccacctcgtggcaaacaaggggagtgccgccgctgactaccagctccgtccgtggatgaagcagatcatggaactcgccttcgactccaaaaactgcgtcgagctctacacgcagtccggtggcgggcactgtggttggcagccctggacaatggtagctcgccaccgggtcgtcacccggatccgcgagctcaagatccaggcgcgcgaaatcagcgagcggcaggcaaggtaccacattgctggtgttgctcatgcccagcagatggacgcgaccaccacaatagagcgctgggatgctagtgtgcccaaccagagtcgcgcctgggccggcagctctaacaacccatcccggcgtgccatactccacgacggctggtttggcgactacatcagcgtggatgaggctctctcgcggctcaacccgttcacgctagaccgttatgaggtagagccaccggcgcggttggacagcgatgacgagcagcagccacggcctcagttgaacagcgacggtggcaaggagcagcccctagcgccgcagtcggatggcagaaacaaggagcagctgccgcctccccaatccggaggcggcaatggcatcaagcagcagcagccactgcctccgcagtcagatggaggcgacaaggagcagccgcctccttcgctgtcggatggtggcgacaaggaccagccgcttcctcccgactgcggcgtcaagcggcagctgccgccccagtcggacggtgatgacaagcagcagccgccgccccagtcagacggcagcgatcagccgccgccgccgcagccggatggaggcgacacggagcagcagccgcctcagtcagacggcggcgacaagaagcagaagcatattagagtcgtcacaatcagtgtgcaagacggcacggatgaagctgttgctgcagaggccgtgatcgagcgtttcaagagccgctgggcacggcggggactctggtcgcagcagctctgcctccacgtttctgtccatcggcctccgattctctcggagattacaaaggtcatggttgaaaagctgaaagagaaggaggatgatgagaagaatgaggcggaagacagggagtggcttggccataaattgaaagatgaagatgtgctgcttgttctttccggttttaattacccagcgttatggaaccaggttctggatttgctgacctcgatgagctgctctgactgtgcagtagtactctgcacaaacgatagtaagatggcaaaatattgctgcagcaatgactctgccaacgatgggcctcagataatctactctctcgttgatatttacctcaacagagcgctcgccctgctttcccacagctacggatacgaggaaggacacttgaaagaaattctgcgcaacatcctcgccaagtgttgccttgatgtcttctgcatgaagatgctcctccatgccctctactacaatcctgacatgacgaaacaccaactgcagttcctgaatataagccttggtaaagaatttacagatcatgggagacaggaccgaataatggccttctgctaccaagcactgccaaatagttacaagaactgcttatggtattcaaccattttcgcccgtggaagcggcgtccgaagggcaagtttaataagacgatggattgcccaaggcttgatagcccaagtgaaccagtcaagtgcagaggacgaagccgggcactgtttcgaagccatgcacagccagaagcttattgtttcttctggtcttagtggtacacgcaaggtaaagagctgcaccgtgcatccagtagtttctggcttgatcagcagggagtcttcgacagttgaggacctattgctcaacaaccagctgccacttgacttggatctcctctactcaatccggcacggcatgcaactccatccggcaaactctaatatcaaaaagttcttgaactcactttccagcagttcaaggttgctgctgacagtacttgatttggaaggtcgcaagggcctcaaggcaggcgacctccataccgtatgcaagattcataaactcaagtatctaagtctccggaacacagatattgcccaactgcccaaggaaataggtcagctcaagctcttagagacacttgacatccgaggaacaagggtacaagtgttccacacggcgctaccaatgctaaagcacctgcttgctggttgcattattgactacccaaaggaagacatcatcaagtccaaggaatcattctccacggtttccatgcctcgtgctgttgcaactatggaaaagatggagatattgtcccgtgtcaaggtttcgaacagtgctaaagaactgaacaacattggtgacaagctcgagcacctaaagaagttgggtgtggttctatctggcaagaaagctagcttgatagatttgttccttcaggttgacaaactccacagatgtcttcggtccttatcaatccgaatggatccaccaggtaactgggattctattgatgttattttattgagacctccaaagcttctggagagcctacacatctgcagcatcagaagcgggttgcctcccaggatcaaggagctccatcagcttgccaagataactctacgtgacacctttttgaatcagggtgccctcgatatacttagcatgctcaaaggcctacgctatctcaggctttgctaccattcattcgcagaaggcgctctgagcttcgtgaagtttgtggaacttgtggatcttgtcattgaagatgatattgttaacagtgtcgccttgggtaataatacttatggtggagaccctgataaacttgaaaagatagtttggtccttcactcacatggaggagctttcaggggtcagtacgctgcagagtctgacacacatcgaactcaatgggagaacatggcacctacagaatctggaaaaactgaaaagagaagtagatgaatgtgggattactttcacgctcaatccacctgagaatggccaaggatcaaggctgtaggtgctatcgtaccccataatcatcaatgctgagaaagatggaactccgtaatcctggggagtatttctaaattctactacggctgcttctactatggaataaagatgtttttcctcttccatctgtcatgttggactggtattgcacctttatgtttcgagtgttaatggcaatctcatattgtaatattgtttccattgctttcagtttggtttagttgcatcctgcattttatttctgcatgtattagctcactggaagtagtccggggttatcggaattcagttgagccgttaatttcattttctgttaggatgctgagctgatcactccaaatgtgggatgtcacgatttggtggatgggcgtttaatcagcatgctttgcatgtaaaatcctccagctttggagaagagcaaaacaaaaaaaaaaagaaggaaaaaacagaaaatgctgcagcttcacgcagcacaaaaacttttgccttctgctttttttttcagtttcgtcagacattttattcacgcaccacataatcgtcaatgctgagaaatatgcgggttgtattaattagatttatctgcatccagaagaaaacatgtacatttaatatagtgatttgagattgcttaatgtgcttctttttttaatccaaaacatgttttacatattttgcatcagcgtgcaaacgattgttgggctgagcaatttctttggacttaacttatttccccacaagacaatgagcattcttgagcctaacgtacgcgttttgaaaacttaacaccagttgctagttgtccattcctagaataaactgcacaagaggagtatagaggaagcaaggcagcatataggccagcagctgctaccagtgtgtggttgtagttacagctgatagtaaaatggaattggtaatcaaccgaagaatagtcgcgcttcctagctatccccattcgagagagttgccacgaaaagggactcctaccaattaatagcagaagatttgcaattcctaaagccatctcgcacctactcctatccaagttacagttttgctgccgcgccatcgatctctcgctctcaccagcagaaaagataagataacatcatccattcgctatccctcgccaatctaatcccaaaaagtgaaatcgcgacgtctcgatgttcaattcgaaaagcagaacaacaataatgcagctgagacgaacctgcggtgtgcttccccccttctttcgtccagctaggcgaggttcgaccccgcgcgcgcgcgctcgcgcagcgcggacctcggaggcccggatccgccgtcacggtgggggtgcttcgccggtggagctcgccgcctcgccggcgccgccgccctcaaacccttgcgccgccggccaatgcagccatcctgggcccaaaaccgccatggatgacgaaaggcgacaggccgaagaacatttgttgggctggcggacgtgacgt

SEQ ID NO: 57755 - DNA, 9708 bp, Oryza sativa
gtacatgtgaggggtagcaccgtcatatcgcgtgcgtagatgggtcaatagcgatcaaggcggacagaaaacgatcgagaattgatggaagtgttaaaaatgggaacaaggtgaattttgggtgctattaaagtgaaccgatatctttcggtgctataaaataaaaaacgtgaactttcgatgctatataaccaatttttccatgtcatatatgtgtaatccctccgtcccaaccgatgtttgtataaggccatatttggcctagctctaactcccaactccaacttacctagagctagagttgtgccaaacagtccagattctctgtttttgagagtggagttagcagaactactcctaaaaactgaactacgggggtggagctaggtttttgctgcttcacagctccactccaacccaaaagatccactaccgtttaatttttttaacatatttacacaaaaataccattgaattaccccaaacccatctcttcacctctctctccctcccacctcccaccagctggtgcccaggcgacgggtccatggtggtgctctgacggcgtgggctggtggcacacggcggcaacggacaacgcgagcagggatggcgcatgggtagcgaccggcggccggcagcgcaggcgggacaacgcacgggtgcacaggcggcacaggaggtgtgagcggggacgacgagcgggcagcgcacggtgccgacagcagcgggcgagcagcgcacgacgcgagcgggtacagcgcatgggcctcgtgccgtccgccgccgcggcgacgcaaaggcggcagtaggtggggacgacgcacgggcggggacagggcggcagcatgcgagcgacgcaaggggagcgccgtgcgggcgaggacagagtggcagcgtgcggacgacgcaagggccgcggcttgcggccggcgaagggctgcgcacgcggggacggtattagggatttttttttggtttttttcattttcagatctggagctaaaagttagccaaacacttttcaactggtatctactcccacatgagctagcttccactggagtaaaagtttagagctaggagatggagtttggagtcttatcaaacggggtctaagtacgatgttggttttttttagagggagtacgagttttttattggcacccgaaagagggatcacatacacaaaacatagccagattagaaaaataatttcgtgtggcatatgaaagatgatttacataaaacaacatcaatgcagaatattctattagcatatgaaacataaattatattttcaaaaaaaaataatacatgtaaattaaaaatcttaaaatatacgcacccttcatattatgtaaggagctgttctattcccccgaaacaaaaacacttcctgtggtagagttaggattcaatctgctgttcaacttaagaagagttgggttggttcggggttttgtcaactgtgtagccaaattgagaattcagttcatatttgctttacatgcccttttgcaactttcacctggtgtattatgcttttggatggccaaggattcctcatgactttgaggatacccttaccatggtggctggggatgatagttcgaaaaaggctaggattagatatatgttgcttgctacggtgtgctggattctatggtctgttaggaatgatatgattttcagcaacaaactcatcgcgacgcctctaacaattcctctttgcgttgcagtggaaaccaatgctgaaacctgaggaagttcctacgctggatgtgacggtggaagatgtgcacgatgacaatctgcgaccggcatgagtaggggttggttaggttgtgagtctgttagtttctctgttttctgtagttgttcattgtcgccaaggtcgctggttggcacacttggcagctgtggctgagttttgttgctttaaagttgttcccctttggatgatggttctcatgttttgctacaatgaaagctggatatcccagcaaaaacctatgcaatctctattgttttctgtaaaaaacagggccgtctggcctcctttataaaaaaaaaatatttcattaactagtactcagaagagtagaatactccagtattaagtacactatccattgagaatatatctcaagtacactgctctagacataacacgtcagggcatggttagtattgggtctgctcggttcagctagacagtggctgtacagccgcagtgctgcagttgttttagtataaatttacttggtagatcctgttggtgtggctgcagcgcagccactgctagctcttccgaacacagccattgggtacgcggcggaggacgcaagaagtcaggagcccgtgagaccggcggaagcgagacggcgcatattgcaaactgaatgagcgcgtgtcgggggagctacagtaacatcgaattggattgagtttgttaggattaaataacatattgttagccaattgttatcccttcttcttagcattagtttgttactacctccgtcctaaaataagtatagttgtgagtattcgtgtctaacatttgatcgtccattttatttaaaaaatttatgaaaaaaatttaaaaattagtcacacataaattactattcatattttatcatctaataacaataaaaaaataatcataattttttttttcaaataagacaaacggttaaacgttggatatgaacagttccaaactgcatttatttttgggatagagggagtacaattgtaagctcatttaaggagcaccgtaccgtgggaagagaataaacaagccgattcaatctattactctcatatccatttatcttttcctctcatcttcttctgttcgtctctgtcggcgccatgggtcgccgatcctccaagttaccgaagcccagacctccgaccactcattcctatcctatttgatcaatcccaggcgctcgtgacaacttgacataagagaccatgaaagaaacagccacaagtaaacagccgctcctggaacctgccgatccaattcaccgagcttcaagacacaatggcggatgcccttagtggcatttcgctgcttgcgtctaaatcggatttggccgatctcagccgttcggtcgtggtggccacctcgagcatcacatcgctcgaacagctggcggcatcttcatcggtgaagtccagcggcgctccttggctaggtgggagcgggatcctcgggccccaacccccggcaccgcatcaaccacggacttccggcgcgccacacgactcttccgcaccgacgacaggcgggggtgttcctcatttctacaaactcgaattccctaaattcgacggcaaagatgatcccctgaactggctcaaccattgtgagcagtttttttttaggacagaaaaccggcgatggcgatcgggtgcagatggcaacctaccatctcaccggtgaggctcaagattatgaggaacacaagggaccccccaaattgggagacattcaaggagttgtgtcacgtccagttcggccctccaattcgaagcaatccacttggcgaggtcaaacggctgacacagacgtcgacggtggcgacataccaggccaagttcctcaccctgtctatccgagagccagctggttcagctcttcaccacgggccttcgcgaggatctcgccatcaacgtctagctcaataaaccagaggacctgcaggaggccatgagcctcgcacgcgcctatgagcgcaaggcgtccaagcacggcggcagggccaaaatcggcggcgcagctccacggtggcacggccgcggcgacagcaccagcaccgtccgccgaaccgacggccgacacgggccaatgaaaattccgccacctgcctccggcggaactagcggaacaccgccgccgaggcctgtgttacaattgtgacgagaaattcgtgcgcggtcacaaatatgcacgcttgttctacatcgagtacgacgacttggcgtccgccgccgccgcccgccgatgacgacgcaaaacctgccgaaccccgcgtctcgctgagcgcactatccgtcgtcggcggcgacaacaccatgcggcttccagtgatgatcgacggcctgcgcgtcgtctcgctcatcgactcgggctccacacacaacttcatccacaccgagctggcgcatcatctacgactccgtctcgagccggtgcgcgacggcctccgtgtcgtggtggcgaacggcgaccgcatagtcagcccggggcgttgccacaatctgccgctgttgatcgacggtgaaatcttccgcgtcgactgcttcgccctggacttgtgcgccgtcgacatcatcctcggcacggaatggttgcagttgcagaccttggggccggtactctgggacttcaagaacatagaagaacaccgactggttgcattgtcagctgacagagacttgcagtaaactgttgagatggatcatttaagcagaaaccaatatgccattagcaaataatttgtgaacatgagaataaactggaacacagccccataccacaaaagaagggaattggagagtttatattcataaatctcaaagcggtcttgaattaatggcggtgattagacaaacattgatctcaaaaagatcaagcggcatgctccaaattgtatcacagaccataatcattaaagaaacacacgatcaccagcaaatggtgaagtattgcattactactatggacaattgaacaatcacttgtgtcactaccaccggaagaatctaactattaagggcccctttgatttataggaaaaatatagaaattttggaggatttcaatcatatggaaaaaaaatcctatgaaggcctttgaaacaaaggattgaatcctatctaatcctttaaaattcctatggaatgggtaatcctatgcacattttggaggaaaattagcaagaggtctaacctcttggaacatttcctatctctcgtcttctgattcctgcgtttttcctgtggtccaatcaaacggccattcctgtgttttttttatgttttgtaattctctgttttacaattgtattcctgtcagaatcctgtgtttttcctattcctctgttttttcgttcctacgattcaaaggggcccttaagtgttactctccttttgacatttgccatccacgacttcacacatacaaaattaccttgcaacaaaactaagggcccctttgaatcaaaggatttatataggaattttataggattcaaatcctataggaaatttttctatttggccctttgattcaaaggatttaagctttccaaatcctatgaaattcctatggaatgacacattgtatgtggattttggaggaaatttagcaagagctccaacctcttggaaaattttctttgagtctatctctttcatctgattcctacgtttttcctgcgctccaattaaacgaccattcctatgtttttcctgtcttttgtaattctctgttttacactgcaatttctgtcagaattctgtgtttttcctatccctccattttttcaaccctgcgattcaaaagggccctaaatggatttggtgcaatggaaaaaagaagtataaaataccgagggggaaacgtcttgtgtatctactaatgcgatgccaatttcatcctcctgggattcggaatcagccaaatagggggtggccagttggaccaaatctgcggggacacaatttcttcacggcggaaattttccaagtccaacactccaatatcacgatggttgttcttgtatccaaaaagatacagttcgttattatcagtgaagtaaacatgatttgccttcagctgcaggtactcttcagcgtggagtcaaagcgtttggccgtgcccaagaaacagcaagttctcgtccaagctacttatttccacaatctttccttctgtcaaactcactttatgtaccttgatcgtgttagtatcacacacatatgactcagagtcgaactcagattctgaatcaaacgagtgatcatcatcttcatccccctccggtacatcccacttcggtagatcatcggaccgccaaatttgcagtaggttaccgcatgaagcttcaacgatataaatattctcatacagaaagtccttcaccttacccataactatctttggcgcgacctttgggtcggtaagatcaaacatgtgtatttctcctaacaaagtcgcagcatacagcaacccatctttaaaaaaacagtcctcatagtcggaatacgggggcagccatgtccacttatcatcaccagcccttgcgaacgagagctggcaatacggattgtggatgagcaccacagtatatcctcctcccatggatggatcacaagacacaaatgccttgtaatagaggatcgaggacgagtcggaaaccgtcacctctcccgtgtgccacaagtatttgtacccgttggcagcagcagcatcgtcgtcatagatgggcttcacctgctcaatggtggtgaccgatggcagggcgatctgctcgccagtgatgggattgacaaggtgcaactctgatctctcatcggcgtttacaatccagccatagcaggacactatgatatgcctattaggtagatcctggagcggcaaaacgtacgccttcttctccacgaggctgtagaggcccgtcgccttggtgccgtcagaatcaaatgtgtacagcatgcatggtgtctactgtggcttgcaatgtccaaggctgcatatgcttgtgtacgcggatcgccaagaggagcagacggaaccagcccggacgaggtcagggacctccaaggtggcaaatatgctcatcaaaacatcctgtggaagctccatcagtgctggatggatggagagatttatcaagcagactacttgcacagctacaattaacttgtcctgttgttgttccttcagctgttctaggattcagaattgaatccgaatcgcttgttggcagaaaccccaaaatttgcttgcccaaacttctcacactgtcaatatcatgaatctgaactactgaaggcagcagcaacaccccagttcagagttcctccttgttttccccctctaaatccccagttgacaagcagtgattcttgcgacaaataattcttccaggtgcacatatataactcgtaaagcaatcaatctctatccgaataggagactgaagagttaatccccaactactccctttcttcgattgagcgacggattcgggcaaaaaagaatttccaactctttgccaaaaatatggcatcacataagatcagatcccagccgccattgtccatttccaatgccctgattaacaagcagagtgggattgggttgttactaaccatatggaaaatcggaaacctccggctgcgagaaggcctccgatttctcggacgcgtagcgccagccgccaggttcttcttcttccctccgccgccggccgacgtccacaccgatggaaggcggcgccccgcccgccggcggggagagaaggtggctgccgccgggataccagaggagacgagagcggcggcggcggccgggacaacctcgacgagttacacaatgcaatttatatatttgtattttggcccagtccattaaacaacaaactatatacgtagaaatttgatatatatattttttatgtagaaacattctatgtataaactattcgtgtagaaactttgtgcatacggattcgatagtacacgagtaaagaagatgtacaaacgttttacgaatacgaaagcccaattttatgcatagaaactgtcgacatatagactttatatattcaaataaatttaaagggttaattgatcagtgccactataaatatgttgattaaaaaaataccactattattcgtgatatctgctgcgtgacactaaaatttcataaaattgaaaccataccactccgtcacgttttctccgtctcggcactgacgcgccaaccaccaccaccaccaccaccaacagcggtggcagcacccccattcatcggacctcgccaccaagccacctctttgcgccgaccgcacgccgccactgccccaaccaccatacaggcacacattgtgtcacgccccgaactagccccgaacggaactagcccgtgacgctccaaattaacatgttaatcgataccagtcctaggaaacagtgctggtatcacaggaagacagaatatcacagcaatagaggtctctttattacagagtaggagtatagtcatgttgggcggcggacagatcccgagctcacaactgcattacaaaagggaaagcgaaagccaagacttggcccattcatcacaggcgcgacttgggaactaccccgaaaccctaaaactcatggtagcggacgtgctcctgaaagaactcctcgtcagcgggatccacttcatcttcttcagcaactgggggggattatttatatagagcaagggtgagtacaggagtactcagcaagccatgggaattaagtgtttgatgcaggcttcaaaggaaagactgttgtttttgcaattgattttatttaaactcctctttgaaacaactaagtgagtgcttctcaaacgacacggatgagacagtgtgtctcgtccggtcggagtatgtgcaatgtatcagtctttgaattgattcaaggttggcacccggccaacagctttcaaacggccacccgggcctggctgatcccatcagccgcggattttccaaacatcgaacccattccacaacagtaatttcacaagcagtagtcaatcaaaactacgctaggaatcacctcacatccgcccatgaccgtgggcacggctgctcgaacaatttagtaacctctgcagagggggtacactttacccacacgacattactaacccggatcacccagcccgtgcagaacggccacgtttggagaccttgaggctttcatgacaaggcatttcgaaagccgacacaggttcactatatgccaacgagaggggtcccagaccgacatcaggttaggtcccagaccatgctgtgccaggaagcccgggggttctccccagcaccaccccgttgaatccacattagctaattactcagccaggggtgtcccatttcacccatgtggtcgcacttgtcttatgtacggataaaattccaagggaaacggtccttaagtgcaagagcgggaaaccgtactcccggttcgtcccccggtctgcggttttggaaattcatttagttcacaagcaccgacccaggtgttgggttttccaagtcttttgtaaaaccccaagttttacccatcgtcggatattttaaatttgaggggaggtgttccgatgcccgtgcccgaaggcccgtgcatcgaagcacaacagttgacaaaggaggtttaagtgtccaataattcaaggagggtaattgtagcaattaggattggggccagcaggctatctcacaagctgcgaccgaattacttgtgttaaacctattcatgcaatatttctggaaaagaaatacttagatttaaattataggtgcaacatgatcaaaggtgacttgccttgctcgagatcttgagcttgatcctcgaaatcctcgcactgcgggtcttcgggctccgaaactacacgcgaagcgggacaactcaaca

SEQ ID NO: 57756 - DNA, 7410 bp, Oryza sativa
cgccacccaatcaagctctactaagctacagctctgcttcactagcgccacattgctgatcaacccagacccacaaccacaacctccctcgacccatcaagatgccatctcccatgaagccgcttagctagatcgccctcttccccagccaccaccaccatcgtctcaccaaaagagaaccggaaggagtcagccataggaggggaggagctccatcgagaggaaataggggtgcgattggttagcatggacaaacctgccatgcttgcctaggcgaagccaacggcatcatctcagccgccgccgtcatccgcgtccgctaccggtgcacctaaccaccacaaggagccatacctgccatcgtccacaccaaacgccaacctgtaccatgtgcatcagttgtctactatcgtagctgcgccgacctcacccactgccattcgccgcatcggcctctcccgacaccctcggccgctttggcctctctcgtagccctcggttgtgcgtgcctctcttggcgactaggccacaccagcctctcctgcaaccctcagctacgtcggcctctaccatcgccatcggtcgcgccggccgcttgctaccatcacccacggcaaccccaacctccccagtcgctcgctcccacatccgctcgaccacggcctagcctgacgtggaggtgttggatccggtcgtggcggtgatggatccctagtctcctgcgccaagtacgccgcaaggcccgcaactgcctctggtgcacctagaagtattgcttggacaggaacgcgttgttcaatatttatgacgattgcaatacttttatatatttattccatattgtattccctataatcatataaaatttatttgctgcacttcaaaacaaataactaaatgtggatgtgttctcaatgaagttctattgttcaaatacaattctactaccttcatttcatattataagatgtttggcatctctatcccttatctagatacactaattatatacatttgaatttgtatatatacatacatacatgaagcacgtacataaatctatgaatgaatctatttaagacctaaaatatcttataatatgaaatagaggaagtacatctttagaatctacttattaagtatttattaagacaaacactcatgagtatgaaagtatggtctatatatgagtgttgaaggttgtgtatgtgcacacattagttttttatatattatgagaagttctaaatagcacgagtagagaccgaacacatttaatcaatatcaagtttttgccttttctactccaatatgccaaccactgagcctcaacggtcaccataaatcccatttttagcactagccacaaattcacctcagcataacaaattcacaaataaatgtggtgatagagataagcaaccggcaaccacattagcagtaaaccacagccttgtccgcgcgataagatagtgtacttaattaaccccatacagttaatttaccttgttagcagtaaaccaatcattttaaaccccagacagtgcaaagtttcatattgatatggtagaaaaaaaaatacaagattacaaactgggatatcgtaaccaggaaaaaaacaaaaacaaccagcaccttcgcatgttggccacacctcacacaacctaggagaaaacacaagcgtcaagccgaccgccgctagagctaaggggagtcaaacgccccccacacaccaacttcatatggaagatcgtcaacaagttctctgacagagcaggggactagggttcgccccccgtgccacctgcacagagagacgacatggggtctgtccggactaggaatagctttgccgatctagctaggtgtaaactagtagactcctttattttttgcaagtattaagggctttctacattttcaaattttcgacctagttcaaaatttcaaaatgttttagtacaggccaaagtgaaagaatgaactctaaagaatatagtcgaacagttccagaactacaagtcagatctatacaagaaatacatcctgaagggcctgacacctgacttcaacaaattcaccaagctaaggaatcattgggatgtgtttgtcgcatacaagacagaagagcacgggcaagtgcaaatagaaaaagaataaagccaatgccgctaggaagcagtaccatcaccagctagggtcaagcggctataacaaggcagttgccaagtgggagagaatggaaactggattgctagaaagaggtattgttccagccacagctaactggcctgaacgatcaaagcattggtactatgctcacagtggaacgctcaatcccagtgatgggtccttgctattaagtgatgagattcgcgaagcagcaagctgacttatggatgcagtagaggcctctgctcagggaacattctagcccgacaaagagaaggacgagcatacgctcgcactacaaaatcccgagcatctagaataaacgcgaggaaaagacgtggttgtttggaaatatggatttcaagaggacatccacacgtacaaaagtcgcatgaggagcaagagagataccgagacgaaattagtagatcttgagtataggcttgcgacccatgagctaaggatgcaagaggaggtgtcacgacatgtggaccaacgcctggccgaacagtagatccaacagactcagccgtctgttcctcccgtcatggtgagcccctcaggcaatcgcaacaactgcgcttctacagggcaagtaggagaacagggtgcagaagctgcagcagggccctctcacgacaaaccaccctacccggttgatgaaatcacgcggaggacaccgtgtgacatgcatattccctttaggaacttatcaatcaaggtatgcgcgtagttttatgatatatgacatgtacattgcgaaagttggtgtatatgtcaattactaattaacctcgattctcatgaaggtggcgtcgggcatggccataccagtggaccaaaatgggacatttcattgcaggtcgactccaccttggtactcaaaggtcgaagttgaactggtggaagaaggcttcgaggatctcgagctagacatcccagaaggagacagggagacgaaactaggagacacagccccacaccattatactatagtgcaagtactacatcatgtttcccgggcgaaaagcagcgtcctttcctccgcctgcaccgtctcctccacgagcaccaactcctccacgagcactgactcctccgaggtctcctccgtgagcacggactcatccgatgtctccgctgcgggtatcgtctcatccatcttcaagtacccgaaagtcgtgcccacttcgtcccatgccgtcaaagtccacaaaacaaacgaagaagccaacacttaacaagccaaaactccccgctctcaagaaaatggcgtacgactgcactcccgaggagactgacaagatcataagaacagaagtgaaggcgcacttcaagccagggagtctaaaaaagaagactcctatagacccgtcagctaagaagttctttcagaagatgagcgcaccaatcacacataccttactatcggactatgaccgatcaataacgaagtcttttaagaagacaagaggaaagtccaaagatgtccctcagctcggaaagcaaccaaaacaagcagttgagccattgttaccacctgatgaaaaggagataagactatttatggcagagatgggtctaaagagggagcaataggtgggagacacacaaataaaaaaagcgacagaagtgtaaaatatatatttatacatatacatgtataatatataaacaagcagcaagtagaacaagcaaattaagaaaaatggaaaaagatctggactaaaggtggttccaaaccagaactaaagataggttcctagcagtggcaattgcaattacacattaattgagtggtcaaaattaggagttcgatcgtcactaggacaacgatgataattgtattgtatcatatacatgtttatccaaaaatattgctacatcagcaaaaattgctcacgtaggacttacgagcagtagggtgcatatgtctgctagtccccttcctaccgtatgttggtccccattcccttccttccgtataatggtcctgattcctgagagaatcacgaaagcaagtgactgcacatcatcatcacattctgggaaaggtggctacgtcccaaccactaaccattatatgccttcaaccacccaaaagtgttgcccaaaatcggatgtgatttgtaatgacaattatacatggattttttcctcatgtatttgcaagttccaaggcgtttaaaactgtacagataccatatagaatgtgtcaaggggaatgctcaagattgaatcccaagttaattgtataaacaagccatctttcaacctctggatgacttctagttttatcctcatactactgtaaaaaaaaaaggttttatcctcaaactaccgtggaaaaagagtagaaaatatagtttaagttcagctgaaagatggagaagtcattttgccccttaagaaaatgcccccttatttcttgtattttatctaaacggttatgaaaaattttcaaacaaagtaactaggttcatgcccgatatatcactccacacacatgctctggacgttgttgaccaaaaatttgtgctcggccgatggtgccggatctgtgttggcgcgaactaaattgacgaacacaacggcctgggagatctgcttagctctagtgcaggttcaaaccttggtgagatgtgggcgtgccagtcaatttgatcctgcaactgacaagatatataaattaaagatcaccagagagccgatcggctgacaagctgatggagtaattctagccgataccgatactagctgatgccgatagggttttgagcaatcagctatatgtccaatgtagatgattatataaagacaatcggctgatgagaataaaacaacaatataatccaatagaaaccaatcggtgaacaatgatatgatagaataagtgatccgatggttaaagcatatatcggttagaggtccgatatcattaaatcaaaagattagataataaatgaaacttttgttgcgatcagttaaaaccaacttgtatacgatccttgtaagccgatgcaacgtccaaataacttatcggctaaaaccccgatgaaacccttattataataaaaacatgttagcctttataactctaagcacgactagaaatgatgcatcgcaaagtatgcgaagaagtcataaacataatgtgcataagagcatacatactgatccattgcaaaccaaattctaaattcgtatggttgacggaaagaaccgatcaaaacagaagggacaaccttgctaataatcgatggtactattaacataacgatcaatcacataaacataaaaaaaagaatataaaatgcagtgatgaatttttttctaatacctgcaaagcatataattggaatagtactcatgatcagatattacacactaatacaagtttttgaattttcttttatattaatgaagacttgcgtgcataaacaccactgtgcaagtacacatccataactgcgtaatcttaacacttgctcaaaaacatggagatcagcggcactgaaatttagttaaaagggcacacacacgtgtgcagtatggaaaaatgggaataaaaacttagaagttagaactctactagactgtgtttagtttctaaaattagagagaagtttaggaaaagttaggagtttggaaaaaaagttaggagtttatatgagtaagaaagttttagatgtgatgtgatgtgatggaaagttgggagtttggtgtgaactaaacaggtcctagataaaatcatacacttattactccaacacatttctaatgttgaatgttcaaatactcacgtgcctgaccaagccattaaatggaccatcacatttatgagtgatatatggctgctatgaactctgaagtatcgacattactgtattttagaaggcaaattaacaagataaataactttttaatggtaaagaacagaatcccgtccatcattatccatgtggtatcctcgcttgcttctcgcacacacaccacacgtcggcgtgtgacgatgctctcaggtgatctacgcatgtgtgtatggagtatggacactcacacatgcgggctttagggacttggcttgtgatacatgtgggtcgtgctaagccacactgtgtcccttttctactttttttattttatctatttttaagttaaactcaattacatacaaatctaaagtttccaatcaaacatttaaaggttacatgaattgatagtagcatgctatattagaatggtacccacatgtaccaacacctgggtacatcaaacttggtatcaacatataccatgtctggcactaagtattatgatacctataggtataagtaatgatacgtgtaagtattttatcgcgagcgctaaacgagccaaggaaagcagtgggctagcaacccaacaccatctctaacactaagaactctaaccgtgcgtgtgtgtgttatactcatccgtggcatgcagccttctctcgattctcaatttaactcatccccttcatctactcgtcacctcatgccgctccactcagtcaataatctcaacatttagaatgctctagctatgtgtttggttgattgtatggaagcatggaaccaatttgcagttacaatgtgataaacacataatggaactagtgatacatttacttttatgtacgcaggtttgatactcagattgtatgcaaacattttcaaacttgaactaatattgctttgaatgtgttgggctgttagctcacaagtttaacaagccaacaaatgggtcaagccaagttaggcttccagcttgttaggataatgagccgagctaggttggctcgatatacgaacatatctctagtgatgaatgtaaatatgtgtgccaagtaccagtaatgatatgtataagtaccaacaatgatacttaataggtatcgatgatgataactagcagtgatgatacttgatcatatatattaggataccaggatgatatggaggtttgtcgagatgtgggcaagcaatatgcgcagctagctagcccacatcatgctcacgcttttgtactcacacaagcattttcttcatttgttcataccgacgctggccacaactacctagctagccgcggagtacataggtaggctcatgtaccgtggcgtatgcgtgttgggcaactcgtcgagcatatgcaaagagccaaagatacctcgtgactatgtgagaactattccataatagcatctccaaa

SEQ ID NO: 57757 - DNA, 616 bp, Oryza sativa
ctgcaccccgttttgaagttcagcaaataaatcttatatgattatagggaatacaatatggaataaatatataaaagtattgcaatcgtcataaatattgaacaacgcgttcctgtccaagcaatacttctaggtgcaccagaggcagttgcgggccttgcggcgtacttggcgcaggagactagggatccatcaccgccacgaccggatccaacacctccacgtcaggctaggccgtggtcgagcggatgtgggagcgagcgactggggaggttggggttgccgtgggtgatggtagcaagcggccggcgcgaccgatggcgatggtagaggccgacgtagctgagggttgcaggagaggctggtgtggcctagtcgccaagagaggcacgcacaaccgagggctacgagagaggccaaagcggccgagggtgtcgggagaggccgatgcggcgaatggcagtgggtgaggtcggcgcagctacgatagtagacaactgatgcacatttggtacaagtgttttgggggggcccgggatttttttttttgggggggtgtgaagatggaggtatggctcttgtggtggtaggtgcaccggtagcggacgcggatgac

SEQ ID NO: 57758 - DNA, 49209 bp, Oryza sativa
  unsure (1)..(49209): unsure at all n locations
cggagtgcccggtggtggtggtgggtcggagcgggtgctgcctgagccacgtcgtgaagcggctgctgcaggggctcggggtcaacccggcggtgcacgaggtcgccggcgaggccgagctcgccggggtggtcgccggcggcggcggcgtcgcgctgccggcggtgttcgtcggcggaaggctcctcggcgggctcgaccggctcatggccgtgcacatctccggcgagctcgtgcccattctgaaggaggccggtgcactctggctctgaatcaacaacgcagtagcgatcaagctgttttccttttttttttctttttctctcctattaggttcaaatcatctgatgcttttagcttcttttttttttcatggcattaataatggtgttgtaattagataggacgaaaaacttgaattcttttaggattttaataaggatgattaggagaagtgtgtgtccgttaacgctactgtacttaattaccttgtaactagtacctatacctattttcgaccatgtaaatacgaatgggagaaatgaagagaaatatttgcggtatttacttgtcccaaattcccggtgtttttccggttgagaatctgatgctgcaaagaaaaaatattgctgcacatgcgcttgcaaacatccctttctcttcctgaatgcgttgtcgccgctaccgtgcatgaacggcagcgtattggatgcttgtaattcatggccggctgttggttgttgtgcacctgtgctaatatttttcttttcctagttttgatattctgatatcacaattatatatttagacttccctcaaaaatttatatatttagacactattgttctaaacatatggagtaagtactaaaccttaagtttgattaatatttgcacctctctatatctgtcactgacattttgcagccacctgcaggatttaattcaactaaatctgtagcaatttggaagtaattaagccggacgcaggcaagcctgatcatcagcaaagagaatcaagcttcacacgttggcatgtctgtccatgagcttcagatagcagcattattccacgtcaggaaagcagaaaaccttccaaaactaacgagacacaagccaacctgcagcgtactattgtagtacgtagttgtaccatgtaagaaaaaaatatacaatcctatggaattatagatgttcatattctctactccacctgatcatgcatgcacggctaggccggtgggaaaaatgacaagaggcgaggcacatgagttgtcataacgtcattaacaaaaaccacacgaaatgcatttatatataggtgtcctttttcttccttgctgtcaaatgcgtaccaaataaatcatgcaatagtttggataccctacatttgcactggctggaatggcactagccaactacctaggatcagtcagtcccaaaaatcattatctagaaaaagttagtcccaaaatgaaaaaaaaaatcttgatgctcactttgaatttttttcacacattatgtggaacagatatcaaactgcaacagagaatgtgaatatgcaaaaattatagtggtttgttcgatttgtaggattttcaaaacataaaaatagtatgagaatatatatgcaaatctaagaattgtaaaacataggaaatcctatgcaaatctaagaattgtaaagctcgagtggatttttttttttggtgtgtgtgtgtgttttacatcaagtgaagggataaaatttttctattgtcgattcctttgaaacaatggtagttttagtgcccatttcaaaggatggtataattctatacttttccttcacaattttctcttaaacgaatgagccgtagttctttcgccctgtgggaagccgcaagctggcatgctacaaacctactacaaactgattgctgagttatacgagatgctgattgctgagtgcgtttccctatcatccctatggcactagggcatgaagacagtttacgtcgaaaagtaacccaagtacaaataaaagaagacttgactgaccaatcgagatatttttatatgcatctctcaccgtcccataaagtcataacagttttggagaagcaattgtacaactcaattcttcaaggaaaattgcatgttatgatcaggaaaatgcccttctgttagaagtgattacagcaagctaacacgtcactatcatcacaaattcattgagattttcagatgagctcacgccagagtaaggacgtttacagctcaagaagcacgtggcaagaaagataggggagaaaaggaaaggcggtgaattacaatcaagaaattcagattgttttcaggactgcaaaactttagtgcatgactacatgtctgtgagactctgaccaatcaaataaataaaatatatatggtgtaagaaataaaatgcaaatggaaaagactccgtgttaaccagtccagagtaactgacaaatacatgcatggtttcagtttcagcttgctacaaattgtgggcggtggatagatgtaattatgtaaaagcttaagctaactcttgcatatgattggcgttatgaatttttcttggtaggcatactaatcgcgcacacaaaaataaaataaaataaaaacaaatgatgccttccagaattcagattcagcaaagaaccaaccatgagacgtgctgacatatcagtggcatgataagagcgtctcagcttaacaataaaataaacaaacaagcatgtcgatgtaatccgatgacgattgcaaatgtacttagtctcatcgacgtggcacgagcaaggccacagtacgacgtgagataaagatctgcgagatcacgcagtgacatcaacatgtttgacaagttagctagcagttgggcggcaaatagtgctagtaaatggtttgcaaaagacacctacttgacgtcacgactttgcatatgtactcatcaatatacgtcatactcatccttaataaaccacaatctcccccttatgatggtttccagcaacaccctaagtggatgactttggctacatctaggatctggtctctttgttcaaccttgtcaaaaacttcggttcagaaatctagatgccttgtttcttaagtggattgttctttttgcactaattccatggaatctatttctccttttccaattagctgtgaatattggagtttggccgaccacaacttccttttgaagcttattatgaggcctaaagaaaaacgggccaccttttagcgttagggacttgagtgaaacagaagcgtagaggaaagaagagataagctatggtcaggcagaccagctgaccaggtggcaggtgcatatgttagtatggaatacggtgttgaatataaaaacaaacaaacttggaggcagtcaggagtcaggacgcaggagaaacgtgtttaaggtgtaaagtatggtaaaattgcatggcttaaagtcagcaacttaagtttctagatgaagtgatacagaatttggtattatggtaacatagcctgccattttcttttttttaaaaaaagtagaaattatgtagatccatttgagtaccgactttggggtgtggattctactccttctgttaaaaaaaactaatttaatattggatggaacttttcctagtatgttgttcagattcattgtactagaaaaagtctcatccaatactaaattggttttttatgggacggatgaagtaatgcaaaagagaaccatcaaattaaataaagtatatacacactatttccattgaatgctatgaattgatctacaatgctgagttcaagtatcttaccaaaacacacagctgaagtcatgggatgggcaagagtcatcatgttgtcatgcagatggcccatgaaagcaaccagtttggctgcaggccacacatagcccttggagtgatgcaagagccatctctgtgtatatcctcataataaaatgcggatttttcatggacagggtgtcaagatatgctcacatctgcgaaccataaacatgagagtaaatggcgatgaacacccaccaaaataatatcattactgagcaaatgatcaaggcaaaccccccaaaaaactcaattgtatttctttttccaaattaaatgaaagtgccagcaacaaactttcataaaatccttgtttttcttatggtttatggatcataaaattctcagtagcaagggaaaagacagataggactctcacatttacctttttccacagagagctggcacatcatgttccatcataatcgtgcattagtctgtttgatcctacaaatcattggcagggctgcagcattatataggaaaaaatctgaatcggttagcaagcgctactactaaaaagaagatagcaagtactaacaagcagaaacagtcggtggcccaaattttacagtttggacgatttgagtccattttagcccctgtcggctgaatagcatgtagcatgaaagataagcatcagtatgaacttgaatacatttgtagtgaaaagaaagtaggtaagtaatacatataaaacatggcatggataaaaaatggagaccagactgttagaattagctccgtttcagtaaaaaacaacaaagtactccatccgtttcacaatgtaagactttctagcgttgtccatattcatatagacgttaatgaatctagacacacatatgaatctagattcattaatatctatatgaatgcgggcgatactagaaagtctacattgtgaaacggaggaagtatgctacaggatacacaaaggtgactataatcagataatcagttcaagaaggcacatgtagatgtaggggagctttaggttttacagcagtaagcttcctgcattccagtcattaagcaacagtgtgacaccatagcaaagtctttgccttgaactaacacgtgcagagtggaaaaagtggaagccatggggtgatgggggccaggcttttagactatcactgtatcaactcttgttccccagtgaacctccatactgattggtatgtgagcttcaaaagacagcttcctgaaagctataaactagatcttgaagtcaacataagtgcaatgggcttctgcgctgcagtaaaggatccaactgaaacttcatcatggcaattgtctctagagagaatcaaaccatgaatcaaaatcgtccgacgcatttgagggtccggaattaggaggaacactgacacttgagatgttgtctttgcccttagcagatgtagtttgtttctgtccattcaagcacagtgaagtgtcagtgagcaagtcgtccaccaaatcatcaatagatgtagatatatctatctggttagcatatctgatgtcaatattgtggtcattcttggaagttgagcctggttcagcaaaaccttcattctggacagaaggagaagtctctgaaagcaagtcatctagagcatcgtcacaagcagcagtcacaagcagcagtcaccgatgatttggatgaagtgctaggtgtaactttcttatctggttgattgactttcacatcttgcaatgttgatttgtttccaaatgattcatctaaattggagccagaaagatgagttccaccaagcgtattaagaagcatatcaagttcttcttctgcagcaaccacctcaaactttgccccttcactattgttattatcttctccagtgtccaaatgcacagagtgagaactagtcttgggtgatgatgtggatttatcttcttcaaaacatttcaactgacaatctgctttcatttgatcatcacaacgaatgctgtcatggtcatgaatcaagctgcctttagcatcactatccacatctgtgcctctttgaatctgtatttgattgacctcagatgcaacagcctataacaatcaggcaaaaccatgaatacacaatgaaaaaaaaaatagcaaaagaaaatgatcttaatggcaagtaaagtaggcatatacaaagcttgcaattaaaacatcaatagataaaagcatccaaggcagggagaaacagctaacttactaagatgaatactaacagatcaaaaacctttatgaaccaacgacctaacaattgcatgaaccatgcacaaagctaagtaataagggctctaaatcatcccagttggctgtgtatatctacatgtgggtatagaggccagatttcagtccattatctaaaaataattccaatcgtcccagtacaataggtaaaatagacatagtttactagggtttaaatacccagtgaaattcattactctatctaatcctatgcagatggctattgtactgtacaaaaaataatccttccaccactcagaaagtttggaagctaaaaataagctatgtggctgatggcagaactaagagatcgtagtgcagacagttaccatgatgggccactggcaaaaggtgcattagtgaaatatgaaaggtagatatcaaaccatagtgtggttaatgcacaaaatagagtgcctagaggaatggccaataggcagatggatatcaataataccagcagcaaatatcaaccagagcattgaaaggctgcattgcaggcagacctgccatggcaaggcatatgagctacaggcattaacagcagagattaacttgtagcaagtggaggtcaaaagggtaggcacctaggtgatgatgactactacagatcaaccataagggtaccagcccaaattgtccttttaagggtttgttttatcacatggaaatcagaataaggaacattgcacattttcattgtatacagattgggtgtcgccatagacccgtagacacttcaagaataatgtttgcatgaagtaagttaaacccctacttgaacatagtgtaaaggaccgtttgttcataacgattttttaaattgaactttagaaaaaacaaaacaagggtatatacaatttctcacggaaaagcaaaactacagttacagtttactaaaagtagacaatgtagcacatgatcaaatacatttgagtacttggaaaattagcaaaactaaagaaaattgctataaacagacgtaccagatcctcaggtagcagatctttctctaagaaaagcctctcagaaagcttaagcttcgaaagatgggtggccaatgcatgcagatccatggagagaaaaggtacctaaaagttgaggggaaacaaattctcacataaatatctaaaaatgtgatatgaagctgcccaaattcacaaggttttaagagttgatacacaaattgtaaggtacataatcaaaactacatgagggtctacaaatcaaaataaagtctaaattccacatccctgtctgttcggactactatcatcaagctatccagacaaatttcactctgtaaactgacaatagtctcgatgcaagaaacaaagagaggtttcagtcatagccccaaccatgctcaaacaaaacattttaatcatgtacatgtcattcgtctcactaagaccaaacattacaatagtttacttgatgtggcagcacaagacaagtaacaaacgtaatatcacagcaccaaattttacctcgaaatcgggtgctaaatcatcttctaagatgaagttgtcatcttcacaccaggacaaaatctcttcccctttagcttcaagcatagaggttgaagcctgcataaaatctaaaaaaaaaagaaaaataaaattaacaaacttagcaacagtggagaaagcaatcacaaatagtaggcccacttcccaaaggacacatcacatgatcatcatcaaaataaccgattacagacatcaattttccaaaactctcaaaccaaaatgtaagttgtggttatatactaactgacacagcagaaactccgtttgaactacctagcggcctacgagatgtatgctcaactcaaattctataaacaaaggagtacctcatgatgtttggtatgctcaactggcttcttaagtgaggtttaatatgactaagaacaaaatatttctcagtttagctagtgccctcgtttcgtgtgatcgtgtctatgtaatggtaagcaaggatcgcagttcatgcttgaagcgattctcccgatgagctttgtcaatgaggtagtggaggtagggtcactcaccgaatggcgaatcctgggaggagagacgctgcgcctcgcggggctgagcccgagcctgctcgagcaggaagccgaagtctgcgcccttgctgcgcggcgccacctcgccggtccactccgagggggccgcggattcatcggcatcgtcctcgccgtcgtagcggtcccagttcgacgggaggttgcggccgcgggggccggaggcggaggcggcggcggcggcggcttccgcgcgcttctgcctgtgagcggcggcggcggcgggagtctggtgggcgcgccgcccccgcaccgtgtgcgagcgcttcgccttcgccgccgccttgggatccattggagggagaagggagggagagggtttcggcggcgtgtttttatttgcagttaagtccctgtaggttcgcgattatttcatctaactccctgagatttgggggaaagtttgctttaggtgtctacttgcatatatttgttgataaattttcttctaaaaatttaatagtattttttaataaaaacatatgtaattacattatagcctgcatgtaattataatgtaatgaacctttagattttcaagagtttaaggaggaaaagaaatcacagcgcacgcatactattttactataaaattgatactcactaacttttaaatcacaatatataagtgtgtcgcatcatcacccaataccaattattatatatagtattttaaatcatatgtaagtgtgttacatcatcattcactagcaattattatctagagtattttaaatatcatgcaagcatgacatcattacaatttagttattatttctaaaactcaatatgcaagcaatcaaatcattatcttcacatcattttcatatttatcaaccatatatatctatcgtttctataatatataacatgcatttatttatctatgccgtaataaaacgtggggtatcaactagtatgtgagaagattcggccccacgaccttcgtttcacgaaaatattatttatgaatgattttctaaagttatatataagttacattataagtacatgcaaattacaatataattataccatgattgttgtgctataattgcatatatcacttttttttaaaaaaaaattgtcaacaaatagtattagtactatataggtagtccttcaggggtgtgtttgtaatttaaaactttatcgagggcctaatgaggacgccgactccccgccgcgggatcggctgccactccagtcccttcgcttccgaggcttgacggcggcggcggaggaggatgcgcttcacggcgtctccggtggtggagctgccggtgggcggcgcggtgctgacgttcgagcaggacaacgactccttcgaggtgggcacctccgtgtggccttcctccctcgtcctcgtcaagttcgccgagcgctgcctccgcgacccggcgctccccttcgccgacgtcctccgcttcccgggcacccgcgccgtcgagctcggctcgggctgcggccccgccggcctcggcctctcccgcctcggcctcgccgacctcgtcctcacggacatcgccgcggtgctccccgcgctccgccgcaacctccgccgcaaccgccgccacctcccgcgcgccccacgcctcgcccagctccactggaactgccccgcgcacctcgcctccctcgcctccccgcgccgcttcgacctcgtcgtcgccgccgacgtcgtctacgtcccggaatccgtgccccacctcgtcgctgccatggacgtgctcgccgacgccgaccgcggggtggtgctgctcgggtaccaggtccggtcgccggaggcgcatcaggccttctgggacgccgtgccggcggccttcccggtgatcgagaagattccacgggagcatctggacccggattacgcctacgaggaatccgatgtgttcgttcttcgcaggaggccgcgacagtgaactggtgagcaatttgcttaccatttgctcctcaatgactctgcaggtttgcaagaattgtttgttcagctccaaagttattatgatcatttggttgtgatagaaactgatgaaatttgcctcaatgtgttgatgcagtcagtggattagtgttagccgatatcgcgacggattcgaccgcgttgatgagtggatctctgccatgagttatggttgacgatacattttgttgctatttttgctactagaactctactagaagagcatattaagtggtattgatggatgttcatgattgattttcttcgtgctgttctgtgattgacaaaacaaaaattaacttgtagatttatcctcgctgaggatatccatgctcaacctttatctgtcagtttttattcgttttatggttgctacctttctgtctgaacttgtagaaactgtgaatgcttgtcttgatctcttcctaatgggctaataactgataagatatcagaaggtgtgacattatgcatcgcttcattgtgttttgtgcctgcaatgtacagccgatctagctcaaactgattacattggcacttggtagatattgctattgtggtttatgaaagactggtagtttggtaccgtgtaatgcttgaacttgtcgcttaattgtagactagtaagaattttgcaagcaccaattctgctgtgtctgtccataagcttgaaaactgaatgtctcaatgcagtatgaagcgtgtccaaggatgtgtgcatgaggtggatggggtttccatttggcatttttattgaatgtgtggttttgtgggaatgagcacggaattcgcaaccaaaactgacactccattctccacgcattgttcatttcttggatgcgtgatgtagatgattctctgctcattattcatcgacttgtggctgaatgttgaaaccaattgtagtcctgaatggatttgctcatatgcataggtccatcaagcctgtatggctgtatgtatctcttcgctttttagggatataatgctgaatgggtttgcacagatgcattgatgtccagttgaatgttgaaaccagttgtgatgctacttgcaggcatcgattgctggaacatgttttgtttcagaggaaatccgcgaagcactgagtgctatggaggaacattctgcagaggattcaaccttatgatgaactatttagcgtattttctgtgggtcccatttaccacgtcagcaaaaaccatttcccaaaacatcgaatgagttgatttataccaggtttctaagggactgtttggtagagcttcaactttgatccgttggtgtcataacgtgtctattggtgtctgtatgctaattatacttagatcatggtgtcatatatatggataagctatttagctataggttttgccaaaagtcgttagtatcgcctgacacctgccattatactatagatccgctcctgctcttccatttagctctaggagctgggtctagaatggagttgtggaactgcctaaactccacttcacatctctagttcattttgtgagagagttccacttagttctgctcctattttagggacatttaactatttgtcacttttaagatgtggcatctaaagatttgccacttgttgtctattacatgtgggtcctcatgtgcctataacatgtaggttctgtggcaaatctttatcatcactcataagaggggtaaatagttaattattcctctattttgggtggagctaaaactgtttggttgagctctagcttcagaagaagtgccaaataggctctaagataggggaggccttatacctggttttacggtcgagggaggttattcgatcagaagcaagggaggagggaggccggtgggcaaatccatttttaggtgggccaaatggaggcccaactttgtgtggcggtatacaggccgtgcagttgggctgggactccgccttccacaccgaaacggcccacgcgtaccgacgcacctcgctcatcccatcctagccgtcggttccaaatctgacggcatcaaggccctccaggccgtgctcatataggtttcctctccacctccagcccggactctcccgatccttccccaactcggcgtcgcgccgcctcaaccgaagcaaggtgcgtctcatctctctcgcaatcctctcctcctcttccaaatccctcgccctcctcctcgccttcgaaaatcgaggcccgattttttttttttgttcttcctcgcaggagcaaagcggggattcagaacgggaaggagaaggtccggttcgtccgctctcgaggttcgtgttcgtcgcccaaaccctaggttccctcccctcttctcgtttgtcgatctatgtatgttgttgcggtaggttttgatttttttttcggggttcggtgtgaacgatctgtgcctggttgatttcggtatgagagatgcaaatagaccgtagctgatgaaaaccgtagcagatcgaggctgctttgctgctactgctgctgtaaatttcctgtagatttacgttcgggtgtaaatattgaacaaattgatgcgattttccattggaggaaattgaatctacggtgactgctgctcacggttgctgctgagtgctgcttcttgcagtggggagcccgccatggttggattagatgggcggagcttgttttgtgggttacatgggtggttccttcaaccggccaaatcattttttatcatcagtggatggaagagacccttaggctagatatgtagttatgtgattggtcggtgtattacaaattatgtctaggtttctactgtttcattgtcttgggttgttttcttcgattgaagattaatgatctaaaatggtttgcagcttaggtttttaaaacggatcaaatagtattctttgtcgggcggatatttcaaggcctactccggaaggaatgcccttgtgcaacaggcaaaaaaaagtgcctctgtgccatgttgtttgatcttttttgcagttgcaggggggagaaatactaaactttctagtggaagagacacctctatgttgttaacagtgtccagatataggttaaaacttatcatgagcaacatctagcttcatgatttcttgaagtggattacagtcgtttgtttttgttctttctattcactttgttcttctaatattaacggctttgaataagtgtgcagattaggttaaaaggtactgggattagggttttcttgcgagagctttataatgttccaatcacacactgatcgtttcaggggtaaagtcacaggaatcatacttgttggtgatctcaaaagttaaaaatgataacatatgaacttgtttttatttagcatatgctccctttgttgtctactttttctgtatgtaatgcgctatgacgactctaaatcgaggtatttctttctccctgtagttaccagataagccattcatatacatatatatagaagcacttcttgagatttggacaataaattctgacaattttttttaatctttttgttatgtacagctcaagtgtcagttgaagtgttttgaaagtcatggcggagcatttggcttcaatatttgggactgagaaggatagggttaactgccccttttacttcaagattggggcttgccgtcatggggatcgttgctcccgtctgcacaacaggccaactgtgtcgccgacaattgtgcttgctaacatgtatcagcgccctgatatgatcacaccaggagtcgatgctcaaggccaacctattgatcctgaaaagatgcaggagcactttgaggatttctatgaggatatctatgaggagctgagcaagtttggtgaggttgagaccctcaatgtctgtgataaccttgctgaccacatgataggcaatgtgtatgtccagttcagggaggaagaacaggcagtcgctgcgcataatgcccttcaaggtcgcttctactcagggcgcccaataattgttgagtattcccctgtgactgatttccgtgaggcgacctgtaggcagtttgaggagaacagctgcaaccgtgggggctactgtaattttatgcatgtaaagcagattggcagggagctcaggaggaagctttatggggggcgatccaggaggagccatgggagaagccgcagcccaagcccacgccacaggaggggcaatcgtgaccgtgatgatttccgccgtgaacgtgatggttatcgtggtggtggtgatggttaccgtggcggcggcggtggcggtggtggtgacggttaccgcggcggtgatagttaccgtggtggtggtggtggtggacgcaggggtgggggcagcaggtatgacaggtatgatgatggaggaaggcgcaggcatggcagccccccaaggcgtgcaaggagcccagtcagggaaagcagcgaggaacgcagggcgaagattgaacagtggaaccgtgaacgggaggaaaagccttgaacgaaagcagtgatatctctatggatggccggttcatgccttcatggcaatcactatccgctggagtcgtggtgtgctgctatgttctaagtggatatttagtgtgtgtcgtttggtactcatgcttggctgagtaacccttttaaatgcaggattctggattctatttacattgtgtttcgtttgacgtgtaaaccgccgtttgtttttaaatatgcaatattggatcttttgtcagtctattatcctgtcaatgcgcttagaaatctgtgattctctactgaccatattgcttctcatgttatagcggttcaagctggcacctgttgtcttggaaaaaagaaccccattctttcttttgctcgtttcaactttgctgcctgttatttgtttggccttttgctacctgttgttgcttgaaactctataagtgtatatacttacgtgctgtacgctttgctcatagcagcctcaaaagctatacgaacgatacggcagcacgcagttcatggagtgcccgttgcaccagcagataaaaggcaaaataaagcccagcttggactgaacacaagcttcacatgaaattcgcaggatcaccccagaaaagcttaattcacagaatctcccaaaaaaagaggaaattttgtttttgttttttttaaggaattggggcatatgattatgtgaactttggccgagtttagatccaaactttttttttaaacttttaactttttcatcacatcaaaactttcctacacacacaaacttttaattttttcatcacatcgttccaatttcatccaaacttccaattttaacgtgaactaaacacaccctgagtataaactctgggcatacaaaccgaannnnnnnnnnnnnnnnnnnnnnnnnnnnggcatatgagctgggaatcctcgtaatattcctctttggcatatgggctgggaatcctggtacgacgaataatcgaatatccctcttcctgtgtgtggtactgtggttctccacgaaacaaggaacagtctggctctcctggacgaaatcgcaaagcaaagctggggctgtgcagtgcagtgtgcagctgctgtcactacgccgtgtgctcacgccgttgtctcaaccaatctcctctactactgtacgcgtgccgctgccggtattgctgccaaaaccagcacctcttcttgttctaagcaaaaaagtcgccgtcttgttcttcgaaaaaagaaattatacactaccgtgtatagctttctttgagaaacaagcttgagataaactaaacattattataagcaaagtgtgttacacttttcactgacgtgctagtgacaaaaccaattcgaaaccagaatcacttcgcagtgccaaaagctggggcttttcttgcggggaaaaatatatgggtgttgtcatccatctgatggctatgctagtgaataaacgtacttcatcatcttccggatcgtgatatggagtaattatgtttagctctagtatttgtctacgcgtcgtaaaaactgattattattattattcttttttttttgggttgctagccgcttgtgacaattgccatgacggcattgcattcttggaagttggatatgtgttccgcgcagatataaagacaagataatcagataagcatagtacttaaccattgaatatatcgtcttgcagacaaaatacatgatgtttctactcttcccttaacgatggcaaacgaggggaaagagcacatatagtggttttcttgatagaacgatgtatattttcttttcaaaaaaaaaaaagaaactatcgtcggtggctagctagtacggctaagtatgcgaaggttaagagaaggaacaatggtagcttatgaagaagagcgagggtagcggtgtgtggaggagagcattggcagttagagggtgccggcggtggagaagtttgttgtcgccacccatacctaatgaagttccttacatttttctcaccaaatagttctgacacgtggcgcactagttattgtaaagaatggtaatatagcttgttttatataaaagaaaaatttgagaaatatatgctttaaagggatacttggttaattatagtcagatcaattttattttctactattcaaattttatgaaaaatatatatttggatgaggataacttgtgtcccgttgtctcatcttttcatctaatgctcaagaatagggctgaactagaataatctacataaatttgttttattcttccttttttataattttaaagtacaattttaatggatatctggacataggggtagggtctagtcctaactatcatactcttatatccgcccccgttttcatccttatctatatcaatattttttttgtcttacgtaggtaagtagggttattatagttatttgtgtatatattgtttgaatatgtccaaaaactttagaaatataatcattttgggggttggaggaagttaaaaaagagagaggaaaatatcagcgtccaaaatcattgtgcctcgagtgtctcccgtacgtctcgcctcgcctgcgccgatccccatctcgcgagcagagcagggaagagggaagaggcgccgtcgtcgcgctgcatcctggtgagcatccgcatcctcttcctcgctcatccgtcccttccgcccactcttgtctcgattttgctcgcgttaaccctagcttctcttctagatctggaagaagcttttctcttaatttcggagccttaaccttaatacagcttgtttttcctccacaaaagtttggggggttcaacttattccaagttggatccgccactgattagtgagcaacttttagttcggagggtgaatggaagataaactttgacagctatgagttaccactgataacgtgtattgttttggtgagttgagtgtggttttatgtggaagttttctgtgcttatactatgtaatgcttaaatgtattatgagacacttatactttggtcactttcttgtgggttgtcagttgaagtgattttttctttaggcttcttaaaattgtcgccagtagatgaaccattatttagatgagcatgataagaattggttttctcagggggaaaaaatgcatgaaactagtccttttttgggtacagttctggtgcttttatggaaaaatggagttgtgataatagtttcatgtcattaatactttagaaaacttctgtgcggaataactctcaaatgcatagttaggaggagatactgtggattggataagtgtgtctttgtgggtaatgttgttcaaaacttgaaatatcagtctatatgagagcagcagcctcagaattgccttcttttttgttttatgcaactgcgttcttatggttcataggtggtttcacaatggattacactgtatatgcaacagcgctgttgactgagtatttgattttactgcaagaatggcttaagttaataagtaacacattgccttggaccctttgattgacgcaagtaaataatagtgactcattttttcttttgattgcaatttgcttacccagtctcttatttacactgtggtatgatatctatagagttgattattcagatggctgcacattgtcattttactcttttctgatatagcaaattatctcagatgtcaactgttatgtgccttgcctccttcatatccctatactttttgagcccacaaagttattaaaatttctaagatattgagcacacagagcatttagtcatggattcaccaaggcttttagatatactccagttttattctatgcttgatacatgtgcataaggtataagagaaatttattatgttgttaactgtttcttttacgatgagatggagtactactactttgaagtatattgtttttctcttattcaaagccttccaaaattagaacactcatatgcttgctttattggtaatgccattttattgttgtcatataaatgttattttaaaggcattagatttgttacatattcatcctctgatttggatataatttttatcaacattgacacccatcaagatcaagattttcttatggttattcatgttatgtctgttgtttgtttatagatgaaaatgaatgtatccatgtagatgtatcttaatgtaacaaataaatatgtctctgatcattattgtttattagtttttgcttccagctataggaaatttaatacacataattttttatgccttggtgttactcatcaaagcatgtgatcattgtgtcattgatgtttgtcaatatatctctccaatactataaacaattcattggagtgtaaactatgaatctgaaagtgatgattcaccatctaacacatgaattcatgtcaatgtttttcagtcatgtttcttgagtttataaagttaacattagtatgtgatatagaaattactaaattacatgggtcgccactcgccagcacaacggctgcagttgaggacagtttggttaggaaggttatctggtaacatatatgtacgtacctgccattcaactgctgtgtggcatactcttggagtggaagatgggaaactcgataattgaactttgcaatatactccatccgtttcaggttataagactttctagcattgcccacattcatagagatgttaatgaatctaagcacacatatatgtctagattcattaacatatatatgaatgtgggtaatgttagaaagtcttataatatgaaacggaggaagtataactgaaggaggcaacaaaagtgaagaaattttttgtacttggtgtatgctttttataggaaatggttttgtaaatcatgctatcatagtatattgtaaatcttatgccttaagaatcctgaaccttctacttgagatagacctgtctatcaaatgtgttagatgtgtctgcttttggcatattcgagcttttaggtctaagttaatagtgttctttatttctacaaatatgtagatttttcaacagatatatcccgaagctggatttcatttagtgtcaatctcctgctattgccaacactcaatgttgcatattttagttttgcttccaccctttcatgctactcatctgattgaactttttttaacctggatttgaagtacgaggtaatcaagtatgttgcttgttttgcaggacagatgatctaactaatcaactagccctttgcaacgaaaccttactaaccttgtattactagaccaatgtggggttttactaggctgaagtcttatggcagaatggcatattttatgttgtagtatgttgttatcaactgtacagttcaccaaaatgtgatcaaatcctgagattccactgataccaagcaactccagtataaatagcccatgttatagcagcagttgttcgcataccaagtttccgaccatgctagaggacatcatacttgatgcctttgaggttcattgttgggattgttggttatactggagacttaatatacgggattacagatgtttgaaaacaatacggacatgaggaattaggaaacgaaggtactaactggacgtcgctaggtggtcaccggttagcagactcagcacctatttgtcagtaagaggcagtaaccagtctacctggggttcggtacatggatgggatcagcattcaagcaattcaggcggtggcgatgcatgaccatcagagttagtgtgcctccgtaagcctagctagctgtagcaacacagggggtctttggtcctgggcagtcaatcgggtactgccttctggagtgatctcttgattgttgtgtttttattagtcaggttccatgtgctactgcacattattcgagagactggaaaggtgagtaattgagaactaggttaggaataaacccaatcaaatctctttttgcccatttcttcctaaatcaatctatgttatattcacttaaaatccaagcctcttttgggtatgccttccattcctggttaacatgtaaatactgcatttaatgatcaatgtcattcagttggagattttgtagatgctccttttcgaacataatatcctgcatgtaggttaataaatgagtagcctaacaatgcataaccagtacttgattatattggtggtaattgagataaattgttcatagttaatgttcggatcagttgaaagatttcacttgtagaaatatatggaggaataattttatgataaaatggttaagggagagagggagggttttgtttcaacgttagccggccaaacaattccatatatgggaaacatggttatgtttaggggcaagtgcaatcaccacagttcatagtggatggccgatgatgtcggaacataactctggagttgaaacttcaatatatttctgcgaaatgatatattccacaggccataaggtggtatgcttccattagtacatggcctcaacttaatcttttcagtgagaaactggacaaacatttctgttactttagtggcgaactggcaaaatagaactttgtaatgctttggtgaagtagttgaggtgcctcaagaatcaagatcagccaaatgtgtcttcttctctaaatttctgaagtacaaagtctttccttgcattttgcatgtctacttacgcgtcttggattgcactgcattgcatgctaatcatgtttgttactccagtttgcaggataggtgatgataaagcataatagttgaccaaactcgctgtacttctccttaatcaattatgttacaaagaaatatggtgtggacacatcaagttgccagtcctgaaaaccaagttcaacctgaaagtttctatcatggaggtgctgggagcaacttatctaacctgagtgtgcaagttgctgttggagttccaggaaatactgatttccggagtcactatgagagcattaatcttcagcaccagcatgttcagaatccatacccacatgtgggtgttgcttcaagttctgtgttcccatctactatgtacaacccctgcatatcaacaacagcagtggacagatatgttcctcctattcaaagttttggattgggcaatccactactactgcctttatatcatcaacttgctcaaggatccatggatgagaacggcagcagtggcaatttttgtgacagcgtcagggaatttatcaagaggaaaaatgcattacttgtgggtggccatcattttgttaatagttttgcaagctcaagctcatctgcttatgtgcctccaaatcctttacataggtcatggaacgcttcatttgaagcaaatatcctacccagcactggagtttccaatccaccagagtactcttctgcagattcactgaacaattccaattcgatggcttcacatccagaattggtgcatcatggcaattatgtatttccagctggtcacatgagccaatacaatgcatggattgcacaggcaagcagaactggtggagtaccacagtgggaacatggcaatgcagcggctaatcctccaggtaagtaaaccttgtaaatagatcaagtggaagttatgatattttttaaaatgatggtttgagggatcattttatggttagcagtggatttggattgctaaaattgtgaattgggaatagaatagaaaatagtgaagtgagtgtgatttgaatttgtaattggaaaaccttgctttcaacaggtggatttgttcattctggaaccatagacatgccaaatggaggtcttcagggataccaagctggcccttttgccaattattatgggcctctgccccatttccaccaaaatcctctgaatagcatgcagcatcctgctctatttaatcatatccaaatgcaagtacctcatcaacattgcctcagtaacaatttattgcatcacccttctggcaatggcctccccttggatccaagaattctggcaatttcatccaattctgggcatacctttgggcctacagctcagccatctttagcaaaccaagttaatgctgggagttcgagaattcagccatatgaggtgattcacatttcctctgttttcctcatagaacaatggcatatataactaattagatgattaatgctggatgatatatctgatcactgttttttcaacagttcctgtttttcaaactggacaatactaaatttaaaggatatcagaatttagttgaaaaatatcacctgatattgttcctggtacaattcatagtttttgaaaccttttaaggtttttttttccttgtgaaatgatttaaacatacattggctgtcatgttccagaaattaaattccctcgctttcttagcaaaccatataccatatctgacttttccctgcaacctttttatcttgtgtaccttttcctacaaaataaatgaaaacatatagttttcattgcggggtatataatctgcctattgctgtgcctggcaacctgctgaccctagtttggaaattaagtacctaatgctcagttgtttttttttttggctatgcataccatgtacatgaaaaatggtatccttggagttggctcactgaagctgaatgcctactctctttttttcgataaaggaagctttatttgtttcccatttgtgagccattttgtaattcatttcccattaatacggatatatgaagtaataaatttgtctctatagaatgctccgttcgtggatctttcgagattgtatgaagcaggagttattgatgaacatagagatatgcggcttgatgtagacagcatgacttatgaggtatggaatggaatgttagctcatttgggttgtgggttacatttagttgatagatttatttgctttcttctcctacaggagcttgtagcgttggaggagcggattggaaatgttaatagtggttttacagaaagctacattgaggaaaatttgaagtcaagttcttatgtcccggacgctgattgcatgcctgatcagtcttctgtggagaaggatgcttgcataatctgccaggtcttcctcctttgtcattagtctattgtagttttcactactgtatataaatttgtatatcactagctatcagatgcatgatcaataccacaattgttccacaataatgataagcttcactcactatttttagaaacactacttttgcgtaagatagtgtacatatatccagttagttttgacatttgacagcaaagtagttaaatatacatttgcagccaatacatattttatgtttaaaaagggagtttgctctttgctatgtaggaggaatatgaggctaaagaactcgttggaacccttggttgtggtcacaagtaccatgcgatgtgcataaaagggtggctgatggtgaagaacctgtgccccatctgcaaaacaacagctttgccagctgatagaagaaacggatgatggatgccaataacatttattggtcatttgcagcaacaaacattcagctcagttttgtacataagacatgctggataatggttgtgcctgtatttccgttgttgtgatacctaaagctgtacagtgagaatcgctcatcttgtagattgttttagacactaaatgttccatgatgcgcgaacagctatcatcatggcatagctattagatcgctcaatttttccctttttattgtacatgatatttatctttattcttttcccaaaaagaaaaaagagaacttgtagttcttctgtacattgtgaaattcaaagaactaaaggagtttctcagctctggagtgataattctatagcagggcaatctttgttttaaatgtgcgaataatcattcatgcaggtatttaattgttcccatgtattttttttttgtttaaccaatcggctgtttggtttgaggattgagatggtcaattgaccatttgattctaaattgtttgtttcgtacgaggaataaaacaggtttgttcatcacttcattcctcaatatatttaaagaatgatcccacgatggatcttcatcctagatggcctgaatcctcaaaccaaacaactttctatgtgataaactgagaacattttgattgttccatgtcaaatgtacagcattacggatacaatgcaaagcaagcatgaaaagaacaagcatgaaaagaactagataactgtagcagcaaaaaattcatgagtagcagtctagctagcagaagagagaaactgtacagacaatgaactgtgctactgaaaaatagacagcaacatataaataaatcaagcggtcaaaccataatagaagcaaacaaatggcctgtatgaaaatctgacggcctcacaatttcatatccctaaactataccggcaagattatgtcctgaatgaattaatgtttcaaatggcaaaacgaaggagacacttagtaacacatgaatacagatgaggtctatgaatgcaataacatcctgtgtcctactgcatagtatcaaccacctcgggtatctccatgtttgtcaagtcctttcgatctacgctgatgaacaacaagcagactttttcactgcagagacatcatctttgccaccaacattgatggtctgcccctttggtggtgcagctgggtcatcgccgatgtcaagagccttcttgctcactacatgatatatctgggtgagcacttcagtgaaggcattctccacattcattgactccagggccgacgtctccatgaagaaagtgttctctttctcagcaaatgctttcgcatcctcagtcgagacagccctaaggtggcgcaaatctgccttgttccccacaagcatgatcacgatgttggcgtccgtgtgatccttgagctccctcatccacctctccacattctcaaaggtgacatgtcgcgtgacatcatagacaacgagtgcccctactgctccgcgatagtatgcgcttgtaatagctcgatatctacagaagcaacacaaaattatgataatttgctgtgcaggaactaattaataaacagcaaaagcgcatgaaacaacattccatcaagcacagcaggcaataatatgccgcatactccatgactccatcaatctaactgttcagcacaggggattggccataaagaactttttgtccccaatctacacacttcctaactccatgataatctagatgtctgtacaataacaatttcctatgataatctagatgccagtacgacaacaacctattctatgccaatgcctggtcctacacaatctttgcctacaatatcttaaaatttatataaaaatgtcatggcctggggcattttagggtgtaatcaaggaagtctatgaattgaaagaatgccaaattatcactcttcttcttaatcctacacaaggatttaatcacgccaatcatatgagcgcggcaattaaatatcacccgaaatcagagatccacacgagagaaacccactaatcgccaacgattaacgaatggcctagcctaatctaacaagcagatcaggatgagcggagctcgcgggggcacaggcggatctggggtggtgtttacctttcttgcccggcggtgtcccagatctgggccttgacgaccttgtcgtcgacgtggatgctgcgggtggcgaactcgacgccgatggtggacttggactcgaggctgaactcgttgcgcgtgaagcgggacagcaggttcgacttcccgaccccggagtccccgatgagcaccaccttgaagaggtagtcgtagtcgtcgtccgcccggtacgccatcgttcggtcacaccccccacgaactcaaccttctcgccgccggcgctgcgcggcgagggggcggagcggatgggagcgaagggcggagggggaggggaggggaggggagagcgtttgtcgcggtgggtgcggatcgatctcggtctctcctctccccaacttttttgggtggctttgtttgtgcgggaagggaatgcagttggttggggttgggttgggttagtcgcgcgcacgccgaaaattcacgggcaaaaacggctcgttttggtcttttttgtgtgtgcgtgtgcctcctgcctgatgcggacgcggttgggttgggccacgttttctttcaaacaggctgcgttcgttcgggtaacatttgagggagataacatcttgtttttcgcgcgcacgctttctaagctactaaatggtgcgttttaaaaaaaaatcctatagaaaagttgcttttaaaaatcatattaatctatttttgaaatttaaaataattaatactcaattaatcatgagctaatgtctcacctcgttttgcgtatcttcccaatctcgtcaatcaccttctcctcaaactcaccctaagttaaattgcaaaaactactccattcatctcataatataagggattttgggtgaatctggacaagaagggaggatctcataaattattttgttactaatgatatattatatcacaagttattttgttacaaatgttcatcaacttactcaaatttattgcaaaaatcactctagtacgtgtgcttaaccgaatcagaaaatgtgagccatcaatgttgttttaccaaaattaaatacttgattccacggatagaaatgttgagaaggatttaaatattatcgcactaagttttgctatatggagttttttaaaaaagttttgctatatgcaaagaaaaaagttcaatcaaatatgaaaaaaaaagtccaacgcaagcacttagaaaaagaacttaggtctagttctttttctctactcaaaacttcaactacctcgttttccgttagcacatttttcaataaatggtatgtttttgacaaaaaaattctatatagaaattgtttttaaaaagcaaacaaattcatttttaatttataatagttaatacttaattaatattatgctaatgagatttctcgttttgcttgcaacaaaaatatgtctccacaactccatatggaacagagccggtatgcagtgactacatagcgaaaggtttaaattaataaacggtacattttgtttagaagttaattttaaataatagataaatacatttttttagttttgtaaaaattaaaagttatttaattatatgctaatggttttttctatcctaacctcacctctatcttcggtagaaaccaacggcaccttaatcgcgtgtgtcaaatcacagaaaaaaaattggctcgtttgggggtaattttcgggcgttttcgcagggttatacatacggcaagcgaaacgcgtctgaagctgcgccgagtcaaggttgtcgacgtcgagaaatcgaaaagtctctctcgctcagaacaaaccgataccaggtcgcatcagcaacgcggcagcgcgcggcaaagtgagaattgtgctacgaagtttggaacacgcttgcttgttgttggctgcgtgctacgtaccacgtaccaccgcgcaccgaattgaagacgaaaaagaaaaattcggacgatcgagagtaccggcacacgatcgctaccagacaagataaagttttccgtgccacggatcaactcatggatcgatcattcagtttggagtaacaaaaattacgctgtggcgagatcgaaatgcatggagcagagaggattccgcgtcatgggccgtgccgcatgtggacgcatttggtgcttgcctgcctgcgccttttctgtttctttcctggccgtgtatcatcttacgccacattgttgtatgcagagtatgtatgtacatatagtaggagtatagtaatacacggtagtactagtataaaatgctacacagcgatttcccaaacgtatctggccatgcaagcattcatgtgttccccggaagtatttacttgggcaacccatgtggtggttagcagttggtgctcctctacctgtatttagctgcatgcatgagaatatatacatactatacagatcacaatttcagtcgacactaactcgatccagctagcgagcgcttcactgcagccaggaaggaaggaggtaaacgtacgttaacgatgtgtgttaatttgcctgcctcccacgtactactgtactacaggaacaaaaaaaatgtcgcgtctggcacggcaacaggcagggagattcccgacgcggatggcttgaatggtgtactggagtaggggtggcccgaccgggttggtcgttccttcgtcccgacgtgcccaaatccccatgtatatatgtgtgcattggcaatgggcattccattgccatggctgtggtcctggtcccccaaaaggcagtcccaattcgtgtctcgcccaaaggaggcaagcctgtcaggcacttcagcaaaatggcacgctgcctagcttcgccgtgtctgcatccttgcatatgcatgctgccatggtgaacacgctgttatggcccggcccagccagcccaaagatcgatcggttgtgcacgcacagccgggtgaaaacggaatcagaatcagtagcatctctttagaaacgacgatcaaccggtaattgattatatttaccattttaactactactaagtattgatattaatatgataaaaaagatattagaaaaaaataaaatgtaaaaataaaaaaaatgatatggttaaaaacggtacctaatataaaaaatagtgattgatcgatcgagaatttccgtagttcatccctatccacggatgaaccgtgaacgaaccaacttcgacgagacccaaagataccggggaaaaaagaacacatcagagcgtgcaaacgtgcacgtacccacccagccacccacggacccgcgcgccgtgtggccgtgtgtcgcatccacctcgagtcaatgccactgcaagacacgcacacgtacgtacgcgcgcatcacacgtacgcgcacgggtgcgtgcggatggtgcggtgcccggaatcgcgctgctccgcaattactccgaccccaatcagaaggcctcctcctcggtcgcccaccgcggaagggagggaagaagcaaacggacgcgcgtgcgtgcgtgcgtgagatccggcctggctacctccggttttccctcggctcgtatcgtaggccatcatttactctccctctccctctccctatgcagcgcaggtctgcagtttctgcacaccagctgcatccatgatcgattacaatactctactgcacccactgcgtatccgtcgaagtatgcattgcatctcgtcttcactggccggcctgcatgcccggcacttctcccggcctcccgttctccatatcgtcatacattatatatcccccacattgccatttaataccaacaagaaaccatcggatgatgactatgacggagactgagagaccgtgcgtgcaattgctgactcttgctgcgtgcgactgcgagaggaaacgggagtagtacgtggtagaatcctatcgatctcgatcgatcggtcggtctccgtctgctgctggaagggagagacgttgatcgatgtgctctctttcgcgtgtgcagctacgctgaattgaaggggagagggactaggagagagcatggtaagatgggatgggattgacgctgtacatgcacgttttgacctttcattggaaggtctacggtgagagaaggatatgcatatcagaagatggtgctgataagtgataaatctccaaattgttcgcagcagacttgatctatcgatcgggatctagggtgtgtttagttcacgtcaaaattaaaagtttggttaaaattaaaacgatgtgatagaaaagttagaattttacgtgtgtaggaaagttttgatgtgatgaaaaagttgaaagtttaaagaaaaagtttagaactaaacaatgcctagtcctatcattgcattatcagagagactcagaggaaatatatcaggtttttttttttgccgtaatactagttgctctctcttctttctttcttttatttttttgccaggccatatcaaaaaagcattctgattttccttttcagcttctaaccattactgcatttcgtttttttttttgcccccaactgattccatgtcaccttccgtcagttaaccgcggcgttgagagttcaacgaacagtgccagatgatggatggtacagaccgtgctaaaaacaaaatgaactgatgaacgctactgacagtctgacacagaaacaaaacacaacgtttcaaaacaaaatttagaaactccttgatccagtgatacagatacggtggtacgaatagtagttgcgattggggttaatctctagcacctcctgatattctcccatgcaaaagtactggtactaatagaaggccaggcagaaagtcatttgccttgtcttccttccttgacgatcgaactggacgaatcaatcacacctactagcgcgtacttccctacctgatatagccaccaagctatcaacagtgtaggcaggcaatgcatgtttgtatccatgatgggagtggattctaaactattagggcttcttcggttaatttatatgagggagagattggagaggagactaattccatacctattgtagtgtggaattattccccttcaatcgtcccctccatcttttcaatcccctctaaaccgaacaagacttaagaggatatcttttagttgtttacatgccatccaaatgattatgaaaatatttgaaaaaaattaacaagataaattaatatgtaataaatcattctatggagatgcaagttaaaatctaacttctacaagttgcaacgaaaaaaaattaaactacggttagtcagttaacatatatacgcaatcaaatttattttttgttgcaacttgtatgagttaaatttgactttacatgtttgtggagtgattcataacatattaatctgtcttgttgaattttttaaaaaaattataaccatctgtatgacacgtaaacaatgaggggatgtccttacgagagtttaaaatagttccccatccattattccacatatccacaaccatttttacgctgcaataatgtatcatttcaattactacaggactgtttgacggagagctctggagtctaagaagcagccgaagagaattcagcttgtgagaatggagaaaacgaaaaccatcttatggcttctcatgtattttttgagttctacaactacaatttctcataatctcgacgaaaagctgaacggttaggaacaacacatgattctcggagaagctctagctaccacaagcttcccaatagctttcactcttcatgtacttagtctatgcaacaagattcaacacctcccccatctcatcagccatcactgatctagctccccaaggtgcacatcaagtagtccaagggagcaaaacaaaaggaaggaggaagagtgatggcattaattaactgtgctgtgtaaccctgcacacatgtactggggtaggtgaggccattataagcttagcttcagcagagacaggaatactacacaggaagaaagccatagccagatccatagggttcttttcttccccctcactgttcttctacagacttcagagttcagagctgtagacgacgacacacaccggccggccggccccctactccctctctcatcatctcgccatcatccatccatctgatttgatcgttcgttcgttgcaaagcatatctcgatcgccagcagcagcagcatggcctcaccgaacaggcactggccgagcatgttcaggtccaatcttgcctgcaacatccagcagcagcagcagcctgacatgaacggcaacggcagctcgtcctcttccttcctcctctcgccacctactgctgcgaccaccggcaacggcaagccctccttgctctcctcaggtagtacatgcatgtcactgttcagttcttgcctaggttagggtttctttggggagttcttggttaatttgatcggtgtaatttgcagggtgtgaggaggggacgaggaatccggagccgaagccgcggtggaacccgaggccggagcagataaggatactggaggggatcttcaactccgggatggtgaacccgccgcgcgacgagatccgccgcatccgcctgcagctgcaggagtacggccaggtcggcgacgccaacgtcttctactggttccagaaccgcaagtcccgcaccaagaacaagctgcgcgccgccggccaccaccaccaccacggccgcgccgccgccctgccgcgcgcgtcggcgccgccgtcgacgaacatcgtactcccctctgcagcggcggcggcgcccttgacgccgccgcggcgccatctcctcgccgcgacctcctcctcgtcctcctcctccgaccgctcctccgggtccagcaagtcggtgaaaccagctgctgccgcgctgctgacgtcagccgccatcgaccttttctcgccggcgccggcgccgacgacccagctgcccgcgtgccagctctactaccatagccatcccacgccgctggcacgtgatgatcagctcatcacctcgccggagtcgtcgtcgctcctcctgcagtggccggcgagccagtacatgccggcgacggagctcggcggcgtcctcggctcgtcgtcccacacgcaaaccccggcagcgatcaccacccacccatcgacgatctcacccagcgtgctcctcggcctatgcaacgaggcactagggcagcatcagcaagagaccatggacgacatgatgatcacctgctccaacccctccaaggtgttcgaccaccattccatggacgacatgagctgcaccgacgcggtgagcgccgtgaacagggacgacgagaaggcgaggctggggttactgcactacggcatcggcgtcactgctgctgcaaatccggcaccacatcatcatcatcatcatcatcatcttgcctctcctgtgcatgatgctgtctcggctgcagatgctagtacggcggccatgatccttccattcaccaccactgctgctgcgacgccgagcaacgtcgtcgctacaagctctgcactcgctgatcagttgcaaggtatgtttaattattagtactatgttcatgcatgcacggatgcccctgcaaaacaaagttcaattggaacaactagccatgcatagcacattcatggtcatgttgcaagtcgtactactactgctactgcttccccgtcccaagatataatcattttttattctgacacgatcttcgagatgctactttgaccaacaacatctatataaaagtaagatgttttaaataaaatgagttgcatattatgataaattatttaatgataaatttaataatatcaattttacgtggttgatatttctattattttgctattaattaatagtcaaaattaaaaatatttgacttgaaaatatgctaaaaatatttatattttggatggatggagtactatactctggccatagctagtacaacttgtctcttcccttttttgttggttatcatatgcatggattggatgctagctcagcagtttgcattgttcatgtttgtaagcatgtgcatagaagtgtctcctcacggggggtcaccaccaagctcagctcagctcagctcagcttggtgtagtgcatgaaacgttgtgcatgcatggccatggccatggctagctatggcctgtctcgatctacctgcaaccttggctctagcaagccttggcataattggagaaagcagagagtactcttgccgccctgatgattcgagtaatggctagagacagtgcaacaacgtgtccttttgtgtgttagctttgaacagttgcagcattggattgtgttgcattgcgtgcagccacaacagtgggcgtttatatgtagtacacggttggctccaatctcgatcttgcgatcacatgggaatgccaacagctacatatgtacgcatgcatggttgcaggcaatgagacaaggttaggctatgtaaaaatctcctgttccatgcaccgatcttgtcatgctatatgcagcatatatgctagctgttgatgcaaagagggacatttccatgacagaagggtagagggggacttggcagcttgtatgtgtgttatatgcatatgcatgcacgcgtagatctaggctgttgaaactatagcatagaaagggccgataactgtgagctgttctagccccccaagagtggacaaatatggatggtttcactaagaaagagtaattatattggctgttcaatttcttgatgggaaagcatcacatagacggatagacatagaccatgcatgcacatatctatatatatggtactcctacattccacacacattttgggtgtattccaaatgaacacttttatgtcatgaaaacaacagcaaattaagcacagaacacgttatgcatcttgagcatctaggagtgtagtacagtagttgtaacttcgtcacacaaaagacttcgtaacctggataagtacagctagcttgttggttgttgccttgttcacagttcacatgcatagtagaaccataagctaaccgagagaacctagatattaactgagaaattaaagggtcatgcatgatcatgtattgtacaatatgaaagtgatttcatatccctcgagagttatcccatcgttttgtgtatgccatctaaatagtcataaaaaaatttggtaagatagattaatataaaatatatcactttataaatatgcaagttaaaattcaacttctacaagttgtaacaaaaataacaaatatagcttattttgtttttttggtaacttatagaagttgaatttggtctataaatctttttaaaaaagttttataactatttaaatgacatgtaaataatgaggacgtcccctcgaggatgaaaattcatatccattgtacagtatgagaagagattagatgctataaaatatttataaaaaacaaactgaaaaaataatagatggataaattaatcatgagacagaacaaagagtggagtatcgatcaacagtgtcgtagtccagcttaggtctgggacgtggatcgagatcataaatggcacccttgtatggtcatgtcgcagtgcttcttttcaagaggcgataccggggttggggtaaaaagatctatcgaaggcttttttgatcaatttgcatgcgtacgttgttgaaaggattgaaggcgacggtgctcaatcaaaatcctctcttcttggttgttgctgctcgatctccaagcaaacacttgacttgaaagctggtagctctatctttcagggcgtttgttccgagattggacgtgtgcatggcatccttcttctcaaaaagatgctttcaacatcgcctctctctctggcttggatttccgcatgcatagatatgctagctttttggcagtcataaacttgccagaggtttgaatagcagactgactttttgcatgcacagatcagattattggtttgaggtttggaataggagagttttatataggattgaagtatatgaatttttcccatatgccgccctttggtttgaagtttttgagcgaaaatttttatatccttgattttttttttgaggatttcaaatgtaagctcaatacaccatcgtctatcttcaatcttcatctctccttgcaactatattctaatagtaatattttttcctctaaaatttctctaaatttcatgcaaaggatctgaatgaccaattggactagttgttgtgttttcagttcgtgtaagcctatatatatatacatatgtcatgacatcccggagtcctaaagatgttaattaaatttggtttgaatatataggtttaattaaagtttggtttgaaaatacaattccttgcaagctgcagggctgttggatgctgggttgctgcagggaggggcggcgccgccgccgccctcggcgacggtggtggcggtgagccgcgacgacgagacgatgtgcaccaagaccacgagctacagcttcccggcgacgatgcacctcaacgtgaagatgttcggcgaggcggccgtgctggtgcgctacagcggcgagccggtgctcgtcgacgactccggcgtcaccgtcgagccgctgcagcagggcgcgacctactacgtgctggtaattaaacctcaatttgctcacattaactcatataatatgtcgtgctaataaataatcaaaaaattaactagcattttctcgagctaattaattgagtgactttacagtcgttataaagagaagttatcatattttctaatgtaaaatttagtaactctcgttatcttcagtattattaaaagatatcaaaatttgcattaaaaatattaatacctattaagtactataaaattactctaattaatatgtggcttaatttatttatcatttttatgtactttcttatgcatgcaggtatctgaggaagctgtgcattgaagccgtattaccttgattacatccacaattcggcactgatcatgcttgctgcatgcgatcgaatcatcgatcatctaagagattctaagttaattagtaattcgctcactagtttggtaatagctagctagcaaccttcatcgatctgttatttcattcagtacgtacatgtctacttaaaatcactgtcgtgtagtactgtacgtgttttgctcgtctgatcaaacagcaacatgcatgacggttttaattttgatgcaataaccagtggagtaaaccacataaatctatcattgcaagcactgaaacttttggactctctttgaagcctgaactctgaacatgtatacatgcacggcgtgcatggatggtctgctgaaaactgcacacgctgtgggattcagagagaggcaggaagggaaacgaaaacattggtatggtctgcagggcgcatgcatgcagattcagagccttttcgcgcacttgaatgcatatgcatgagttaatttgcacactgtggacgcaggggaacacaagaacaatggcatgcatgcatacgtttcgtgtagggcagctgctggctagcttctcccgtacagtgtgctcgtgcgtgtgtgctgctagctgggaaagtgaaatcatccctcgatatcttctcgtttggtgcatgtcacctaaatagtcaaaaaattattaaaaaattatcaacatatattaatatgaaatatattactccacaaacatgaaaatttgaattcaatttctacaagttgtaacaaaaataacaaatatagtcgaatgtgtgataactgttttcagtttaatttgttattattgtagcaacttgtagaagttgaatttggccttgcatgtttgtggagtgatatatttagtattaatctatgttgtcaatttttttcaaattttttagtaactatttagatgacatgaaaaaacgaggggatgtgtcctcgagggatgaaaatccacatccgtgctagcttagctttcaccggtgaggttagctagcaggcaggcagacaggcacagggcaacggcagccagagccagggctgggctacgcagaccaactctctgtacatgtttaacatcactcgctcgcttcctcagaattaaaagcgaagctttgtcgtcagtaaagtaaacagcgggaaagtctttttagaacctagctagccaccatatgcttacatcaagattcgggcgtagagctcaagtgaaaacaatgttgcgagtgagaaatatatagcacgtatcacgaaagagaatttaatagtttttctcttaaggtacctaaaatttacactacataattttataccttgatatacttaatgtttatgtaggtaacaaattttatataaaaaatatgatatattctggtatctttttaaagatgataaaattatccatatacaagcgcgctaggtgcatccagtaaacagctactagcacgagcatgagaggtgagtagctcgtatgaattgtgttaagggtataatcctatgcatgtgaatggttagctgcgttggtttttgatggaatataagccagtcgtcattgctaagaatttgatcgagttttcggtgctaaaaatatgtccttagaaaatgtccataaattaaagagtaaacttcactctagcttgtgtatactgatatatgttccgtaggtattactactcctttatttattgtattcatactagattattaattagctgattatggatgtaattcctccgttcaaagatgtacttctagcataataattttgtctcaaaacgaagctatttcttcactcactctttcctctcaaccaatcacaaccattccctatttaattttttcacctactttcttttctcaaccaattaattacgatcttccttcaattaattctatatacttttttaatatccgtgctaaccggatgtagtaaaaaaaaaggcaaattgacgacgatgattacgtgtacagtacaaatttaacctctccgatattcatttctaatggcctgcaaaaggcctcaaaatgaatactatatacatacatgttacataccttgaacaaatcccctaaataaatgcagaataagttcgccttgggtctctctatttgttgtccagtccaattttcgtcccttgaccgcaaaaccgggtaccttccgtccctcaacttagaaaaaccaggcaaactttgtcctatggcagtatggtaggcggttttgacctatgtggcgcattgaccatcccacgtgtcgcgctgaccacgtttctcctcttcttttaccgcgtcgctgcgtcggcgcttcaggatggtcctctcctgcgtcagcgcggcgggagcgggagcagcggaggacggcaaggacagcgggagcgggtgccgcggcgctcgcggcggaggacggcggagtgtggcccactccagcacgaagatggcggcgccgaggccaccgacgagcttaaggatgacctcgccgtcctcctcccggacgtaggaccgcagctcggcgaggaagtcgccggttcgtgtaaaggcgagcaacgtggcggcgccctggaagatggcggtgaggacggcgggagagggagcagcggaggatgacgaggacggcgggagctgccgccgcggcgcttgcggcggaggacggcgaggacgtagaagccgaagccctcgtgcgcgatggcggcggtgaggtcggtcccctcctcgaggggggtgcggcgcagatggaaaatttggtggtctggtaatcgatcacaccaagaagaagaagaaagccaaaggcaccgtcattggctcctcagctctggagcagctatcctctgtgccggaggtaggatcaggtgcactgtcaggatgggattagttgtaatgagctgcgagtctgatgattggcgattaatgctttatggaatgttggaactccttatttttcctttatttgcaaaccgagcttttgtatgcaccatctgcttgtttttgtcactttaaacgtgcaaactgactggaaattttgtagaagttcaggttagaagttttgtaaaagttcagatgatggggagcttaatttccctgaactcaacagtgttgctgcttttcatcctgttcagcaaagacgcaacatttcgtactagttttttctgaagatttgctttgcaatacattaagagaaacagaaaatatgctgggctttcaccagatacatgatgtttgaagatgatagcaaaaatctaatctcatcaagtgatgtgtataaagagggcaatttctaagataaggcccagatatagcgcgagaattggattatacaacatcgtaaacaaaatcccatcttcatgtccactacagatcattgtgtgtcggagcacttcaaaacctcttgcaaacaaattcatatggaggaactttatcaaccgcagaaggagcaagtcaataactccacggccgtgggcggcggcggcggtggggggaggcacggcggggtgcccgctcgccgcgacgctggccgatcctggcggcggccgcgtgctggtgctggagcggggcggcgcgcccgcggagttcccgccgctcgccaccgcgggcggattcgttaggacgctggccatggcggacccggcgcccgagttggacgcgcccgcgcagaccttcgtctccgaggacggcgtgccgaacgtccgcgcccgcgtcctcggcggcgccacctccgtcaacgcgcccatcctgttccacaaccacggcgagaagcgtcagaggcgcaacgaggaagaagagggagagccgagaccaccatatttatttttttatcgctgacatgtgagccccgctatttttaaattattcttttgtatgtggctgacaggtgggcccatggtttttattattttttcaagatataattgccacgtaagcgccacgtgggacggagacctagtcaaataagccacgtagacgccacgtcagccaaaaccgccttcaaaatcaccgagggaccatatttgcctggttttcataagttgggggatgggtcgtacccgaatcagcctggacgacaaatagagggacccaaaataaacttattcaaataaatgcatatacacgctaaagaacaaccaatcttacggcccatttgtaaagcccaaatccccccaataatccagcccaatccccaggaaattgatttaaactgacttgggctgtcatccccatagattgacccttccaattgggcctgtagtctgtagcagtatcttagacttcagcacttcggatagctacctagcctagctacttgaccatctagcttaccttgccatgaacacatcactagctaattaattgatcatcctcttaattatacaagaggcgggaacaaataatcccaatactcgccaccaatctcctcgaaatcgatcactcctgcgtcacttttcgagcattcttgcatcgaaacttgatctttttctgaagcgaacgacaccatgtgatcacagttcgtcgcggtctgcacgccggagaagacgacgcttcttgctgcggcatcggtggtggtgttcgctctcggcctcctcctgcggcgcgcgcgggtggaggtctgatcggaggaggagcggccgccggcgaggtcgcgctcgaggtgcttctgcacggtggcgagcgggaagttgaggtgggcgcggtggccgcgcatgcggagcgccgccatgtcgtacgccagcgcggcctcgtccgccgtcgcgaacgtcccgagccacacccgcgcgcccctcctccgcgtgtcgcgtatctccgcggcgaacttgccccacggccgccgcctcaccccgcggtagctcctccgcgccgcggccgtcgccgtcgtcctgtagttggcgccgccgccgccaccgacgacctggttgtgatcaccgggggaggcggcgacgagctgtagctcgccggaggattccgacgcgagcgccgccccgctgagcagcagctcgtcccactcctctgcgcccatggatatccacctccccaagctcggcaacctctgcaagatcgccgaattctcctcctgaccggtcaccgccgacgacgacaccgccaccgacgacgacaccgccggcgacgacgacgacgtcatgatgctggcccacacgttctcgagtatgttgctcgtgtcatgaggctgattggaagctggagccgctccgatcgccatgaccgatcgatcaagctctgaagattttttctcttcttcttctgaagattagcacagtccatttgcaccgtgcaatatatatctatcttgatcgaggtggctgtgtcatagctgagctgacaatggctggctggctgctttgccgatttctgacaaagcaagtcagcgcgtgtggctcgtttgtgaagccagctaaggaatttgcatgagagggagaattcggtggcctgaaaatgagtgaacccgaattaattcagtcgcggcgcaagatctctgcagaaatccagggatgttcacgcgtgcatggtatcttgaggtggttgattttgtgctctggaatgcattcttttctccagcttggttgaccagatgcatggctaccatgtaatgcttaggtcagctccagtgtttcggagttcagatatcaaagttgcaggtgttctcgttaaagaatttccagctcatattcagaatgtcctttaagaaaaaggcatgtattcagaaaatatgtacaaatacttctttgggcacaataaatgtatttgccatttcattcatactttcattcgtgaaattggtgcaattttgagggagatgagtcatgtgaattctgaagagaatttgacacattcatgcatggcaaagtattttattcttatgtcagccatgtaattgcactgttgcagtactagactattggttatgacatacgacatccccatcgattacacaaaagaactatattaaacactaaacattgatcaggagcaaagcatctccttaatcaaattccttaacgaacaagataatcacataatgattgcgtcatcacaatagcagaggagggtttctttcctgaatccagttgcttgatctgcttcacaagccatgcatgttcatgcgtaccgtaggcgccgcatgcattcaggcacaagacccacttgttcctatcattgcatccacttgttaaaatcattgcatctgaatcgatctgtgggtcttatctttgaacacgctctaatataaatttataataatccttacctgacaagtcaaccgagctgaaaatatcactcaatccgaacaccgttttcaattcttcaggctagcatgcaagtcgctttctgataaaactgaaacagcttagtttatctgaccgcttgatcttgaagctaaatactagctaactaggcaccgtttagtataatctggagtttggggctggaacatggaagcagtgtggttgaagcctgactttctggaggaaatcgcgtgtttcccatcgttgcattgctcgtacgttggagcaggagatgtcacaagtgataagatgcttctgggtgcaggaactgaccgtgatatgctgcgatctctgatggtggccattgctcgtccacaaagggcagatagcttgggcaggttggaacagaatgttttgtgatcttttgcctctgggtcaactcatgcagtaatgcatgtatgacgcgatggttagcttgctaattggaatcgagaaataaaatgagcatccattttcacaacaactttgcactaccaagtacaatcgtttccgcaatcttcccgaactgcaaatcagggtcttgaaatcagcccaaacccccaaaaccactcttcatcgtgcgtggtgagttttgacttgaaaggccacacatttgacagttcagattgatgaattatctgatttttcctcatagctatttgagagtataaacgagtgaattaactattatgaaatagaaaagttgctttagaaaaatatattccaatatttattttacacgaaaatgcgttgattaatagcttgggaaacatctataagaaaatctaaaatatagaataataaaagagaacagggcataagccagtcataataaaagagagcagtctaagtcaatggttgtgtttagttcacatcaaaattggtagtttggttgaaattagaacgatgtgacggaaaagttggaagtttatgtgtgtaaaaaatttttgagtgatggaaaagttgaaagtttgaagaattactttggaactgtccaatatctcttccatttttcagacgaaacgtgtagctttattttttgatttttttaggctaatctgaactctgaaggcagtcatatggttgaaccggcccatcaacacaaatacaccatgggctcgaaccataacaagtcaagccagaacaaggcccacactatcatgggccggatcacggcccatctaaacaagcctttccacaagtcagcgacgcagtctgctctttcctgtcttctcctccacctttttatacaacgcaaatcgcctcgtcactactccgtacaaattttcttctggatcccacctctgctctgcccattcgacggcaacgcgctgccgcgccatcgcgccacgtcgcctcgtcttgcctcgcctcgtccaaggtcaacgagagcatgggaggaggccgggaggaggaggcggcggcggcggcgagcaaggtggggtactcctccggcgacctcccgccgtcggcgccgccgcacctgcagggccaggacccgcagcagtaccagtacggcaccttccagccgccgccccatcaccatgccgcctcgggcgagctcgcccgcccccccgtcgggttcccccagcccgccccgcctccaggcttcgccggcgccagcggcggcggcggccactaccaccaccaccatcagcagcagccctacgcgccggcggagccctactacgcgcagggctaccagaccgggccaggtatggccggtctctctcacactgactcctgctttgcttgtgctgctttgattaggtttggtggggaaatatggggaattgcaaatcgcaattggaaatttggaggtcttcatgagcctcacagcatcgctatgctctcaatttctcatgtccaactacaaattttcgatgcttttgtgcttgtggatgattcagaagcctgaccaatatgcgtgatccgaattcctaaccctcttatttctcttcacggatgggaaaacctacttagatttttgacttgggaaggaagatgaactagtcatcagctcaactacgacctggtctgctaaaatgtaaataggaaagtataaaccaagtttatggtaggaaaagagacaggatagctgatttaaacaactagactttcacttcctgcacacacgacgcacctttgatgattgaagtgttgctcatgacattggagaaactttgaggcgtgcaaattcatctaatttggtgaatttgaagtcagctgaatcactgaccataaacagattcagctgaatcttattgtgattctctgcccccccccaacacacacacacacacaaaaaaaaaagataaaagaatatcgtctttaacctcttattgtcgcatacacaatgatcaccatatccttctctatttttccttttgagataatgtaacttcagatcagatttgcatttattacattgaaaaacaaacaagtgaacccctagcatggaagtagaaattgttatatgatcatatggttcgtggtttctcaggttatggtcctattgctgagggaaggccagtaagaatgcgccgccttccttgttgtggtcttgggttaggctggcttctgtgagtgtccatgctttcgttattcttgccatactactgaagttaagtccaactccttaccgagtttatcttttgttcaaaaaggtttattgctggatttttccttgctgccatcccatggtatgttggggctttcatactaatatgtgtccgagtacatgactacagagagaaaccaggatatgttgcctgcactgttgctgtaagtatatttctactgatgcgctgcaatcacattgttatattctccctccgtcacaaaatgtagctatttctggctaagaatctggatcagaaatagctacattttgggatggagggagtattatcacaaatttagaggtgaatatgcaccttttgtagatggaatttcagtttatcttggatttttttattgtgaaccacatagaagtagagaaatgcagtcgcatggttatattattgtcaataattcagaggtgaacttggaccttacgtaaatgaaatttcacttcaccttggaactttcatttaactacatataaactactaggtcatcttctagatcatcactattgctttaaatataaattgcccacctgattagttcttcatagtagatgtccagttttttttgttcataaacggttgtgcttataacatgaattgccttcttaatgcttgaattgacttcgttttgaattcttctgcatcacaaacaggctgtaattgccgcaattgtcatccccttggggttaaccaaaggagcacacgtatggtgagctgcctccgagtttctaaggagtcactgcatgtaaatggcctgttattatttgagaccctgcactgggtcatatgatcatatcacttgtatatgtgtatggatggtaatatagtgagcaacttcagtgtggtaatcttatatcgaaccattggaccctcggtgttcatatactttgtaataaaggatcaatcatacaagaaccttaataaggagtaatatactgcgtcatatcagatcttaccctcgatgctgaaacgacctgaatattttcgtgttcatggataataataaatcaggtgagatgcatactcatatctattatattattaaaggaatagaaaaaggagcctccacgttcgctctcatggcctagaaattctcacattaatcggagaaaaagaaaagacagagttcatatagaaatacaatttagaaatagctaaaattaaaggaatagaaaaaggagcctccacgttcgctctcatggtctagaaattctcacattaatcggagaaaaagaaaaagcagagttcatatagaaatacaatttataaatagctgaaatttggaattaaaaaataaggaatattagaagaggagacatagaaatacaatttagaaatagttgaaattcggaattaaaaaacaaggaatattagaagaggagactagagtccatatagaaatacaattaggaaataactgaaattcggaattaaaaataaggaatattagaactagagtccatatagaaatacaattaggaaataactgaaattcggaattaaaaataaggaattttagaagtagagtatagagtccatgtagaaatacaattaggaaataataaaaatttggaattaaaaacaaggaatattagaagtagagtatagagtccatatagaaatacaattaagaaaaaaatagaaattcggaattaaaaaataaggaatattagaagtagagtatagagtcgatataggaatttaaaactaactaaaatttggaataaacataataaaattaaaagtagagatataaagatacaatttacaaataactaaaattgcaaattaagaaaaacatgggaagaagagtttaaagtcaatataggaatacaatttagaagtaactgaaattcgaaattaaaaattaaagaatattgaaagatgagtttagagttcacatagaaatacaattagaaataataaaaatttaaaaataaaaataaataatattggaagaagagtatagagtctatctagaaatacaatttacagaaaattcggaattaaaaaaaggaaatattaaaagacaagtctagagtccatataagaatatatataatttataaataactaaaatttgatagtaaaaataattaataactaacacttaatattatataagatataatatgaatattacccattagtagttttgtaaagttattgcaaaatttaaaattatgttgtcattttaatatatttgaataatataatgaggaaacatatatgctattatatgagagaaaatataatgatgctagccgcgcaatctgcgcgggccactgtgctagttgtagctaatccgaagtaggaataagttcaccggaggtctctcaacttaacagcgagattttttgaggtaccttaaccataaaaccagaaatgtctacccctaaacttactcaaaccgttcaccggaggtccctcgacagtattttttgtccgattttgctgacgtggcatcctagtcagcaaaaaaagtttaaaaagtacgtggagcccacatgtcagctgcacatatttttttcttctcttttcttctccttctcttctcttttcttctctcccctctcttctccttcaggctggcggcgggcgcagacgtgatggccgagcgcggatgcgggcggcaggcgagcgcggcagcagagcggtggcgggcggtgggcggagcggacggcgggcgagcccggcggcggagcggaggctacgggaggagcagccgcgcaccgtggccgccgtcgtcgtcgccgtgggcgaggcggcacggcgcggccgttcagcggcatcggccaggcgtcgcagtggccgtgcataggtggctcgaagtgccggctgacgttgcaccccagtcgctcgcgctcctcctgtgccgcggcagcggcagtggtggcgacggcagcgtcgccggcctgatcccatggtcctcccggacgcccagctcgcgcagctgtagcaggagcgtgtccacgctcggcgtgccatcggcgtcgtggacggtggtcggcgcgggcgcggtgaccctcatcgtcttcaccgacgtcgcggtagcacttgacgtcgtaactcatacgcatatacgccgggtacaaacggccgcatgtacatgcgtcttcgtacgagcatatatatacatgcatggagacgaccagctatagcctagctagcttcttgttggtttgccgcccgataacatgcaaacgtatatattagccaagcatg

SEQ ID NO: 57759 - DNA, 13543 bp, Oryza sativa
cgactgcgaaggtctcaggggctactgtggatattatgggtaccccatacccacacggcatggttatccgactagttataggggataacttatatctatgtaatatgtaaccgatcatgacttgggtattacgtttccttttatattatggagcggcctaaagtcctgattcgattatattgtaaaatagatttaggaaaccgataccgtattggttaaggtttctatcttgtaatcctgccccccatcctatataaggtgggcaggaggccctctagggggcatgagacaacctgatcgtcagatctatactacacccggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacaccgactcatataaattccatgcattctatggtgagccacaaataatgttaatctttccttaagaaaatcccaatatcccagacggcaaacttcagcaggaaatgggcgttcaatatgaataactgatggaaccatgccattttattttctcaccccccaaatttggtccagcctatgttgagcaatattttagctgagaaatgggccaatactaggcaaatctaaattaataatgggccgattagtacaaagtaaacacattaacaacgatatgatggcgatggcgctctttctcggaataagttcaatttaggttcctcaatttgttgcccagtctgattgttgtccttgaaccacaaaaccggatacaacgcaaccccccaacttacaaaaccaatgcacataaggtcctaaggcggtttggatagcggttttggctgacgtggcgcctacgtgactggtttgactaggtctccgtcccacctggtagtgacgtggcgcttacgtggcaatcatatctcggaaaaataataaaaaccatgggcccacatgtcaactacacaaaaaaataatttaaaaatggtggggcccacgtgggcccacatgtcagctacaaaacaaaataaatatggtggcgcccacctagtccccacatgtcattccctctcccctgtcggctctccctcctctttctcatcgcgccacggtgccgcctcacagccgttgccgccgccattgggcgtcggcttggatctgcgtggaaaggaagggcgggcggcgaggagaacgacggagcaagcgagcgaggcgggcagtgggcagagcgaaccgacggcgggtggcgaccttggtgagacggacagtgggaggagcgaactgatggcggacggcaacctttgtgaggtggggaggaggcggaggggagcgtggagaagtcgatagtgacggccggcaggaagaaggcaagtgtgctggagatcgagcagaggaaatccgcggtaggtccatcgtgaaagacgacaacgacaaggacatcggtggcttggagggccacgtcagtggcgaggacgggcgccaccgaggccagcctctcacctgcggcaccggcgttgttgtcatcgtcctctgcagccttacccctcgtttgtgccgtggtcgccgcctgctagagatgcgtgtggagctcagccttgcccctcgcttgctccggccgccaccgctccgccggcctgcttcggccacggcccgccccacccctcgcctactctggccgggagagagaggaattattttgtgtgtagctgacatatgggttccacgatttttattattttttgggataaaattgccacgtaagtgccacgtggaacaaagatctagtcaaaggagtcacgtaggcgccacgtcggctaaaaccgccctccatactgccgagggacctcgtttgcctggttttcgtaagttggggataggtcgtactcggttttacggttaaggaacgaaaatcggactagccgactaatagagctaccttaagtgaacttattccctctttctcccatataacattcaagttatttgtcctacggcccacggccacgagagaaggatgacgcaaacgcaaagcatatcgtttccgaaactcctagttggcgattgatcgccaggagtgatcggtttcccccctttctccacgtggtttcctttttttttttgtcaccgcattactttcctattttagtaaatttatgcatctaaagtttatacatctcaagtttacacatctaaagtttacagacccaaagtttataaatcaaaagtttatatattcgattcaaatttgaatttgaattcaagtatttttaatatataatatttctatatatctaaagtttatgcacctaaagtttatagacctaaagtttataagtcaaaagtttatatacccgattcaaatttgaatttgaattcaaatattttttatatatagtattcctatacatctaaagtttaaagtttataaacctaaagtttatagacccaaagtttataagtcaaaagtttacatacccgatttaaatttgaatttaaattatatccgatttaaatttgaatttgaattcaaatattttttatatatagtatttctatacatctaaagtttataaacctaaagtttatagacccaaagtttataagtccaaagttaacatacccctttcaaatttaaatttgaattcaaatattttttatatatagtatttctatacataaatttttttaactttgtttttttatttttttaaaaatttatagtgtagtaggaagagaagaagtggaggagaggagcgcgcgcgtgtacagaggggcatagggatcaatcgatcggacgcccattagccacaccctatggtttccgttgctttggttgctatgaccgtcgttaatcttagtttagatcaccatttctttttaacgaaaaaaaaagaatcaccatttcttaattctttcggctgtgatattaccaatctggtttacaccgtaggaggactttccggtaacagccttaaaaataagttaccacttgtttgaattgggttttaatgcacagcttaatattcccgtcacttaaaacctttttttcttaacactagcaatatgttcgtgcttttgtaactgatcatacctatataattagtgattaactaggtgggtggattgagtataaatcatgagctagacccatataattaagaattggctatgtttgtggattgaggagaaagtagttaacgacggtgtggttaattcgcacatacgaaagagcacacgacctcttgcattcagtgagaaggagacgtaaggacggcaactatgtttttgaagcagtagagatataaacacaaattaactcttaaacttagagcgattagaatattatatacatataattaaacatatatccgtatttgatattattcaactattatatgggatacttgttttcgtttctaaatccaagaaaaatatgaaagaaaacatagtaaaaaaatattctcatttttgtgccatttttcacctagtaggtcaaagtccggccaaggttacgttatgttcgtttcagctaacggctgatgaattttgtgtactgattattgtaccatgtttatagaaatatgattattgaaaactttatatatcagcagtactgaaacctaacttgttctaaactatttattagcattatagggacaagcaatttgtcaataatctggccaatcatttcatttcaaacgctcccaaactagttttgcttccgccttacaaggtttccgccatgtaatacgagcatttgtggtatttgaaaatttatctacaaatataaatattttaaaccactcacttcgtatcaatttacttgtcattcttgtactcaattttttttcaaaatacttgttgtcctctcctcacatccaagtaattttagagatgcatttccttcgtacctttcatcaatacagctatactagtactcctcacaaagaattttaaggcttgatttaggaaagatgattaggatttaattaatgagagtagtaatataatttgatacacattctagttttacgtgagattagctagaacgatagataaactaaaacggacagagtactactctttccctatccatcatacaactacatttatctttctcaatcaagtaatctctcatgtgggtattaaaagtacttttatctctacctaatttctgctaaaacccctaaaaaatacttatatttgtcgatgtaaagaatatttccatgtaaacgagtaaatgctgctggcattattctatcgtaccaagatgccaagtacatagtcttttcgtcccaaaatataagccgtttttaacagagattaaatagagatgaagttaaactagctagagattattgggattggttgagaaaataaaacagatatataagtttatcatattttacaataaattttgaactcttaagaaattgcatattggaacggagggagtggtaattataaacagacaaacagtagagctcacaacttaccccgtccgtgcgtacgtagcagcactgcagctgtgaagcagagcataaatccgataccaactctgccgcacaagctggaaccgaactaaaagcatccatccgatccggatccaaacgtagtacgcgactccgacctctgctctcttccttttacaccccatatccatcgtcccgcctttctttcccttctttctttctatcttttccacgaccgtgccacggcgtcagccagcaaactaatactaactacacaagcctcctccgttcctcctcttcttcttcctcattctcctcctcctctcgaggccggccgagatatcaatggaagtcgaataccacgaggtgagccgcgcttcgcattgcatctgttctatcgttttcccattttctcgcgtactgaacctgacatgcattcttccgggcgccatggatggatggggggagcaggagtacgtgcggaactcgagaggggtgcagctcttcacctgcggctggctgcccgccaaaacgtcgcccaaggccctcgtcttcctctgccacggtacgtatgtagtactagattcaaagctcgatagctagctgcatatgcattgagcaaaagaaccaaccgagaatgaactttgtctttgtttctctctgaaatttttagacggaaacgagattgttctcatgtttcgaggctaattgattcttgttgttttgtttctgtgtgttgttcatcaggctatgccatggagtgcagcggctacatgagaggtatgaacctggcacacatttggcttgtctgtttttttccccttttcttttgcttgtttagcttttgcttgcctcagacagagtagagcatgcatgcacagagaaatcttttttttttctgtgacttttttttttggttggacctctccatttgttctgctgccacctgggcacgtagcgattaggaacccagcaaataagaacaaagaaaagaaattttttaggtggggtttcacgagttagatgttggtaggcgtggatatcacaactctgcttctagatgcattgatggattcacatgcagctttattcaggctgtgtaattgttggtcattatacagtgcttctagatgcttttggcactgaaaaattctcatacagtcctggccaccaatctgctgtaggcagtaaatggtggaggatctcagtaaatatatatactgtcttaatactattgccatatgtttgatatactaccaaattaacatgaagaacccaaaaacgtattagcggttagtgctataccatttatacaagatggtagatagttaatactccacttgcataattctggtgggtgcccatatagtttgctcaacaacactaactcttctgcatgctacaaattcagttaagataactttaaaatatattcagttcagagaaccttaacaaaatttcagttcagagaacctttccaattctgtctgcactgcgatgtagtactagactactagtgtatagtgctcgatctgtcattaacctagatcatgaactcagagaaaagggagggttatattcgcagtaatagtgttcttctgtctcaagaggatgcagcatgcaagcatcgatcacatcgacatggatattgatcaatgtggacacacactgcagtagcagcggtaggagtagctgctgcgatttactggccgatcgacgcatttaaaagccgtcctgggcaggtcgatctcgatcgaacgatcgatcgatcgatcgatttcgatcggttcaattcaaggcagcaggcaggcaggcagtgatgcatgcacctcccaaaattaaattaactgctccccatcaatcattcatatgcttctgaccttgaaaactacctcctgtctcctcctcttttggctgtcaccagtggtaaccctgttgccacatctgcgagctcattgacctccatagttaatcgactgtagagtggtctagcgattagcacgaccattagtcgatttgcacgtgttgtacaatgtagaacttgagcaagggtgatgcatcattgttcctacgaaaagcatctctcaccttacattctatatagtcactatgtgtctgtcatctttgtagcatgtttttctgttttaggactactttgaaatagaaaaatttcgtgagaagaaattatcgggtttacactagttttcctccgaaaattctgtaaaattcttacatttcaaagcaaccctaagatttagttaggcttttccaagtcatttggtagttgctgatcgatgagctagacacattggtagccaccaactaatgctgctattattgaagtacttgatacgtccttgagccggaggctagccaggttttaagcataagcctgcataatctgttctgacggtccctttcaagcatcttctgcaggccatagttgtcaacaatgcaacgagtcccttccatccatgcatgatgcatccattaatttctgatttccatccatttatatgagatcgcgagaaggaaattagagaaaaaaaataagaagggaggttgcagtacaggtgagcggcctgacctgccggccctgaccattaagttaagcaccaaccacaccgccaactcttttccttaatctaaccaccatatttaacactaatcacacacgatttaagcagacgacacttaatgagttgctttagcatcattgttattgttgcgtttaatttagctgagagatggcgaggcataatttgccacttgtcgaatcgcctcaatctctattaaaccatctccttcgttgtttgtatgccacgttagtaattataaattaattaaaattttgagttttttaaatgtttgaaaagaaataaaaattgggttgggtgggtgtgggtgtgggtggttgcaacgctgcgtcagcttggctgatccgggctatttggcaaccgatcgaaggagtgttgatgagcattgggcacacgacgagaaggatggcctacgtacgtgcctgcaatgcaatggctgggtgtggttgagctgccattaaaattccttaatggagtagaggttgcagatcgatctagctaggccaccaagtactactactgtagccgtaatgcttgggttcattcaatactgcgacttgacgaattcatttcctgacaatcttggctgtgtacagtatgagtagtactgtgtggtagcaaattaagtattgtgtatttgtgtttgtgtagtgccagttttacagtattatactcccaactgcatgcgtgcacaatactgtaccctgaacttacactgtgctgtattacacccctgcagaattggccccgttgatctgttaaaagagatatagaaaacttgtaggagttaaattctatatgaaaattgtctatttggttctttaaatcaaacgattgagactccaataatagttctataaaattcatataaagtggttcaagaaaaggagagtttgctggaaatttagcataaggtcgaatcacatggaaacttttccttcatgcctctgcgttgctgtagccaaggcagcagatcaaccgcttatttttcatatgtttttcaaccatgtgctttacactcgtatttccattaaaaaaaaccttacattttttatagttctgtgtgtttttcgatttcttgttttaaaggcttaatttattagctagatgaagtgagtatgtgacaatatctgaatcttttttttatatgagaaatgggttcctggatatgtggaagagtaacatttgggattggatggatatgggatgcagagtgtgggatgcggctggcggcggcggggtacggggtgttcggcatggactacgaggggcacggcaagtcgatgggcgcccgctgctacatccgcagcttccgccgtctcgtcgacgactgccaccgcttcttcaagtccatctgcggtaaacaacaaaatctctaccctttcttcattacttccctcttcaacctctctgcttactttacattcagctacacaatttcagtacactatcaagccaggctctgtctgtgtgtagctatgcaatgtttcaacttagctgccgtttactgtacgtccgttttagcattagtgatgacatgataattcaggcaccaactagcttttaatccttgtcgttgcccgcttaggctaaatacctgaatccaacatatggtagctagccagctacttgtcatttgtcccccacctaatgatgaagggggacgtacgtacggagtttggcacgcattgaatcgatcttggttcatcatcggcaatggagggctcgatcggtaggccattgagcattaatcatatatatatgatcgtcatcggtgatggtactatagtagggtacccactgttcagcgatcaccactacccggcaatcaccagtgcttggtcggtcctgtggcaacattaattattatcggtttgtttggattgaagccaattttactctactaaaatcttagtaatttcaatagcgtcatttgcatgtttggtttggtatcaatttttttcacgctagttcagattttatactactaaaattggtagtattaaaatttggcccatgtggctggttactcgagaggcgtccgttcctggttgctgttgtatactgaagcctgatatatcgcagtaagctacattctccgttttatattataggccgttttgattattttaaaatcgaacttcttaaaaatttgatcaagttaataacaacgtttatagcaccaaattagttttatattaaatctaacattgaatatattttgatagtttctttgttttatgttaaaaatattgctatatctttttcataaatttagttaaaaataaagaaatttgatttagaaaaatatcaaaacgacttataatataaattataaaactaaggtagtgatttcacagtataacatattagtgctacagttacatgcctatgcattctttcgtgctgaatagctgaatgatttgtgatatttattggatggtataaacgaatgaattagctgttataaagtttcaaaatacgcttaaaacagcgttctgaaaaattcatatgtacaaagtttttgcaaaacaagaaaaagaaaaaaaaaatcgcaccatttaggcatttactagttcggaaagcaaatccatggtttttgttcattaattcgttaagtgcagaaaaaaaatatactccctccgtttcagcttataagactttctaacattgtcaacatttatctatctattatatactaaaagtccatgaaacatgctacaaacgctctcaagccgccacatggcgctctaataaaatagagaaaatcctagaaattctaagaaaaaagcaaaacatctatctcttgattttcacttaaattagtgggtccaatatacaccgttagataaaattgatcttaaaacaaactaaataccatgggtcccacctatcctctcctcccgcgcattggcaggtggagtatatacgtacgtacatggtacgtacgctacctccccccctttttttttccttttttcttctttttttcatttatatatataatggatatattttttaaataatcataattttataaacaaagaatctaccatcatataacttaagccggtgtactctgtactattattttcaaataacgcactattttaaaataagttttacataattatatcgtgtacctatcaaataaacaatatctatattaactaatttatacgggtacttaaactgatggctccattatataaatcattagatctactttttattacattggtctattattatcaagtaatgcactgtttcaaaataatgcctacaccattatattgtttacccattaaattaacaatgtaaaatctatattaactaatttacacttacactagaactggtggacctattattataatcatcggatctattatttgttaataaataaagcgtccaaaattctctttttgcccgctgcataatgcaacgtctgcacttttgcctttcgcatgtgtgacaaagcatagtgtttgagacatctaaagtgatcacaaccgctatagcgctaccgctttgccacatatcaaatcatatatggatatgattaattttgttaataacatgaaaagaaaattaaaggtgtgatgcagcgagagaataattaagaaccatgggttgtgtttttctcaacactaattagctctgtttaagttgaaaccgagagttgattacataacaattataatatatttgtgttatgtcgtatttggattttgtactatttgttcgtacatgtgaaaggattcattacgttataaatgtgagcgcaatattaacgaatatcaatagaactcttactacgacaagggtgataaaagggagtttaaggccttctcttttttttcccgattccatattttggatttttgtttgcacgctttccaagtttctaaatggtgtcttctttaaataacattctaactttttaggagtcatgtcatttatttataccctcaaatagctatcacataaattatataattcatcaatttcaactatcctaaaccttaagtactacatattttttttcatgcgagccatggtgatcaggaaattggtgatcaacggatcatcaaagtcgtaagatgaatatataagagttactcttaacaattgtaaataggtgtcaaaattagttgctattaattagacatctaatggcttgctagccacaaaattaatttctctctacatgtatataaacatggacgaagttggaacaaatattaccatatgtcccatacatatatattgcgcagttaatattctaattagtcatttaaaattccttaaaatactctcaagctgtcacgtggtgctataataaattagggcaaatattataaattctcagaaaaaaatcaaagtatctattatttgattttcacttaaatcggtatgtccaatattccgttagattaaattgatcttaaaacaacctaaatactacgaggtcccacctcgtcataggtacgcacctacatacgcgggtacgtacgcctcccctccctttttttcatttttctctttcttctttttttcctatgtatatgtttccctccctttattactatatcatgcgccttcatgagacgatttaatcaaaagaattttgagtaccttgcactcacatttttaatttgcggccataatacacggtatgtatatacatggactgtatgataattaactatcaatagtttctaatttactcgagaaaaaaacatgattcaaaaatcataattacttaatccatctcctactcaaaagtttgtgaatggttttctaagataccttaagaaaaatagaacccttaaattattataaaataatattatccaaactttagtttgccctaaatctatgagacaaaatttctgaacaaacaataattttacctttcaataatatagtgcccgcgcatacgcgcgggccaccttcctagttcatatagatgctaataaatctaagcacatatatttgtctaaattcattaacatatatataaatgtggacaatgctagaaagtcttataatatgaaacggagaaattacttctctgacttctaccagaaaaccacagcaggccaaacaataatcttacctttcaataatatagtgcccgcgtatacgcgcgggccaccttcctagttcatatagatgctaataaatctaggcacacatatatgtctaaattcattaacatatatatatatatatatatatatatatatatatatatatatatatatatatatatatatatatatatatatatatatatatatatatatatatatgaatgtggacaatgctagaaagtcttataataagaaatctgacttctaccagaaaaccacagcaggccattttaaaaagacgtggatattagggaatgacctaatatgaaataattagaaagggtgagacgtcgaacccaggtcgtctagcccaccacctcgtggagctagctgcaagagcgctgcgcttttctcacttcaggccattttcccaggtcttgcatggatgcctgcctcactgtgactgatgctgctcgcattgcaaaatttgcagacatggaggagtacaggagcaagagccggttcctgtacggcgagtccatgggcggcgcggtggcgctgctgctgcacatgaaggacccaacgttctgggacggcgccatcctcgtcgcgccaatgtgcaaggtagctcgctgcatgcgcgtgcagaaatattcttctgaataatttgatctgagaaaaattaagactgaaacttggtgcgtttccttccgatttgctggtgttcagatatcggagaaggtgaagccgcacccggtggtgatctctctcctgacgcaggtagaggacgtcatccccaggtggaagattgttcccaccaaggacgtcatcgacgccgccttcaaggaccctgccaagcgcgaaaaggtccgtgcaaaaacatttgcagtttttttatttctgttttgtgttatcaagtcagtttcagtaacatttgcttcagttaacattggtagtagccctatgttaactgttaagtttgctagagaaacccacatgatgagttagttcaacatgatttctgaacatttgatacagtggtccaacagatttgttgtcgttgagcatataaactcagtttggtgtgttctttgccatgccatgccaaatttaacagatcaggaagaacaagctgatataccaggacaagccgaggctcaagaccgcacttgagatgctcaggaccagcatgtacgtagaggacacttgtccaaggtatgtacccctcgtcttcaaatcaactcaatatatgcaccaattagttctcacatctttaggatggcactaagatcacttgagtatgatcttggccatg

SEQ ID NO: 57760 - DNA, 1739 bp, Oryza sativa
ttcttctctaatgctctattgctgtcactattttggaaaaaactatgctgacttggtgtagtttttatcctactcttcccttgtagcgaggtatccaacaagtgggggggggggcccttttggggaaaaccccccttctctcggagctacttctaccaagcaaaagtgtaatcttctaaacgaaagattcaaagcatgggtgccctaaaaattaggacagcccagccacaatccccagcatttggaattccagccagtagccctcctttaaaaaaaaaaaaaacaaacatctatattctcaacggttcatattagcagtggctccatagtactatagccttttcaaatcacagggtaatccaataatagcttatttttctgtcagtattttgattcttagaaaaaatttctagaacaaataaacataattttgttggtttctgtcctacagtaaaattataagaaattaatacggagtattgacagcataggtgttcccatactcttatctgttatccaacaaacaactcagtccaaacatgaaaggtaactattaagttaatttgtcagttaaatgctgagacattaaataatatggcaaacaaaatattggcagagaattattaccaatggggttgacattgccccagtaagtctccacctgagggtgctggaggggatctccatatacctcactggtgctggtgaggagaaattttgccccaatcctcttggccaatccaagcatgttcagtgtcccaaccacgttggtcttgtgtcatctcaaatgttaaggctcacagtaaccatttgtagaaactaaaagaaaccgctcatcaacaaatcaaaacacttgcttgtttgacctttcgggacagacattccgattaacaaatcggcacgaaatccactaaactagatctagttgttggaaaaaactgtatgcaatcttgacttggtttcttccactaaaaatcgtttttttttcacagttacttaccacaaaaaataaatagaaagcataattttgatattcaatcctttttggagttaaaacaacattaagcaaacttcgtttccatcagttcatgaagtttaaagcaactagagatgcgggttgcagaacgccagatccaaagatctttaattagagcaatccagatatgccagtttatgtatcagaaagcaagccctgacttcatgttcagatggagtataaagtatgcaatgaatttggccaaaaataaatgagaaaggttgaccagacaatcaagatgaacacctcagctccagaattacagctgaaatctattcacactctatttgttatcggaaaaggctatacgtactaactttttcttactaaattcttactaacacggatatgtcatgctatgagtatatctagattttttataacgtccatctacctaaatcaagcagttgaatatatatgcttaaaagaaggaatttccccatccaaaactaaccgaatccagcaaattcacctaaaatcgacaaaatttaactagaaatgggaaagtaaattaaacaacccagctatcagttagcaccaaaacttagatgagcatcgagaaagagtaattgatgagcaaggatatgatggtcttgatggggttgtacttgtagtgcacggggctagcggggcaggcgaggtggtagatctggtcgacctcgagcaggatgggctcgacgacgtcgtggcggatcacctcgaa

SEQ ID NO: 57761 - DNA, 8687 bp, Oryza sativa
ggaaggggcgtagagggagaagagggcggcggcgaggagcatcccggcgagggcgaaggcggggcggtgctcggcggcggcgtagcgggcggcgcgggtgagccaggagagcggcttggagggcttgggggagtactccccgccgtcggaggcggagcccggggcccccgcgccgccgcggtacgtgagctccgacgccatctccggcgaacgtctcagatgtagaaaaaaaaagcttctctctctctcactgagacgtgggacccacgcccctataattgcgtgtaaggaccaaggacgggaggttggagagtcagatttctctccgcgccgtcggcgaggtttatcgcggcgagggaaaggaaggggagaggtgtgtttaatacgacagccacgctgcggggtggtgtgggttgatctggtgcgttggatttgagatggacggtaaaattcggggagtttagattttttttttccgcgagcagaaaagaagaaatggacttggctgtatattgcgattgacttatcagcacaatttaataaattttcaaatttaatttgattttgagattttttgtcgcagtttttcttttatccctacttttagatagtttaaaacatgtatataaaagttttatttataaattaccttttatttgcaaatatgtgcttttgttttttcctccattatgcaaaatgatggggctactaccttggggtaattcttcacgtttcaacgtttgggggaatacttatgttgcgaacaataaaattgcgctaaaaaatgtgaaacatttcgaagaggcatacagatggataacaatattttattcaaccataatttgatccgtaaaacaaactgaaataattatatattcgtatctaaaatttatctccacgccaaatcaattattacaaagataaacaagtgaagcaaccagaaattaaaacttaattgtactacttgtttattattctgcttagaaggtgtttttacaactgcagcttataatggaaaaaccaagtaatacaaataattttagaatagaacttctataattctactcttgacagtacaaaagtcaaaactgaaaaaattaaagtgatggaaaaagaaaaaaaaacctagactaagttctgattttcaaatttggttatgactttcacacctcaaacaaacatgctcattaattatttacaaagtatgattcaagagaacgtagcttaaattccacgtgtaaaaattaactacatattcccacgcatccttagtgcagtgttgattctctcgaacatgctgacaaataaggtatggagactcggatgaatgtgttggttgatatccgactcattttttcggagctgctgatcatgaatataagatgtgcatgtatacattcaaaagggtgagtgtttacttgttgtgatcgtctatatttgtaacttgtgagcacccctttgccccgtgagccacctccgtcggttgtgggcagcacacaaattaatcgaataaactccctactattttgctgagtgtagatatataatttattttattaagaaacacactacaatgcagacacttacaacgcgtacaaactcactcttataaacatgtgcatacattctatttctatgaagactaaaaaacaatatgtataaacgtacacacacattctacctctttaatcaccttcgaaaacaccatgctatgtcgcagcagatcgcgaagagaaacaacgacaatagggctaataacacgtactcgtactactttggacctggagatataatatatcgtagtcgaccttatcctcgttaattagtcaccgttcttctatttgctacaagatgacacctaatccgctctagccaattgccacctccgcttgctaactactcatttggatagttgcaaaatgaaatgggcgtttgtaactcccttaaatttatactatctatgtagtactacatgccaaggatgtatgactgtttactacgtgtaaaagataaggagatctgaaatatatttagtgagtgcatttttcaatctctctctcaacactgattaattaagaagaggtagaaaccgtagaaagccagcaaattgctgcaaatgtggaatgtactattgcaccttactctttcatgttgaactttcagcgtttggacgcatgagctcgctttacgcgcctccagatgaccttaattacaaaaccgcaccttcctgaattcttttcacatcatcagaaggaaaacagaaaacatggcaatccaagagcggctgcctaaattgtgtatctgtttttttcttttccttctcctcacaagaaaataagtcttgcatgcccaaatttgccaaacttcgtttggttcagcagagaagaaactttgatttcaattgttccatcaacatcaagtaggcatagtaccatcatcaaacttggactagctggatgcatggtttgagtgtctctgcatctgtaccggaaatagatgaggtgcagtgcaagtcactgtttggagtgtgtttttgcatttttggagggccaaaatcgggattgctatatagtattcgaataaaatttggggatgaaatcttacagattttggaccattggatccatgttaagattcgtgcatcggcctctctcctctaactccggcgggctccccttcttctccggcgccagcgacaccccaactccggcgggttagggtttgaggttggggtgagggtaggcgggggttgggggagggggaagagaggggtttcctcggagcttagagggatggccgtggacggcggaagaccggtgatgggcggtggactccggcgggcggagaggcggcggtggcgccgccaaagctgcggagatggaggagggcggtaggccggcatctgcggcgggggcaaatcaagcgtaagattaggaggaggcggccggtggtggtgaatcctgcggcggggagccgccggatacggtgaatacggcggggcgggggcacctcgtcgtcaccgctgtgaggagaaagagggggggggagggggatgggagggggctcgccgggagggtctcgccggcgccgttgactctttccggccagccggcgaggcgggcggcggcccggtggggcggtggtggcggggaatcgcgggagaggataggaggaggagtggtggcggcgactcagtcacggggagaaggaggagttagggttaaggggctgcacgaatctcaaagcatatctaatggtctaaaattcgaatgataggaggtgggattttctgtcacatgatatatagacagcgccaggggcggatcaagaaacaaaaagttggggggactcaacataccaagtacaccgatataaacacataatctcagtactaaactatgctaaaatgctattataagacctttagcacctcctatcttatcaactatgatgaaaaaattgaagtgggggcttaggggggtatccataggttttgtgggtgcaggggcacgttggatccgcccctggacagcaccactaaaacaatagtgcatatcagtgcgttgaaatgatgtgttgtactaattcgaaatcgggccttacatgttaaaaatttagaaatatacgtattttctgtagaatttgcaagaaaatatcgaacgcgtgaagatttgcaaaaatataccgccatcgtggtttcgttgagcgagatcgtggtctcgcacgatcgaggcgcgagaacgagagcggtatcgctcgttcggtcagcgaggacagagcgcacacggtggcctaggcggtgcgattagcgagagcacacggtgtcgcactctaaaagtgcgagagcgagccggtgggccccgcaactgctgcgatgcgcgatctagcatgagaggaaagcgagagtgccggtgggcgcggtctcgcgcaagagagatgcgagagcgctggggccgcgactgcgatccacgcagtctcgcgctacaggaacacgagagcggtaattagtgattaattaccataattagtgattatttaatgataaataatgatcaattagttgctaatcaatgtgattaagacattaatcattggccccacagcagcccatgcggtctcgcacattggttgtgcgacaccgtacgctctcgcaaaaccaacacgcgagaccgcgggccctccacgcgccatatcgcactcccactgtgcgataccgtggctgcccgatcttccaactaaaaagtcccgctatcgcgctctaaaagagcgatactgatgccgctctcgcgattcgggcatgcgagaccgcatgcccgcgctctcgcgcgtctaaacccgatagcgaccccgttctcgcgctgccaataagcgagaccgatggcgccacgtggcactctcgctcggtggaaacacgaaaccgcatcgatattgcataacaaacaagtgacaccgccagctcaaatctcctcgccaattcgacgcgcgagaccgtcaagctctcgcacattggtaatgcgataccgtggcgatctcacgcttttccgtagcgaatctcggtatcgtgttttctatccgtgatttcgatggtatatttatgctaatcaaaccacatccggtatatttctgaaagaaagatcgatgaacagtatttttcaaatttttttcttacatgttcttccaaatatttggctgtgttcgggagctcagtttggaaacttctccttccgcacatgtagaaacgatgtctcattatcgtatgattattattagctaaaaaacttaaaagagtaaagttcatcaccggtccatataaacttgtaccgctgtgtcatcctggtccctaaactagcaaatcgaccgtttagatccttaaacttgttcgactgtgtcatcccagtccctaaacttgcagatgactcgtttaggttctccaacttattcagttgtgtcacccaggtctctaaacttggatttgaatatcatctgggtcaaataggacggtctaaagactttatatttaaaaataattcataactttttcacgtgaactctaatgaagacaaactttatatcaaacttgtagccctcgacgcgatctacaactttgtagttgatttttttattttaagtcattttttgtcccaaaatgtaatttttaaattaaaatttcaaaatctataaacatgcaacaatattttgggaccctaaacagttttaattcaaaaacttttcaactacaaagttgtaggtcgcgtcgagggctataattttaatgtaaagtttgtctttgttagagttcacatgaaaaagttatgaattattttttatataaagtttttagaccgtcctgtttagggaccggggtgacacaactgaacaagttggatgaccaaaacaagtgatctgcaagtttaaggaccgggatgacacagtcgaacaagtttgaggacctgaacggtcgatttgcgagtttagtgaccgagatgacacagcggtacaagtttagagatcggtgatggactttactcaacttaaaatatagattaatataatttttaaagcaacttcctttttttaaaaaaatgcaccacttagcaattcgagatgtgcgtaaaggactagtaaaggactagtgtgtagatctcaagaactttgcacattcgaacacagccaagcatagttggctcaattttttgtccataaggctctaggtatggatgggaatgatttaggagtgaagtacgagtacttaatacttaaaaagtattacgtacaatatgcatgccgtacagcacttagggctatttaggggctgtttggttgttgccactttaaaccttaggcctgtcataatttattaggttagtgtttggttgagtgccacagttaagtcaagtcacactttgttagtatactggccacacatcatacttttattttctagctaaaatttgtcatagctatggctaataaattattggccacatttgtgtctcttgtcactgttataacaaaatggagttgtaacaaagtcatcgaagtcccacaccggcaacgtacgccatacatgccattcttgagatggttaagcctttgctcatttcatattcacgacgaatatttgatcaaactttcaaaaaattaatcatcaatatgtttttaaattcttacctttaaaaattgtatgcgtagatttacctttagaagacactatcgtactgttatatacttatcagattttatatattacatcgatggtcaaattatcaaaagattgactatatatttatatgatcggagagaatacaaaacaaagctttttttatgtgactgcgagaaaacttatgttttgtcactctgagaattgccccttcaattatgttactactatctaacaaggaataagttcattttatgacccttaaaagtgatcgaaatctaatctataaccctaaactacaaaaccaatatctcgacccccaaactcctaaaaccggtacaatttgactccttggacggttttgggaggcggttttgctgacgtggcgccacgtggcgcctacatggcaatattgaccgagtcttcgacccacgtggtgttgacatggcattagaattaaaaatatgtgtgggacccgtttgtcattcacacaaataaaaaaaattgtggggcccactgacatgtggaccctacatgtcatccttcttccttcttcctcctccctctctccccttcttccccttcggctggctgcggcagctagagctagctggagcggcggcggtggcgggtgggcggctcggccctgctctagctcggagggccgaaacttgtggccgccgccgccgtcctgctcgtctcgcaacggccccaagtggccgcctccctcttccacgtcggcacggctgcgccgccgccttcgactgcgtggaccgccgtcttcaacctccgcctctgtcctcagccatcgacaacgccaagtgcgaccccccctggtcgacttcctccacgacgccgaccccatctcgccgagtgttagccttgccatcgtcgactcctccactccggggaccgccgccccgtcggaggggggcgaccgcctctttgtcgcgccgaggtccgtcgccgtcgacccgggggatgagctccttgcgccacctccgtccaccatgccggcggtgctccagaacccactccagctagcttccgctgccgccgccgcttcagctcccgccggcggccaccacaccgcggcccatgccccactgctggtcgagggtgaacaaggggagagagagaaagaagggagagagggaggaggaagaaggaaggaggatgacatgtggggcccacatgtcggtgggccccacaatttttttatgtgtaaatgacaaacgggtcccacaattgtaatgccacataagtaccacgtcaacgccacgtggatcgaagacttagtcaatattgccacgtaggcgccacgtcagcaaaatcacctcccaaaaccgcccagggagtcaaattgcaccggttctaggagtttggggttaagatatccggttttatagtttagggccatggattagatttcgatcacttttgagggttatgaagtgaacttattccatctaacaatgacatgtgtgaaatcatcttggtaaacaatttgtgggccaagagcccaagaggaaaaataacgaaggccattttgtaaagtagctaaatactgctacttagtcccataataatattaaatagtctttggccttgtacatccatgcgaacttgctaatggcgcgacaaaccgcgcggcgagacacgtgacgcgcgcggagagggccgcggcggcagcgcgtgcgcagtgggcccgggcgttttttttctttcctgtttggttttttctttccgttttttttctggttttttcttctttttttcttttcgtttttttaaacatatacttatacaaactttttatacgtacttatataaactttgtgtatgtgtatataaagtttgtatacatatatacaaactttgtatatgtcatatataaagtttgtgtacgcgtatacaaactttgtatctcgtacgtatacaaaccttatattgtggccaatttttgtttctgcctttgtttctgattttttttttcgattatttccttgtaggtttttttggtttttcgttttttatacgtatggaatacaaagtttctatacacgtatacaaagtttatatacgcatatacaaactttgtatcccgtacgtatccaaaatttatatgtgtacaaactttattgacgtgatgtattttttatttttgttcgattttttaatatatacatatataaagtatgtatgcgttgtatataaactttgtatacgtatacagaagtttatatacatgtgtgtgtctatgtatgtgtgtatatatatatatatatatatatatatatatatatatatatatatatatatatatatataactactatacagcaccctaaggcgctacttattaaacaacacctgatatagccttcagccccaccaacccacgctccctaccaggtccataatacgtagttaaaatttaactcaccgacgaccaatctccaatccacccctagccgtagtagtaatttttttacttgcattttgcaccacctatatatgtatttgt

SEQ ID NO: 57762 - DNA, 693 bp, Oryza sativa
gatgactcatctttgatgtcaccgtcgctagggcaccatctcccacggttccttccccgttgtcatccacctctgcctctccacggatcccgttgccctccatcggtcctcatcactcgaatcccaggctacctcgaagaccgaatatcgggtcccaaaactaatgacttggatccgactgagattaatgtatcaatccctggatcagtaaatattgatacatacaatatagctggttcttcattgcatacgttaaagtttacaatactaagggttttacaataataggtactcacataattaaacataagtaagactattacacagcggaagtttttatacattctaactagggaggtataacctctcgggattttctaagttatcagggtcatcatagtaataatcataggggtcctcctcttgacccaaatctgaaaaaggggttataagagaagggggagtattcacaatacccaacaagttaccatggaaacatgttatgcattggtatagagtaaagttctttgcaaaaagcaataataaacaatctggaagtattaaaccaaaagtttgtaaatatgtagactttaaggttctaaccagggtaccatatgagtcccgggactcaattccgggagtacagctattcgaataggttcataaatattctactggagcagatgtacgctt

SEQ ID NO: 57763 - DNA, 54095 bp, Oryza sativa
ttctacaggaaatggaagaattgacgagtgtcattgatagaaagaagaagagagaaaagaagcgtcaatcaaagcgccgtgcaaaggtatatcagtcatgagatatagatgctgccattgccaaatgggtggttaatttgagttatgtgctaatacactggtcttttcgttccaggataaagcacgcaaagcaacaggaatgcaaatagatgctacaggagataattacggcgatcctgatttgttttctataagtgctatcaaggttcatgctgtttctgtagtcatatcctgtgtggttcttaagtatttagtactaatatttgtttaaaatcataggacaggtgttcatttgcatggctataattttcctgaatttgaaagtgtgcttcttttctttgcacttgaaatatgcaacgttcgtgctcctcagtaaagtttcacttttattgatctctccatgcgacaatttcttagtgtggtagcctttatcagtattcacaaacttagtaaattgattttcgttatgttacgctttctcaaagttactttccagtatgagctgtatagtctacacttgtcttgtgtaatacttactatcatctaaatagatagtttgtgtcatttttctgtagggcggaaaagaactccaagctattgaatcggctgagcttaatgtagaagatgcccaaggagatagtgagaatgaggatattcaaactcgtgaatactctgatgaggaaatggattctgacgaagaacagcagaggtaaatttcgaaattaacactcaataaaacatacaataagccggtcataaatttttacaggttttataattttaccgcaatcccaaaaatgtgtaacatggtaatcttcccaaccaggtatgatgcccaacttgaggaaatgcttgatgaagcttatgagcgttatgtaactaaaaagggtggtgaagtgaaacaagtacgcaagcgtgcaaaacgagtaaatactgatgctgatgaagaattattagaggtaatctctgacacatggatcttgtctcaaccaaatgacaattgcatctttcggtctctctgcatgcaattggggtagttaattatgccaatttacacactgccctttatataactagattgcatgggtggtaatagttgttatccttatggtctgaacttaatagggaggtgaagatgacggtgacgatgttgacatggatcaaggttctgatgaagagcaagatcaagagaccaatccccttttattatccctagatgcagagaaaccaacaaaagagcagatgatggagcagtggttcagccaggatgtattcacagaagcaggaacaggtgtggttgagcagagtgatagtgaagatgaaagagagcagctaactaggattgcaaaaaagaaggcggattctggaaagaaggaaaagtctgctaaagcaaaacacttgcaacaggacgattttgagattgtgccagcagaaccagtccgaactgaagatgactcatcttcatcttctgatgagtctgatgaactagatgaggacctcgacgatgacacaaaagctgaagtactagcctatgcaaggaagatgttgaggaagaaacagagagagcagatacttgacgacgcttacaacaagtacatgtttgacgacgagggtttacctaaatggtttgctgaggatgaaaagaggcataaccagcctatgaagcctgtaacaaaagaggaggtagctgccatgagggctcagttcaaggagatcgatgctcggccagccaagaaggtcgctgaggctaaggctcggaagaagcgcgtcgccatgaagaagctggataaggcgcgccagaaggcagatgccatcgcagatcaaaacgacataaacgagcagtcaaagaggaagatgatcgacaggatttacaagaaggcgattccaaagaagccccagaaggagtacgttgtcgcaaagaagggcgttcaggtgagggctggcaaagggaagatactggtggataagcgtatgaagaaggacaagagggccagcaaagtgaagggtggcaaaggagctaagggcaaggggaagaagggcggcggccagaaaggcggtatgcgagggaaagctgggaggaaagcccaaaactgagtagcaatagagcatgactgaattttctactgaatttttgttcagtggctctactgctcaatttttgtttacttataacttaccgaattcatatgtacggaatttttaaatgcgtgaattatcagttgtctcgtcagattatattttcagtcccatcgttttttaagcctacaactgattataacctgtaacgcttaaataatttctggggggaacttttatacgtgttcttaggaacttaaaatcacaatgctgaaattagcaacttaatccaactttgaaaaaacgatagaggtgtttgtgtcataaaatttgtgatccattcagttccactaatccattcagagcctgcactggcattgctgcatgttgtagcgtttgggaatcagcgggagtggaacccacgcgcgtttccttgtcaagggaaaagaaagaggagcggcgctttgcctttgaatcccggggcacggcgatgcagattcccattcctcaagttggcgccgatcgatcagccttaggatcgaatccgaatccccagctttgcgctgcaaagatttggaatccggccgtcgcagtgacggccactgagctgaatcccgagctgctacttgacgattagagcaagaataatactagtgagctgctacttgacgattaggatcaagtggctggcaggaatgatagtatgataccgactaatgatggctcacagctcagggaataataatgtctcaggtgtttgtttaatttggggattaaaatgcattttagttagcactatttggcagatactgaagatgctgcaatgtttaaggggtttaatactatgattaagggagaagttgaccgtgttattcaggctggtgcatcttctgaagtttcaacgtcaggcaaggaattccaagaaccaaacatctctgtagatcaaaagcagacggtacaggataatgtaatctgcgcagatatgccttcttttctgtcccttttcatctgaaggcaatactgtagtcaatccagaatctgcaattctgcttgatgctaataaacaatttcccaattgaaatgtttgttctttttctttttaaaagaaaaaactagatcagttgaattatttcaaccctcatgcgtgacagattgacaatgataagcacagtttggactttggaccaacatgaaaagcaaacgagaactcaggctgcaaatccaaaatcagcagaaatccttccagaatgcatgagaaaagctttgcacagcatgtcaattcactagccagcatctcccagaaagcatttgctcggatggttcaaaatatcagagggaatcctgcatctttccgatggctttatgcagatatgattcccagagagagatctccggtggcctggtccatgctgcaggaaggaatcaaagatgctgcttgcaagcacttgctgctctccaatggccatttgcatccgatggaccaggatcctacacgacacagttcatcacgagaaatgccatgccaggcctttggaaaggtcaatcaggcccaaatcagatcttcataaacagggggaaaagaaaaaaaaatacagaaatacgatgcaaattccatgaccctatgagcaaacggcaagccaggaacaagatggcatgtcgtcaaattcactttccagagtcattggagatggaaaagatacacacatagatatatattctttgggtccccaaagggtattttccacttcactggctgcttatcttcctttggaatatgttctttggatagtagcagtaaagtggatggctggctgggatcgcgcaaaacgcgtccattgtaaagaatggatgttcttagcccacatcctgctattctccaacgaattacatatccaaacagtgcatgcatgagcaattgtttctaataccttctgaaccacaattagaaattcggcaccatgttgagagagatttgtgaggtggattcatacaccagcagattcaccgcctagccaccatgggcggctgcccagcctcgtcagcgaatgttctactgaattttttgcatgtttttcaaggattgggataccatttccacagcaaatattagctatagttaggtatgtccgggctctaattttttctggatccaccactggatttataggctatcagcctatcatatcaaggattggaataacaggatcatagatctttcaaagaaaaaaaagaacactgaataatgggttcggtttgcgcacctttgcagttctgaattctgaagaagcacaccttcggcgcaccttgcagggcacaggcacagcctattggttgatgctcacacgttacaagctcactgctctgcatctgcagcctctgctctcatgcatcgatcgaacctgcactgcaccatgtcaggctgatggctgacacatcaccattcacagagatgctttcattcgtgatgtcagcagcatccatggattccatgctgccacgccagaattctgtatgcatgacataaccatgattcagaaatagggtttattaatgaaacaaagtgtttaaggacaagatagcatgcatgttttacatggaccatagaacatatgcagatgtagtactgtagtccccccctcttccttccaaggccatggcaacagcctacaggtaatagactgataatggcaactactaggtccaggggtgatgctcaagaaagcctttgctttggcacatattcttccgatctttcatgcatgcatgggccatgcctgtagcccagacaaaaacaacttcagctgcacaaaaggttaggctaaattgtttgcaaaccaagctgtcagtgtgcataaaacagaagttaaacactggaattagactagcttggtaggcaagctgctacttagaggggagacaaagcaagatatacaagatcactgaaggcttcataagcttatacttggagagcaaggccagctgcttgctaagcaggaaggaattcatggcaaagacgcatgtatccggatgactgtgcgatctctgcaggatgacaaaacagctacgtgataaaatcttgatggatccatagattcgttggcgctttaccttgatgttactatcctttagatctgatcactttgatgttaccccctttcttttctctgcctctttctgatgctgtttttagcttcaccgttgcttcagtgctccagttcgagcaaacacaggacaaaactggagaatggaagcttgatcagaaaacgaaccaaacatgggaatttatatctcacttttttcactgataggttgtggtaaagtctggccacctttaccttccattgaatgcaaacgcgcctgcgcgtgctcagcacaagatattgctttgtcttcttctcagaaagtgtaaagaacatgaggcaatttcaccatgctaatgcttgggggatactatgacaaaatggcacatccaagtgctgtgttgctgtcgaaagatgcactccatgccatgcgtgcatagtagtgatgaacagttgttagctctgcatgcagcatgatgcctcgatgactggaacgctcggcgcatggatccgagagaagcagctgcatgcaaaaaacaaaaacgatcggcgtttgtcagtataaggattgagacatcgggatgcccagctacatgccaggtcagctccttctcagctgagtgacacatatactgcagctccagaatatttaacttctatcttcagcaccagaaagttcaccacaaaaattttcaatgttcaggcatgccaatgtgcagccatgagccacactaacatcaagatgtaatctttaccagaagctcatcaaagttaccatgttaggcatcatgcaccatagtctcgatcgattaggctgctattttttttgccgggagattaggctgctatagaacacagccaatactatcaactgctgtaattggcattttccatcacacgctgtctgtgtccctttgctccaaaatctgcgaaccttattctcctcggccacctttaatgcacagccattattccatacagcttacagctcatacacacaacagcacccaaggccccaggccctataaatagccgaccttgcaacactgaaagcacaaaccaccagagcttctgaaagagcaagaacattcagagctaagacacagcaagatctttagcattagagctttcagtagttcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtcaagacgatcgagtccgggcgagtgcagttccccaagtacaagacgcagggatactggacctgaggtaaaaaaaaaaaaaaaaaaaaaccatgcatgccacctctcaaccaaacctgagctgcaaaaaagaaaaaagataacttgcctccaataagttttcagaattacagtcgagtagaagcatggtagtcataactaagtcagtgattgtttacaagcttactaaatgcaatgatgaagaatagaccatgtatatttggctgtttatagatggttcatggtttaacttgaagatacaacatgcagggtttagtactttatattctttccatgttgccaccatgcatgactggcatcataagcatacttagacaaagagtcagtaatttatgagtgtctttgtaatctgacgccctctaatcacgtgggatctaatcctagcgctatcagaataataccttccaaaagaaaagctttggtcttagagaagtacagtctacctcgtgcttccagcttacagccgacatgcacttctcatagtcctttacaagtcacagctaagtgccaaaaggttgatctcccatgctttttgagagggtgctggtgggtatgctttgagtgggttcttgttcttgttgttttgttttctttttgagttggcaattttgcaatcgcaacactttacaaatataaaaggcagctggttgcaagctagagtttgcaatgagatcaacaaaagtacatcatacaagtttaaaaaaagcgaaagtactaggtctattttgctagtcttggttgagttccaaactctttccgtacctatcagcctaacttgatgtctagttgaacaaagcaaccaaaagagagaaaagaagcagctctctcctatcaggcatccaaaagcaatatatagttcatctgagtaaagttttttgagctccgataaacttacagtacattatatttttcctttttcccaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagtaacattgtgatgtaaactcatgtgtttgtccaattataaaatgttatgttcgattgcattctgttgccccaaatcactaaatttgatggacgctatgttcaatcttaaatttctgagctttaaaacgttaaagaaatacagaatcattgccaccactgctttcgttttcaaatgtcggtctcaaaaaggagaagtcactgaattgtcttcaagaacaacagaaagaacctaatgccagaatgatctacatccaagcccaccaatgttcactgttaagaatcactcattactgtagggtagaatcaagaacggtagttacaaactcacaggactagctagaaacaaacatttctgaaaacattcttgtcatgtttctgctgactgtatactcaactactataactactgaacaagggtttgcatccactggtctctgccgagacgacgatatctcataccatttctgaccacaaaatttgccatcttgatcacagtatcagcagacagcagtaccaatatcatttgtaattagtaacacaaaactggcctacaaatttaccagagctcacataccaaacgaagatacaataatgcaaaagtagtaacattcaatttgagcatattcagaattccgattgcaactttgcaagaaccatagtgtgagcatagtcacacacacacgcagcactacactaatccgggtaagtagaatctaacacactgccatctaaatttgacagcttggggacaacaattctgaggcacaccatcaacaaattacatggtacagtacatacctagcaactcgatggcaaagtggcaatggcattgctcttcgccttcttggccgcggcgcccttgctctccatgaggcgccacatgtaccacgcgcccaccgaccggtacggcctccaccgctcacacagcgccgccatctcctccggcttcggcagcgccggcagcccgtacagctcctgcacgcccttgcgcacgccgaggtcgccggatggcagcacatcggggcggtgcagcgagaagatcatgaacatgtggaccgtccactcgccgacgcccttcaccttggtgagctccgcgaggagcgccgcctcgtccattgcggccacggcggactccgagagctccccggccgcgaacctgccggcgaggtcgtggaggtaggccgccttgcgggcggagacgccgatggcgcggaggtcggcggcggagagggcgagcaccgcagcggggttgaccaccgcggcatcgggatcagcggcggcggggatgagcgcgaggaagcgagcgtagatggcggcggcggcggagggagcgagctgctggtggaggatggagtgcgcgagggagtggaaggcggggcgggaaggggacgagatgaaggccggggcgccggtggaggagatgacctcggagaggagcgggtccgcggtgcggaggtgcgagagcgccgccgcgagctcccccggcgaggacagcggcggtggcgatagtacggctgttgttgttgtggcgacggatttccctttggcgggtgtgctcttgacgatcttgcgggagcggaaggagatcttaccggcggtgatgtccgctgcgcctgcgccgccgccgccgccggaggggcggggagtcgccgccgctctggtcttgaccattgcaaaggttgggtgttggagacgagacggcgtggattactggaccgtggagggaagcagttggccgttttgtcgggtggtcccttgaggcccatttatcactcgcgtgggcccacccgtcctcctcgcgtgacgggccgtgatctgggcccataaaaaggctaagcaacggcccgtaactcggaacgggagtacgtaccaaaaaggttagccgtcagtgtcactgctaggtgggtcctaccatttgatggagaaatgcctaagcaaaatctttactccgattcgcatccgccgtttaggcttcatcgggcggcccccatctcgcgacgggattcagggaaacctgcgctagatgagatcggcggcgagatggtggcctcgccggtgaggcggtgacggagacagcggcgaatccactcgcatagttgcatgagcatatatttctactgttatctgatggtaacaagtgaaccttatcttatttaaaaatttgtttagaacatatttgacatttcgtcttattcaaaaacttttataaaatatgtaaaattatatgtatacatataagtatatttaacaatgaatcaaatggtagaaaaaaaatcaataattatttaatttttttaataagacgaacggtcaaacatattttaaaaaatcaataacgttaaatatttataaacagatggagtattcagtttcattctgctggttttctagtggcatctaaaatttactctggatgcagatctcagatgtgatcattgctttggtctttcattggcaaccagacagctgacaacttatgataaccgttctatgtttcagcaaggcgattttcggttttaccaactgattagtgattacactacacatgaaactgagaaaagcatccggattcaaattgaacatagtattcctgttgctcacttcggatctggcgacccttctgccacccatcggcagcttggtagtagtgaagctaaagtttgttggatttttgccacgctgagtgcatgtttcttgtcagcattacagctgcaagttgagacctcgtgttcgtccagctgggttccagtccaggagcagcatcgcagcatgctctcgccacagacaaccagaatgcatggaagcaactagccaacgaccacgaggcaaagcagcaagatatgatgatgatctgtacttacaacagcatatggtgtgcaactgtgcattccatgtttgtttatttcaagcccaaaaaaagagaatggtatagaagaaagtaatagctatatcaatctagaattggattagatatatctcgatattatgaatctggataaaaacctaatattagattggacacatcttattactatgaatctgaacaaaagcttatctagattcgtagttatgtccaatctaattataaattattagaaattaatgtgttcaaagataataatagaaaggtcatgagcttaactagaatgaactgattgtttgtacatatatgtagtacaggtggtcggatcagggtgaatgacaaaatggtccacatgcaacagttacagaaaaagaagaagcctatgttctatttctgtttcagttcagacaaaatcagagtagcctccttatgtgtcactgacagtgggccccacaggagaccaacgaacacggtcaggaactctccccccatttcaacggaaaaaagtttcctcttttctactccctctctctcatccatttctccggttgagcggcgccgcggcggagccgaggcgagcgagcgagcgggcgcgatgaacggcggcgggagcaggcggggaggtgcgtcgtgcgccgacgagagcggcagcgaccaggacggcggcagcggcggcggcttgcggaagccgctgctgaacacggggagctggtacaggatgggatcgcggtccagcctcgccgcctcctccatggccgccatccgggagtcccacgtctccgccttcctctgcacgctcatcgtcgcgctcggccccatccaattcggattcaccagcggcttctcctcacccacccaggacgccatcatccgcgacctcaagctctccatctccgaggtcccgtgcccgttccagctgcgatcttgcgtgcttttgctgcttcctcttgcttattgcgtttcttgtagtgtgaagttttatctttctgatgcagttctcggctttcggttcgctgtccaacgtcggcgccatggtcggagcgatcgccagtgggcagatggcggagtacattggccggaaaggggtgagaatttgtgcttcatttggtccttatctgttcttccactagaaggccatcctgtatctcgacgacgaacaattgatactttgatagttgacaaggtcaatacgtcactgttgtatgatttccggtaacaccaataatttgccattaaagaaagtgagtgggattagaaatgctggtcatttcctgtgaactgtagcttgtgaaaatatgaaacccaaaatttcaggttcagttagctatactattggggtttgaccttaatttcaaagttgacgagttctttagttgtgattgccattgatctggcaaaagaggagttagtatgacagaaaatgtgtagatgaagtttttgtgacattttctttggttcatacttcataatcacttaatcagatcagtagttaactacagtgaagctctattattttactctaatggtcttgctgattgaatctccagtcgttgataattgcggcggttcctaacatcattggttggcttgccatctcctttgcaaaagtacgtgtcacatatttctcaagcttatttttctctgtttgctctttttcactagtttcattcttgccgatctttgtttttcaggacgcgtcatttttatacatgggacgcttgcttgaaggttttggtgttggtgttatatcatatacggtctgtatttaccaacttcatttcatgtttatttgctgcttagaatgttctgtggcttcactgcttgagtacttatctgactgagactgagatgcctgtagaatgaggcagagcatcctttgctaatgaagcttttttacatttttgttgccagaagaactttggatcagttaatagttagtgcatgtataaacccttaatgtgtgaattatatcgtaccaggtgccagtatacatagcagagatatctcatcagaacacaagaggagcacttggctccgtgaaccaggtgtgcttatcgtcagaagcatcttatcttatgcgagggaaatttatggtttgtttatgttggacttaccatgcagtttttcattatgtagttgtccgttaccattggtatcttgttggcctatttgctaggcatgtttgttccttggaggctgcttgcagtgataggtacaaatcaatacctgatgtctgaatgttttctatttagggatatgtaataaataataatgaatttttaacttttgatatttgctagtaccttttggacttattgcaatttgtatgtgcgttaaatgtctggtacctctgattctgattcaaatatctgggttgccatgcttgtaggaagcatcccatgtacattgttaatacctggtctattcttcattccggaatccccaagatggctggtatgttatacacctaagttggatattgtatcacaaatctgaaatctgtagcaagcactttcctacatctatatgcaggcaaaaatgaaaatgatggatgattttgaggcttctctacaagttttgagggggtttgagactgatattactgcagaagtgaatgatataaaggcaagcaattttatttttcttgattaactgactacaagttatttgcggtttcgcgtgatttcatcttagtaagattttcactaacacaacacttgggagatatgtactttcatttttctggaagactaatatggttcaaatccctgttatgcagagagcagtagcatcggcaaacaaaagaaccacagtccgttttaaagagttgaaccaaaagaaataccgcactcccttactggtaacttacataccccttttgttcagtttataccaaagtcattaatcatgttttgtaatggtaactacgctttatgttgacagataggaactggccttcttgtacttcagaatctaagtggaataaatggtattctgttttatgcaagtagaatcttcagagatgcaggtaagttgtggatatctcttataggtccttagtactacagtcacgttgtagtaaattttggcttgtaatcttaacacgcaaagaacttcagggtttacaaacagtgacttggccacatgtgcactaggagcaattcaggtaagtgattaggaatatcctgatctcatctctgtaacttatatcaagttgcttacagaaatcgttggattacattaggttcttgccactggagttacaacatggttactggacagagctggtcgacggatgctccttattgtaatttcctcttcccaatgaaatcacctttttgttagttgtctgtaacaataacatagtgactcacttaaaattgcagatctctactgctgggatgactctaagccttcttgcagtatctgttgtattttttctggaggtacattcagattttttccagtataccattgtgataaaaaaaatcatatgttgcagtctctttgatagcctacattgtcgcatggactcttcccctttctcctcagttcactcaatatttcaatattactacaatgattatttgtttcagggtaatatttcacatgattctcattcgttctacatcttaagtatgatctccttggttgctcttgtggtatgtctgtcagttaaaccatttcttttgaaaattgctccaaaacctctgccggaaaatttacctcggtcacttacttcaggcttatatcatcaccttttccttcggcatgggtgccattccatgggtcatgatgtctgaggtataatgctttgccccatagctcacaatgatgttagtatttttagagcattgacacatccaccattttgttgcaagtatctcaggcatcagcttaagtaatctaaagatttcagttaaatctttgtttgttcttagatcctcccagttagcatcaagagtcttgggggaagctttgcgacacttgccaacatgcttacatcctgggcaataacaatgacagcaaatttgttactcagctggagtgctggaggtccgtatttctataaaaatcctctgttaccaagaataaaattctgaactgatttacctgataaaagttaaatattttattttaatttcaacaggaacatttttgtcctacatgattgtgagtgctttcactctcgtgttcgtcatattttgggtgccagagacaaagggaagaactctggaggagatacagttttcgttctgctaaattttgagtttctcgttgcatccagtggatactccagttgagtacaaggaaaggatttacttatacaattaggaaccttggcttttcttttaccaagtcgattactggttgaaggccaagcatttttattcagttcattttttttgtatattcttgtgtaattttaattcagttatgcccaattggcttgtaaatgccagtgcagtggctcaaatcaaattgcttcctacttgtcttcgacgttatataataaaaagatgcataaatgagcaatttgaatccctgactgttttggaaatacttctgttctgaagttcagctatctgccgatatttccacagttatttggcaccttcatcagaaattcagagttcagagacacttatttggtgataaatgaatatatttactccccttattccttaaagaaatgcagacattgctggttgaatatctgtcatgtactaagacagatttctgccgtttttggccggtgatgcatccctatcaaagctgtgattaggaattttgccatgatctgcacatgtccattggcatcatgtctgcaaactggaacatgtttgtttctttcagctgggagcatcattatattatagtgtccacgagaagcacgacagccagaaaatgttgccgtatgacgtggctttgagcaagcaagtagccagctaccacgccacgccatctatttccagcagactacgccttctgcgtgattaaattttagttcggtttccataaaattcgttcaaattttttttggagaaacggggtggtttgaaatctccggcccttttcaaatggtcgttgttcattcagcaagcaatcgctttcctcgtcatcacgatcttatccagcttagctcgtgaaaatgattgggatgatcctaatgagatcagaagaaattaaaaaagggacacggctagatcgcgcgcgctaatggcatatcactaaccagcgacgtccttctcttaaaaaaaaaacaacagttatacaagccttttttttccttcctagagaattttctcctaaattacttatccgatctataatccgattacaccattatggttgttgcaattaaatctttataacaagatcttacacgattatattctgataaaaaatatctatgttgcaaattacttttattatatatgtaagttacttttgtcctatacataaatcacttttagatttaagctctttaataacttatatcttttaaatcacgtattattttcatgatctatttatatcattgtactctacataaaatatgagacaaaacaatatccatattgaatatattcaaatattttattaatttaaaagtaatttatttaaattgtagtagtaacttagctatgcaatagatataacttagctatgcaatagaagtaagttagcacaaaatagaagtaagttgttacaacattagaagtaaattcgagagaaaaatattttgtatctaaaaattaaatttaaagtccataaattatagaattgactaaaaactataataaacataatcgacttaaagcattatgaatatataaaaagtaatttagtcaaatctaaaagtaacttatatatatgataaaagtaacttaagtatataataaaagtaatttacaagtataaatatttttttatcgtagtataatcatgtaagatcttgttttgaagatttaattgcaacgaacacaatggtataatcggattatagatcggataagtaatttgagagaaaactttgtaagaaggggaaaaacatgcatgtgtaatagaaaaaaaaggcatgcatgtgcgccggcttctccacggcttctatggttggcatcgcgggataacacaatatcgagaggcctcgccgattagtttttgcgttaaaaaaagcagtacacgtcgttgtctggacatgttgtgcacttgtgcacactagtacatctgagcacgaacttattaacgtttttagtatttatgccataaaacagtccaagaaatacaattttaattgattatgtatgatttctggatgattactcttttttggtagtttatggcaaagaaaaatgaggccccatttattacacacaggaataaaaacctagaaaaatagaacacaagaatgcttgtgttaaccagcgaaatgaaaaacacatgaaaaatataatatgggatgtttggaagaaaggattcattagtcaaactgcagctgctttaaaacgaacatacccgtaggcaagtttccaacaaaatttagcaaatatttgctttcctataaaattggggaaaaagtgcatggaaggaatcaaaaacctttaggaagactatccaccaaattctttgttcaaaccgtgaaaataatgaaatcccttaaaatttatcttttgcttatacttatgtttatagctaaattttgatttttcaactttaaatttaaagttaattttggagttttttcagcgtagtttatattttaacatttgcttttaaatcgttaagaatacgtatataaaagttttattcacaaattattttttatttccaaatattcctcctatcaaacagaggtgggcccctttttccatcccggaccaaacgaaatcttctcccgtcggtgactgacaggtgggccccacctgccaaccggtcaagccaagagacaggtagacacacacacgacgcgatccccccaactctcccccgcttcaacggaaaaaaaaaggggtcgcgtctcctcgtctcgtcgcctcttcctccttccaattcatctcgtcctctctctcgtaactcgtaaagagatctcgtctcgcctcgggaatccaaccattgccggcgaagtagagatcgggagggcggcgccatgaacaggggcggcggcgtcggcgtcggcgatgagagcggaagcgactacgagagcggcggcggcatgcggaagccgctgctgatgcacacggggagctggtacaggatggggtcgcggcaggggagcctcaccggcgcggggacctcgtccatggccatcctacgcgagtcccacgtctccgccttcctctgcacgctcatcgtcgcgctcggccccatccagttcggattcacggggggcttctcctccccgacgcaggacgccatcatccgagacctcgacctcaccctctccgaggttgctgcccgcttcttcttcttcttcttcggttcttcccattacccccccccccctttttttttgtcccgaatctgaacgacgcgctgctgctgcagttctcggtgttcggatcgctgtccaacgtcggcgccatggttggggcgattgccagtggtcagatggccgagtacattgggcgcaaaggggtgagaattttttttctttttttgggtacacatcgtatgcagttattagttgcgctttcgtagggttaccagtctctttctaaaggacaataatggtggtctcggtcaacgtcacctgctgtgctgggagagttttatgtaattagtacaaataaaaaattattattttagtttttaagtaatacaaatgtgggcaaaacggatggaactttctggaaataaatgttgatcattcttcagtagattattgagctaccgaattgctaggatggctttttgggggtttgacattatgtctgttcatgagtttggtagttgcatacttctgtttcatacagatatgaacatatggtactcaagaaatcggtatagacgaaaatgtatggatgaagtatttttcatgctcgtgttctggcatgacttacagtagataaacatactttagggtaattttatttaatgtcctgtttttggcatggttgcagtagtcagttgtacttcaatggtctactcttttaagctaactgaattgtttggtgaattttccagtcattgatgattgctgcaattccaaacatcattggttggcttgccatctcctttgcaaaagtatggcattacatggttcagaatcttactttcaccaccttgttgctttatacaatttaagctcgatgcctttgctttataggactcatcgtttctttatatgggacgattgctcgaggggtttggtgttggtgtcatctcttatacggtttgtatgagaaaacttccttcctcccttttttatgcgcacttatagtttgagtacttaacttctttgttcaagaaaaagaaaaaaaaggaataacggatatgtcaatattttggaggaaaaactctgcattgccagctatgttagagacttactattgatctgtgtattatgtgataacaggtgccagtttacatagcagaaatatcacctcaaaacatgagaggtgctcttggctcagtgaatcaggtaaccttacttcacaggaataatctttttgacacaaagacaattgcttttctatgtttttcttgtttattttaagcaccttatgtgattgtttgttacacagttatctgtaaccgttggtatattgttggcatatttgctcggcatgtttgttccttggaggcttcttgctgtaataggtaatataaccaagttctgattgtattgctaatgtgatctttttttcctttcatttttttatgtctgcgttctgatatttcagttcacaagttcattaacagcaaatgatactaatatgttgacaaacatagctaacatcctacaaacattgcatgcaaatattttcatttgaatcatagatggaatgttagtcattttcaatagccagcacatatttttttcacaagtattaaagtaatagtttggatgtcatatatgcgtctactaggagtaaatggtttttttattcaaatctgtgttttttttgcatgtaggaatcttgccttgcactgtgttgatacctggcctattcttcattccagaatccccaagatggttggtatgtattattgtatatgcaaaaaatcgatatgaaattacatcatctgaatcatttttttatagccatatttttatctctatatatctctaggcaaagatgaacatgatggatgattttgagacttctttacaagttctgaggggatttgagactgacatcagcgcggaagtgaatgatataaaggtaagcacttgttataacattgagcacactgatatatgcaccacaataccacatgcttctggaagtaacagcatcatctttatgcagagagcagtagcgtcagcaaacaaaaggacaacgatccgttttcaagaattaaaccagaagaaataccgcacacccctaatagtaatttccttaactttataattggtattgtacttttatgccataccaaatatagggactaaattttataattggaattgtacttttaactgtggcagctaggaattggcctacttgtactgcaacagctaagtggaatcaatggaatattgttttatgcaggtagcatcttcaaagcagcaggtaagttgtgtcgtgcttccttctttgctagtaaaccttttcattacactggttagggctttaggcatagtaaattgtatgcatatattgggatatcttgccaactttaacggtagtgtttgctaaattaccatcagtgtaatcatctgttcatcaaactttagcccagaaggaatagcatactagatttcaaactactaaatttgggaccgctgacctgataggacctctaataggtttatgcatatgtaatttccttcgtctctctgtatcatagtcatattttagccgatttggcttcgtgacacgcaaaatttcttcaggtctcacaaacagtgacttggctacatgtgcacttggtgctatccaggtgtgcaactataaataccgttcctgtctctatgcaatcacttaaaccacacactagacaagtaaacatgtccttaagttgctcacggcatttcttgtcaggttcttgctacaggagttacaacctggttattagacagagctggccgacggatcctccttatcgtaattctcttcctcctgaaactaaagcatgctaattttctgtattctgtgaccataataaagctctcgcttcaacttctagatctcttctgctgggatgactctaagcctccttgcagttgctgttgtatttttcctcaaggtaagttcctaccagtaaaaaagaaaagggaaaagtttcatctgttgcactatatgcaatattccatatatggcttatgaattttgcaatatatcacaggtctcttctgtcaatccactgaatattttcatattgttattgtgatttatttgtttcaggatagcatttcacaagattctcacatgtactacaccttaagtatgatctccttggttgctcttgtggtatgtccctcattatgttgttttctctaaaaatatgcatcacaaatatggaagctgtgacagaaaatgttgactcgtacacttcatttaggcttttgtaatcgccttctccttcggtatgggtgccattccatggatcataatgtcagaggtatagcttcatggctcataatcatacggccttggaatttagctgaagagcattcacatggccatgatttttggagcatttgtcagatggtctgaagactcacttccaacttgtatattttcagatcctcccggttagtatcaagagtctcgcaggaagctttgcgacgctcgccaactggcttacatcctttggaataacaatgacagcaaacttgatgcttagctggagtgctggaggtacatacttctacttctctgatctctctttcctgcagtggaattgttcttttcgttgagcgagactagagtagaattctgaatatccaacctgacgctcatgctatcttcttaaacatcaacagggacctttgtgtcctacatggtcgtgagtgctttcaccctcgtgttcgtcatcctttgggtgccagagacaaaaggaagaactctcgaagagatacaatggtccttccgctgagccttgtggtcttcgaaaatatggccattttttcaagtacaaagggaaggattgatttgcgcatttgcaaatcttgtgtattctatgttccgagtcaagtatactggacaaaaagcaaagtattctttctgttcatatattcttgtacaacattgtttcacgtattccagatcgacttgcaaaggcttttgtgcagtgacacactcgtgatctcatcctaattgcttttcctttttgtcttgagcggctgcatgagcatgatcaatgtaaaatatgagtatactctcaggcattcttgacgcctttgcttgccttcgaaaatatttttcttgtcaaatttcaatagtctgagaaatttctggagaaggtagccggcgatccatagcgcagaggcagagccttgatgaagaagaatttgatccgaggaagacgacgatggtgacgtcatcaatgccggtatgggccagaacaggaaagcagagtacgtgccattgggccgtaacgggatggcctcttacgtgagtgtactatatgggcctatcaatatactgtagtagctaattaggcccaatttcttaatggacattttgggctggtccatggtgcaccgctattgcggtggaatccggtcaggtacatatgttccttccagagttgaccggttgacccgctttttgcagttagctccctgtttggatctttttctaattttctaggcctgttcagtttgttgcaaaaaaaccttaccacatagttaccaaaattttgacaacttgccaaaattttagcaggatttcttatatagttaccaaattttggcagcaaactaaatgtagctatttttttaataactttattaaaatttggtaaagacccatagtttttgatagtaacggttcaaaatctcgatttgctatcaatggtagcaaacaaaatttgcctagtaagatacggagatacagatgctgtgatatagggatatgacattttctattaaaaaaatacatatacaaggtccatacatacagaaattaatgaactcttgccgggaaacaaaacaaggatgctagctagtttttcagtgttacgtggttcctggacaaaacaagcttcagattcccctctgggaagtctaaaataacaccaagtttttactgagattatgatttgaaccattctagtttgactctcactgcgtcatgctgagtaacgagttcagccaaggaatgaggtttctatcaattcatggtatggtagcaacttgttaccagtggtcctgaggtctccagaatataaacactactagttggcacagtgatctgatcgatggattagagcatttaaacatgtgaaagatccttggctctgtagttccatgtcttctactgatagtctgatactgctttggacaagcatttttcttcacttgtaacagtagaaatgttcccggtattttttttttagaactatgttcctggattcaaaggtaggtctccgaggaacgcagtgtcagtcagttctgccttggtgggcctctcattgcgagatgacatataattgggcccgataaggtttagacatttcaggacgatccacagaaacaaatctgatatggtttgggataccacatttcgcgtattattattaacccagttttggataatggatttctatagttatttgagatccagtatttttcactttggctcctgatccaacatttcattttttttcatatctacaacgttttctctataatcattgtttcccacccaacatttagccattgtcactctccttcctccagtcctccgtctgcatgtgtgattggttggttcgactgataaaccctagaaaaataaaaggagccaacggaaaatgattttacggtagaacttctgtatttctaactttagtcttatgtcttagtggtttaattaattagaagccaaggctgaaaacaaagggagtgttcgacaggccgactgcaatggctgtagctgcgaatgtgctaagtgagtacgggactattcgtgccggctgtggtgcagccatgaaagcagcagccgaacatgcccaaaataaaagaactcaataatttaaaattaacttcaataattcaaattttgtttggtagtactacttgtaaaccaacgaccaaacaacgagcatatcaaaggttcggtcaatttaattgcccaaaaaaagtggttcggtcaatttaaatagctaggcaacagctcaaacaagatcttgtaggcctctgatcaaaaggagaacccttatatgggtcccaagacatataaccgtgatgattgatcgatggtacctcacatctcaaaagcccaaacatatatccctccacatatatatccacttacctttttggatcaaacgatgacgatgattagtgcacagtggaaagtactgttagttaaatcacaaaagaaatataaagaacaaatttggcacgcgagcaataggaattatactgctgctagtaactaattaatggtggaactagttaattccaaacagtacaactctggtcatcgatcgatcgatctcattgcttaaactaaactaaactgatcaaaattagttcgtagtagtagtagtacactgatctagggtctctagctaagctaatagtattggaacaggccgggccgctcgccgacggcgaacgccggcgaggatggcatcatgttgagccgccacgacaggcagggcccgtcgtccgccgcgtcgaacatcgcgtacgacgccgacttcgccgcggcctggccgtagcatccccactgcggcgccggtggcggcggcggctgtcgcgagtagcagtacgcgtacccggcgccggtgtccagcgacggcggcggcgtcggcgccaccgccgccgcggcgcgcctctcctccttcttgtaccggatcccgcacgcgttgcacagcgactgcaaccaacgacagaagaatatttttcatgtgatgtgacgtttgtatagtagcacttgatttgcacgaaaggcgttcgtgcacgttgctgcctacctagatggcatggcacgcaggagtacgtacgtaccttgggtcccctgggaccatttcgccagagcggcgtcgacatcgtgtcgcagttggcgcagcggcgaggcaggcggccggcggcgggggcctccttgttgcaaggagccacgccggcgccgtcctgcttgccgccgccgccgccgccagggcgcgccgacgacggcacgtcccacggctgcagcccgccgccgtacgcgcccgcctccgcgcgccgcgtggacggcgtgccgagcgacagcgtgcagtccaccgccgcaccgccgccgccgtacggcgaccgactgtcctcctccgcgacgccgccgcactgcctgtagtagtactgcccgcccgccatggggaacagcagcgagaacgccgacgccgccgcggcggcgccaccgcacccgccgccgcagctgccgtacagcatcccgcacgtgcacggcgccagctcctgcagcattatctcaacctaacaatggtggatcgatcgatcgatcggcgagagatatcgagaggagggtactatcgtctgtctcgttggctgcgatcgcgagccgtggtcggcgaggcgaagcgggcgggggcatgtgagctagcgcaggcgcggcgtacgcggtggcaaatccgcttattataacgaggagactcgatcgctcagccgctcacctgtgtggggtttgggtttggttggcgttttgcgggagaagtggacgagattttgcgttgccggcgcggggagcgatgcgatgcgatgcgggtgggtgggtgtgtgtgcgcgcatgtctgcctccctgtccgtctcggcgtctcgcgtgtgttttgtgttcgtgcgtgtgcgtgtctgcacgcagcgctgcggtggcagaggcagcaggcggtcaagagagagagaagcggggcagctgcagcgagggggggtcaaaagaggagaggggcacgtgaaacggggaacagtctcccatgcaactcctggggacgtggtcgttagctaccctacccaccccagcccagagacactactcgctctcttgtgtgcagtgcagtagaatcgcacttccccgatcacgaggtgcacagtccgatctgttcctcctcccgtaccggatcgatcctgtatgatccgatcccctgtcactagctacacgcagtacatacagcccgtcatctactccactaccaatatactccttaaaaaaatactcaatttaaaaggaatctattacaatgaatctgaacaggacatgtgtttatagtttaggtcccgttcttttctccaataaaaattggatgaagattaagattttcgtggcacgtttttcaaactgctaaacggtgtgttttatgtaaaactttctatatgaaagctgctataaaatatcatattaatttaagagactgccaatcttcattttcgtcttaatgagaaaagaacaccacctcaatttgttcaaacggatagcggagtattttgcatgtaccagcaccagcagttctgcgattgcttgatcattcgctggaacggggaacagataaaaagactgctgctagctactccttgcattgccacagtggatattctcaaaacgtcatgtccttgctttcctttgcacaaatgaaaagcgtgtcgcaacccttgcctacattatcgaatccagcaagctgctgcatgcaaaaacttctatcaaaacaagaaagaaataaaggagtaggagtagtatagatcgaagagagaacaagggtgcaaaagaaaaaataaaggcgaaatgatcaaaagaagcaaaagggtaaagagtggcaaccagtaaccaccactagtttccatgcatgcatgcatgcaggataactcaagaaaagacgtggagatataattgcatggatatatggaatggatggacggatcatgagttggccacgccaatgatgagacctctagctcagccgtccgcccgttcacaaaagcaccccgggcaaaaccggccaaccggcccggccggtcgatcgactcgaactagatcatccctgcttgctatgttggcttcattttccctataattatatcttgagagtcgctttatattattaatgagtctgttcagcaggctgccatgtaacacggcacagccgtgaaatcagcaaccgaacatacctaatgtgatatcaaatatatgggtttatatgaaaatacgacaacatcgatcgataaaatcaaattagtttaccaaaatctaccataaaatatactactccatatgtcatattttgtatgaccgttggatgtcatatattaaagggtagatgtaatattttaatagtgtatttatttgttatattataaagatgttggactgttggcgtgtcttactctgagctctaggccttttttttcttttctctagagaagtttaacttatgataaaagttaaaacgatttagcatatataatggagtagagaattagctgcctgtcggttttaatgttttatagaccgattaaggaagaagcaagcttgcagatgtagggatcggtggcaatgtgtcatgcagagaaagccaagaagggagtggagcccatcattccatttgctgcagcccatcagtgccgacacgactgcatctgcacctgcgcgcgcgctgcatgcatgcgctgatgatgcgcgttgcgttgcgttgcagcagcatggcccccatgactctctgcacacgcacgtactcatccatgatccgtctgcaccagccgtagtagtacgtgcggtcgtctcagacacgcctgcagcgccagccgatcgattaatgctcgctcgtgcaagtggcagatcatagtactcctccaactccactgttgcaatcactcgtagtactgctggttattaccacctgcagatcgacctgctacagtgcctgcattttgcatcaaatctgtgtttagagatcagctttactccttccatccttaaaaatcaacctactaacagacgtgacacatcattgtacaataaatctagactactctttatccagattcgttattctaagagaggtaaggttaagttttttttagatggagggagtacatcaatccggatttatagtattaaaatgtgttatatctgattctatattcgttttttatgtgacatgaatatattattagaaacaagtggagcgatgaattaactatcggcagtcaaactggtagtgtgaatgttaaccggatactagatgattaattattggttgattatatgttactggtgcaagactgcatgcaaacacgtactggcgtgatttgtcgtgtggcctgttatttatcagcgtaatgctctacacgtatgacaggggattcagggattgtgtgccttgtgctccgtgctgatgaatcttcagtaaacaaagcgattaaattgtgccacatgcctgcagctagctagcagcatttctctgcataagatgagagcaagtataatagtaggctataagccggctaaatgctgagatggaggagagaagagaggagagagaggagaagcgggctataaacttatagccagcctggacacaagaaccaataaactttctaagagagacaagtggatcctatattaattgtaaagagctaactattatataggtagactaagagaaggctaaaaaaaaacttataaccaacatgttagctgtattattagccttgctttgagggggtgtgcagttctgtgtgtgttgcgtggtgaggggagtgcagccaatccggccgaggagatcgtcgttcaaaaagttgtcccgacacggccagagttaagcctagagattggtggcctcatgtcctttagtttttgatgactgatccatgagagagaacacggaggaagcaagcggccggccaggcaggtatcttttggaatttgcaagccttttctcgcttctccaagtttgaaccattcatccctcgatcagcactacgactagttgttgtttagttcagtgcaccaccttaaaattgcagttaagtgcatgtaatcctctcttatgtacaggtcgtaaacagtagaaaaatgaacagcagaagcaggttgagaggagaaatccaatgttttttacacgtacgcttctcaaaccactaaatagtatgtcttctcataacaaaaaaatctctacgaaagtttatttaaaactcatattaatctactagtatgtttcaagcttaaaataattaatactcaattaatcttatgctaatgattcaccttgtttggtgtatattctcaatattttctaatcctctcctcccaaacactccctaagcaatcaaaataatttacctaataaacttttatacctgtattaccgacaatttgagagctaagaaaccctccaaatcaacttaaaactaagttataaaatttaaatttaagatgcgggtaataagcaaacaagcacagtcgatcacattcacatgcatcgatctcgtggactcctgccgatgtggcacagcacagtcgaccagatggattagtactataggactagcaaaaatgcattcaaatgattaggtcgatatgaccatatcattagcaaaacattggtctcggccggaggatctactccgctaggatcgatgcggagaacgtacgccgccatcatatccaacccaacaacccatgccgggctttgcttgctttggcgcctaacggttggcgggcccacgtgacatgacccatcagtggtacttcctgcgccttttgaaaccccgcttccggggcccacgacccggcccacctaatagctggcctcgggctcgagattgactgacgcttttgtcccccctgctttcgagggcaaattaaacttgggagtagtgaaggagttcatccggaaagcccaattgcacatctaggagtagggaaggaaaaagggcccagctatgtgctgggccgaatctggtttcagctggattttattagcccatccttgaccagcctgaaacacttggtcaggccagcccatgacactctgagcccggtacagaacacacacacaacctggcctaatcgaggccctgaaacggaaagtaatgttgcagatggaatgcatttcacgacatgacagcatccgcttctctccgtgaaaataccgtgcaaacgcataggtacaactatgatcaccttaaaaaaagtagatcgatatattttggaattgataaagttatcactgtcttattatcgacaagtatatcgtctatcactaaaaatataattggccgcaaatacgagtatcttttttcttaacacatgaagacgcgcacacgcaaaacacaggtgtcactttcgatattggtggtcgttttcttcagcatcgatctatagcaaagcatgcagactggtcatgaatcatgatatttgtcacgaaacctttgacgccgttggtcgtttatgcacgtttctttgactcgacgcatgcgccgttgattagtgctgtgtgtttgtttgttaatctttcgatgaacatattggactagctagtatgctatcaacatatcaattaggcaattaccatcaaaggatggcagcacttggggccacattggcattatctcaatatctcggaatgatgtgaccgaatacaaggaacatgatgcggatcatgattcgctggatcttgttttctatagtaaagaacagtgcaacacatgcgcgcaaaagattagtgcaaaattgagatgattattgcacatggatgcatgatgcaggagggttcactgtctaatactatgactgcaatttttctctccgacgagacctgtgtgatttgatgattgatcaatctctctgtacacttaaggtccataaatatatctggcaaaaaaaaaaagggttcatgaataatatgcatagtgacagaacacctatcactttttttttctatagaaagcaattaagattcatctttttgtaccacacaaggtacaatggtagttcaagtaacatagatatcccaatcatcatttactcattcagtacgtcaacatcttaaagatgaactacatggcacaaaaaatcttgtcaggctgaagcagatgttgatttggagagcatgactcttttgaacagaagaccatgaactatagctgggggaggaaaaaaacaactgcttgattcttgaacttcctgtcactgaaatgaggaaattctttgttattgcacaacgtcgaacctacttgcgaagtttttcagcacatcatccaacgacatgtaaataactaacaagttgccttttcttgttattgaacttcagttggtataccagtgcactcttgcttacgataggttgaaagcacatggaaggaaagcattgaccagcttgattatcacataaaagaaaaattagataatccacccttagctgggatgtgtgaggtagacactgatgtcaaatataaggattgaaacaagacatgtgtgaatttaaaagaaacaacttccaggagcatcgatatcttgttgtatagtatctgatgaagtatacattgatgtcagctacaaggattggacggcatttgcgagaacttcaggatcacatccagctaaaaaccattaatacatcagggccagtggtaatagctaagcaaaaggaaacttccaattgaacatgacaaatacacagcacatcgatccgttcatcataggttggcaggatcaaaacgcccttgccactaacatcaatcccatgtgacaaaaaagaagggaaaaaaataaaagaaatagaagaagaaaagaaaaggaaaacaaaattcgacctttcctctggaccactatggcagtatctagtggagtaaatgacaatcggaagcaatggctaaagagacaacaaagtgtagtgtacataatacaacaataggaaggcctaccgatgacctcgtcagcaaagctctgctgctactctgtaaaacttacctgatgatccatgaagtacagaccagtgtgatcacagagtagagagcagagttggcagcagcaaagtctggagattcttccaatgcaatcatgtcctataaaagcaagtgccattatgtcattctcactaaccaatcttttgaggatttttggtttgatccatgatgataaacgtttgtgtttgttgcaccaatggaggagaaggatggatggatggatggatggtgttattgctgcgtgttgttgtgggtggcgaagccgtcgacgagctccaccgggtagcggtcaatgcaatcctcccaggggctctccggcgacggattgacgttgcggagagcgtgccagacggcgctgttgcacttgaacccgctgccgaacgcgatctgccagatgcggtggccgcggcggacccggcccttggcctccatgtaggcgagctcgtaccagatggagctgctcgacgtgttgccgaagcggtggagcgtcatgcgagaggcctcgacgtggaccggctgcagctggaggttcttctccagctcgtcgatcacggcgcggccaccggcgtggatgcagaagtgctcgaacgcgagcttgaagtccgggatgtagggcttgatcttggcgttgaagagcttcttggcaacgagcgtggcgaagaagaggagctgctcgctgaagggcaggacgagcgggccgagcgtggtgatgttggtcttgagcgcgccgccggcgatggccatgaggtccttggacagcgacacgccggtcttcccctcgtcgtcctgctcctggtacacgcagttgaaggccttgttgtccgcgcccttgtgcgtgcgcacgacgtgcttgagggcgtacttggcgcggcggcggtcggcgccgcggttggagagcagcaccgccgcgccgccgacgcggaacaggcagttggggatcagcatcgacttgcggttgccgaagtaccaattctgggtgatgttctccgtgctgaccaccacggcgtaggtgttgcggtgcacctgcagcatgtcgcgcgcgaggtcaacggcgatgacgccggcgctgcaccccatcccgccgaggttgaagctcttgatgttccccctcagcttgtacttgttcacgatcatggcggagagggacggcgtcgggttgaacaggctgcagttgacgacgagcacgccgacgtccttgggcttgacgccggtgaacttgaacagcttgtcgagcgccccgaacatgacagactccgcctcggcgcgggcattcgccatggttggttccggcgggatgaggtgcatggcctcggggacgtaggtctcctcgctgaggccagaccgctcgaggatcttgcgctggaactcgaggcagtcgtcggagaatccgcacagcttggagtggtggaggaactcgtcgaagcggaccttgagcttgtcgggcggcttgtagcaggcgaagtcgacgaggtagacggggcgtgggcgggtgaggacgtagacggtggcgccgaagacgaggacggcggagaggacgaggacggagacgaggttgtactggaggtggagccagagctggcggagatcgtcggggtcggtgcggccggcctcgaggacgatgacggccatgagcggcagcagcaagagcgtgaggaggtgggtgatgaggtagtggtaccccagcttcacgtacttgaggttcacgctctggaggaagtccggcagccgccggtggctcggcgtcgccgccgccgccgccgcgtcgccgccgttcatggctctcgcctagatctgatggcggaatcaatcacccgagtcaaagatgtgggtgctcgtccgagattgcgcgtggactggactgcctgcctggtggatgaacggattgttcgggggcggcgatgattggggggcagctggagaagagtgggagcggaggaggaaacggatgcgaggcgattccgccgccggcggatgcggatgcggcggcggcggaggaggaggaggaggcggaggcggacgcggacgcggttgtttggggctttgtgagaagggagaggtgagggatgggtggataaatagaagtagttaaccacaggcgaggcgaggtgtggtatagttaatttgaaggaattttttcagggaacccctcgaagtgttggagtattaaagaccgcaggttttttttccttttctggaacccctcgtagtgttggagtattattgcgatattaaaggccgccgggtctgcctgttcaagcgatcccattccctcccttgttaatgtgattgtatttaataataatgttgtttgcttagcaataatattgggcctacattgtttattagattttcacttatgtgctcgaatcctctaaaccagtagttttggatgttccactgcactattatacaattttttgtgaagtttaacagctgacatcagttttttttttaattctgttcatttttcgaagttgataatttgaaagtagcacagagctgatagtttcatatacagtcctaagtagactataacaacgaggaaagacaattaatatccaactattttcaaatagaccgctaattggtatttttggtaatgcacacatgcattgttaacttttactcatacaagaaaaacaaatactcgcatattttcatcttaaaacagtcagttcagattcctttcaaaagaaaccaaaagaaacaggctcaaaattttgcagacaggacgagatgcccaaacagaaatctctgttctcaccagggcgtggctgaaaagaaaggcatgaccagagtgaaaaaaaaaaagaaaagaaaaaaaaagggcaaaaactctcaaaagagtcagagagaaaggaaagccctaggctaggcatccggttcccaggctgtggccccacatgccagtacagccacgagacgcagcgtgtagccgacacgtgggcccccacgcgcgtcttctcgtcgcacctgcggttttgtcggccatcggatccagcggacggctccggctggttcgtcgccggtccagtggacggcggagattctcccaagtgagtgagtgacggatgaacagatcagaggaaaaagcggccggccgcgtcgtgcgatgagaagatgtgatgagcagttgatcgcgacagcggcgacgttgcgcggtcacgaagagggagatatatgggcggagtttagctccaaaatttttctttaaactattaactttttcatcacatcaaaattttcctatacataaactttcaattttttcgtcacatcgttccaattttaaccaaactttcaattttaacttgaaaacacacccacggtgtgaatttacgtacccctcctgttgcacccgtgtgccattgtcgtactcatccttgcaaagggggaaaaaaagaattccagctgaaaatagtagttgaacaaacgtaccaacatatactatccaaatatgacctgtttggttggagggagtttttaaaatggattggaagtttagagggatgaggctattaactattttgtttggttgtgggacatgggaattttagtgggatggagatatggaattgagaaataaactccctccttttcaatacctgggtaggggcagctaattaggagagaatttctcctttactttgcctaaacaaatctcagccatccgttttcattaatgatctaatctccaactaaactccctatcaatttccaccacctctaccaaataagagactgggataaaaaatcaaattcacatcttaatctcaccatcaattccctcgtgtaaacttccaatccccttccctcaagttgccaaacaagccaatagggtttgtttggctgcatgatacgaacaacactaaaagagtgcagccgaacatgcccatagacattttttccttatcaaagggtctgagcgagagtctgagcccttcattttcattaatagaaatgagactagaatatagaggtagcaacagagtcttaagagtctttagataccacaaaaacaaaaaataataataaaataataaaaaagacagagctaactacttaaggaagccgtttcgcttattcacggaataagcaaaacggtatctttgcaaacaaaaataatttgtgaataaaacttttatacacatgttctttgcaatataaaagtaaagcctgaaaaataaacttcaatgaaaaaccctcaaaatcaacaaattcaaattttggttgataagtataagtataagaaaaaagatgatgcagcagctatattacacagtaaagaaaatgtatagcactgatcttacaatgcattgttactgaacaagaccatagttgcgggtgaaattttgtaaaaaagattatgaatacaaatgtggtaagcctagacctataacattgctcatgactcacccccattggtttattttgtatgcctgcaaaaattccgaagtaggaatagtaggtgacattgtcaactccccaaagaaaaaaaaaggacgtttgctattagtttgatgaaatttgctcaacaaacttacctgctgggttggctgcagtctgcactctctcaacacatgattaatctggccattgacgcatggttggcatcgggaatttggaagtttgaaggagaagacgatcttttttgtgcaaaataatgttttgaggagaaaaaaatttcgaggagaagacaaagtcgctgcacctgtccaagcgtcctgtttgatgtgtagacgactttgcaagttagctagcggtggccactgccaagaaaattccgactttgcgacgactcgacaaaacgaaaggaagaaatcgcgaagttttccatggccatgcacgtccgatctttctagagggatgagtaaagtgtgacatgaggtttgtttgagagtttttttaattccgttgtactccgtagcttctctaattttttaaaactcttttaaataggacttcctactccaatagttcattctactaccctcgtagtatggttcagcttttttttttcatattatgtaggtgtaataaaatttatataaaataaattagaagatggttttctcagtttgtttagattctcatcaattagattttcactatctgctactcagaatttagaactcccaaaagaaacccataaaatttcatcagacgatgctgctcttttcaggaaatttccgagccaaatcggcaaccagacgagcagccgggagagcgagttggtgagatttggttaagtagctgcaacctgcaaatacgtagtcactgaacttgtctatccatccaaagtcatctgagagattgtaaaagagtcctgaatttttgtggcagtttgttgatctgatcacagagacagcaaaagtggattaaccactggaacatccattaaccaactggaccaaactttcacataaacaatcatgcatcttcttcgaatcagagaaagcaagagaaagacagcgaattcaattcatcccctcttcttcttggtacagaaagggacgtgaccaacttagcattaatgatctcacggcagcacagtgagaagttgacaggtactgagagaattgctgtgatcatgccatgcaagatcagacatcctacctgctccagcgtccaattccatcagagaacaacaggttagttaatactttcagagaacaacagtgtattggaatgttcttgaatctaatcacattgatgaagggatcaattgaacagcggtgattcgttagtatgtatcttgctctttgatgatgctgtccttgtctctttgagttcagctttgatggatgaactgataggttcatcatcgccagtcgccactgtacttctttttttgttgtgatatctaaagctaaccgaatacctggagtgcatctctgaattttgctaagatttggctagcagtttggaggcaacaaaattaaggttaggtctgcgaaacgaaaattgcatatgtggtgaccaaccaaaacccatccaagtttcgaaattgattgtttagcatgaagaagtcaactagctagctatttatacctccgttttttaatatacaacacacttaaccttttcttgtctcaaactttaaacatcattttttaagagaaacgaaaatagtaccgtcagaactttcatcaaaattactttaagcatatccatttgcttatctatttgcagaaatatttctaaaaacagaaatattcaaatgaattaaaaagcaacctatgtcgtactctccctgtttcacaaaaaataaaattctaataatgaatctcgaattttttgtgaaactgaggaagtagagtatactattaaaaagcggagggagtagtacggtagtaaagttaggtataaccaataggtgaggagtgaggaccattgagcaacacaggatatagtcattacattctcaattacaggcaagtacggcatgtctgtgactgcagtggtggaggaagctgactggtgagcagttggtagctttgacagactgtactgaatctggagatagcaatccgagagaccatgttcatgacacaaaaattccggcctggcaaattcagatgatttgctagaccagcttgggaccatgtgagacaatcagattaatttgccataatgcaatttggtttagaatgcaatggcaatttactggtacaacatgttttccaggtggcatgtgaaaagaggatataatgcaaacctgtcaaaaagctacgcacccttttactgtttcaggcctttcagaaaacacctcctttttgtaacagaaacaagcaggacaagcactgtaaactcaatgatgctgcaaactgaagaaaatactcaaaactgaagaagcatcagaaaacactgtatggctgtaagctttcatcattgtacgagtgacttttggacccactatctgaccatcttctcactccagttgctatacaacaaagagatgcacagataaattgaatagacaaggcaacttttgaaagagcaagataatatttagacagtttttccctaactatttgggactttttctagtgcatggtcttggaaatgtccccctgttaccaccagcatcaggcatccaggcatgtgcaaaaagattcaggcctacttcttggagacaatgcctcatcgatcttgcaaaggcatggcaactcaccttgcagacgctacatgccattgccctctaaaataaagtaactttaggtgtaagatgcaacttgtaacatgagctgttcctcttggacacataaaaaaatggaagggcagaaggtcatgcaatcttcagttaaatatatcacctacatctggagccttaaacaaaaaggtttacttgcatggatgtttgagagatatcataatcttcactgaaataacagagatgagcatagcaaaattgtttggtatagtagtgctatcacacatagcaatttgaattttcaaacttaaatttggagccgattttgaagttttctcatcgaagtttatttttcagtcttcgcttttagattgctaagaacacatataataaaagttttattcacaaattactttttgtttgcaaatatatcgacgatggctctggtaccccagaaaaaagttgttgcagcaactccaacgagaaagttcaagcactctactttggtcaaatcttcagatagaagaatgttcagtccagaagtgagcccggtcatctagaatctggctgtgtttagttcacatcaaaattgaaagtttgtttgaaattggaacgatgtgacgaaaaagttgaaagtttgtgtgtgtagaaaagttttaatgtgatagaaaagttagaagtttgaagaaatagtttcgaactaaactgggcttatgttttgaaacaacatcagttggcaaccttgcatagcgtcgtccacatcctttctccaatatcagaacacgatagtaatcttttacttgttatggcagcatccaatcagtaagatagtaagtgcaaggcttctgaaatggacatggcgatggatcgattctgaagttgacgttccaccaaaacctctagaaacggttaatgtaagttaacctcgcagctagcatggtgcatggggcatgccaaatcaacgattaggccaaaaatcgcaacaattaatcaacacagaaatatttgcaacgtcagacgtaagtgtggatgggatgtgtaatcatatctgattcactgatttgacaaatcgttaaacattgtaaggttagcttaaaaatagctaaccatgtactattttttttgttgaacaacatctgtatacccaaggcctctggaagacagcaatgtcaagttatataattcttgtcctggatggattggttatttgctgacgatagagagcagaaaggtcaagaggtcacggatgtacgtatcattaattatcttaatctagactctgcactttgaccagatggacaagctttcctaagaactttcatgagcagagtttagcagccataactcgttcctgtcttgcgtccgtagctggtgggttgagctaaggttgatatccaaagaaatgtgaaaagacaataaaaaatcatgcataatcttttatatcagataaataaggcaataaaatttgttgtttaaaagttaaatctgaaacatagaccataatatttcataaaatcaactctaaatttaaattttagctgtgtctaagccaacaagcagataacgaaagcgtgtgtaactggttactgtagccatgaaaacatggttgaattaagctagctcgatgatgctgttgtaacgtgcatcgtttgacatttagaatagatttactgatttagtccaagaaccatcgttctaacctcaattttccttttctcccgcagggaatggcacctcaattgtcatccatccaacaagaatttcaacacttaataccagcttggtgacgctgttgtaacgtcaattgtttgacattcagattagatttaatacaacaaccatatagtggagtttctaacctcaatttccatttttttaatggggaatttcaagatttcaacacttaagtaccagcgaagtgccgggcgatttctagttggatgtatacgaacagagggtacgaattgatgcaagcaaaccactgttttttctcggtctgatgctaatataaattcgtgcagatagtacaagaaccatatagtagaaatagatttctgagtgaattattatcatgggctatctacttgattataaagataaattaaatattttaaaaaataagttaacaaaacaggttagaaaaaaagtttaaccaatcagtagattttttaagtaaattacacccacagtgcaacaacttgagagcaataaatgtctaagtgcaacaacttgataaatgagtgtattatatagtgcaagaaatattctggggcaacaacttatgtaagtacgtgctattttggttaacaagtactaggcgagttattttcatgatattaatataacatcatatagcaattctatagatattgcctaatcttagcaattctatggatattacctaatcttaaatttaatatttaaaatttacatggcacatccaattcgcatcaccggtttgatttttttattcaccttctgaaatctcaattgaagtataatattttctacatagtaaagattaattgactttcaattattacaataaaaaaactaaatatgtttatgcaaatccgtacaagtatagtaacaaaataagtactaaaaaattaaatatgtatatcaaatgctcaaaataattaaattgtcatatcacttcttaacttattggactaaaatgaaaccgtcctcacaagttgttacactcgtacggtaattagaaagtttttgcgctaaattacaccctcctgccttgttgcaccgcaaatataatttactctttttttaagaaaacatttttgagaagaatggatcaaataaactataacaataatgtgaagaagcagccgagaagaacgggatctaagctagctcggtgtcgctgttgtaacgcgggttgtttgacattgagattagattcagtacaagagccatccggtggaatttcttgcctattttcccccctttcttttctcagggaatagtacctcaatattcatccattcaatttcaagtttgcactcactcaatatcgatgaagtaccgggcaatttttctagtttcgatgcagacggacaggggatatgaacagaataaagaaaacggctgttttttttttctcgaaccgattgccacaagaaattcgtgacagttacgtgctctagaaaatgaaatggacagggtgactacgagatgaagtcgagagtgacagagcacgtgtacacttggacatggacgtgtagaagaagcaggcaagcagcatatagccctgatctgatgacctcgaaagtgaggaggcccaggcccaaatatctgtcaagaaaatcacggcccaatactacaaggcccatatctctcgcacgctgaaccgaaccgccattctcccccgcggagtaagcccgcccacccacgtgggctccacgtgtcgcttctcccgaggcccacgaagccactccatatcttcgccatatttagcggagcacacgcgttcgtggcgagaagcagagagaggagagaaatccagagacgcctcgacccctccatcccgatcaaggcgagaattcgtcggcgacgatgctgcgcgcggcggggaagcgtctcctcggcgttgggctgcgcccggcgggcggcggcgctggagaggcggcggcggcggcggcggcttcggcggtggccgttgtgaggaggagggggtaccacgagcgggtggtggaccactacgacaacccgcggaacgtggggacgttcgacaaggacgaccccgacgtgggcacgggactcgtcggcgcgccggcgtgcggcgacgtcatgaagctgcagatccgcgtcgacgaggagtccggtaggatcgtggacgcctgcttcaagaccttcgggtgcggctccgccatcgcctcctcctccgtcggtgagtaaacctagatccccagtatcggtgtgcttgtgaaaatctggtgggtaattgtacgaatgatggaagtgactgatgtcgcacttgaatgtggcgatgaaatttgtaaaatagggaagttattgtaggttttggttccatttcaatcaaattctattattgcaaagcccttagtattgaatagtgccgtccccgctagttcaaaattacgaatatgcctacctgagcattgcaatattgtgaatctgagaattatagtagatggctgaaattgagtttgacttacttttttgtgatgctattggttctaatattctacgctgttgccttaatgtgttcatattagtttttatagggtatagatatatcgtgtgggcattgtatatttgtagatatcatatatcctaacacagaaattcccatttccacggctagtatccagattactttgtggatcctatgtcttatgttaggagacaaggccaacatgttaggagagcagtcactgaatcactcacaagttgttttgaggttgatcaaccaactgattcagtgactgctcttgcttactatgttaagatttgagatagtgataagcactcttatgttgaaaactgcaaatatctgtacattattccataaattcgcatttagcaattgaactctgttgaccttttaattgtttgcaagtgtcttttaggtaataacatgaggacgtgccgttatgtatccaattaattgctgtctccctaacatgttggacttgtctcctaacatgttgccattatgtagccaatctagctgtcattgcggtcacaataacatttgacacacttgatatgcatttagggtgcaccaaaaatatattgacttcaatgtttaagaagccgaaaaagttaattttgcatggagtgtcaatcagttaaacatacttgagatacaattttttttgggtttagaagtctcttttagatataatatgcgtgcttatgaagttataaagttgaaatggctattggctggctctctctagactgcatagatacaattcttactatcatgcatggcttttcctaatatcattattactatattacaattgaggttaaaaagtttgtctctctaatatagttttaatttcagccagtgagtgggtgaagggaaaacaaatggaggatgcagcttcaatcaagaacaggtaaataactgctgtacttgctgatctagtccttttttttgtggggtctttgttttcttgttgatgtagtcttttcattatatgttagttctcagcaataaaggttgttttctatgttagttctcagcaataagattcattagtttcttgtgagatacactagagtgtcctctagatggctcggtggtatgggcttcaggatatgggcttgattttttttgcagcattggtagtcataggatattttctgttcttatttgcttgatgatatctatttgcttttatagatttgagcacaatgcctgattgctgatttttcttggaagcattggctgactcatggtagtgactaccatgtccattgagtctgcaaattcattgaaaataccagggcaaatgttaaattcatgtatccttaagttttagcctgtcttttttactatagtttgcttggagttttaatggtttccaattgcatgcctgggacaacgaccggtttttctggtagtgcaccagcacatctacatttatttttacctcttgcgcagctgtaccctgcatctgaatgttaattgtcggaacttcatagtaatacttcaggactgcaaattttatctagtgtaaaatttagtacctcaatactgattggagaagaaggagaaaacaatagagcaaactgatataaaagagagaagttttaacagcaagctgaaccactttatcttctgcaaaacccaccccaaagtgtgttgtccaggcctgcagtaggcagtaggcccacattggtgttcatctcatatctgtgaatggttagatgcaagataaggcatctaatccaaaagaagaatggaggtggaaaacttaggtcttctaaatcccgtgaaattcccgaatgcttagttatctattaactaaataaagtcatctatttgatgttacaagttctctcttttatgtcagcttgctccattgtgccttggtattaggaggtaccaaattttttttataatagagaattattactttctgcattttgtaaatgtatgatactattaatataaatgtctatttgcacaaatatttatagaacatatgaagttcgaaatgaatttaaaaaagtcaacgatgtcatacatataaccagaggtagtacatctcagggatcgtaggctcatccctcatttttaggaaacatcctttaccatattattgtgagtttcacttacaatcctattgtcttccgcctgtggctagcattgcttgggcacaagctttattgtgctcattggagttctattgacttatcatgtcctgttttcagtgagatagcgaagcatctatcgcttccgcctgtaaagctccactgcagcatgcttgcagaggatgcaatcaaggccgccgtgaaggattatgaagcgaagaaggcaaagttggataaggggaacgagtagacatcctaaagagagaacaggggatagtccagtagcatagcatgtactagtatcataaaatgtgtgatgatgtttatattgccacggaaataaacgcatgcaacgttatagtttgtattaggcaaagcctgcccctggcagcggttcgtccagctatagtacaccacatgttgtcgaaggtgtacacgaaggtatgcaaaacttgccagtgtcgtttgtacccaagttctgtacatgaaaagtgcttgatactggtgagtctaatgtagaaaaggcgtttaaccaacctgtaaatgatacagtaccctagtattgtagtacttcgtccgtttcacaatgtaaaactttctagcaatacacacattcatatatatggtaatgaatctctacgtatattgtaggatcgaaacacaaagaactaaaccaaccagagggggatgaatggttggtatacccaaaaacccaaagtttttgcggaatcaaaagttacccttaaattcgacggatcacggtaaccagtttgaccgcctggaagtcgtcgtttgactgagatagtaacaccggtcgaaccgccgagatcagctcctgccgtctgtaatcgttgccggtctgacagcaggtactccgtcggtctaactaccgcgatgctgccagtctaaccaccgatgtctcgctggttgggccgccgcacccgagaaaacacaaatcgaagaactctcgaagtagatgtctcgccggttggaccgccgcacccgagaaaacacaaatcgaagaaatcttaaagtagataacactttattactcttatatgtgtttacaaagtgcaacaacagactactcaccaaaatctcgactaaattcgaaaccctaactaaatgctctcaaaagtgataccgggaagcctcacactccctctctatttatacacgaggtaggcagcctaaagccacgaaccaaactcatactagaagtcctaatccacctaggaaaccttctcgtaccagaaacaaactttacaaactccaatcataacaaatttggactccttccaaattcaactccgtatcccatgtgcacacaatacctccatcgtatgccatatggaatcttcaccaaccacgtacattgaactctagcctaagcatcccgcatgatatctgaccgtcacggacatcgccttatccccaagtcaactcccgatccatcaccggcaatactctcccgagacatcgagtcacctacacatgaagcaaataaagaaaccatattccaagaccaatctatctccaacttgactcattagtagcaaacaacagtattacatacacatagtatccttctagaaaacataaacataaaacaatcacggatatccaaacaaacaacccgaaaccaaaaccaacacagggtcggccgatcaaaccgcgagctggccggtctgaccgctcgataaccgccggtctgaccggcaacccatgcccggtctgatcggaccaaatccagcaatacatgtttaacacctgtaaatccaatcatctccaaaaccacttcgtcaataatcttcaaatatgaaaaccaataatcacatatgtcaattgttcatcacagaataataatcaaaaacacctttgattttacacatatatgtgtttagattcattaatatctatataaatatggataatgctaaaaagtcttacattgtgaaacggatggagtatatgttagaacatagtcaagggctcaaggctgctgcctgttgtgcaaccctgtcctgtttcttttatcggggctcttttatgattgaaacgcatatagacgtcgatagtccatttcacagaggcatgaaacatgtggcgtaatctgtggactttgggctgcttacggttaccagcagaaagctaatgggtttggcaaatgtggcttccagcagtagtggtgcatttgcacttcagctagcagctggaaatgaaacagtttggtacagacgttacgctcttcaggattcaggaacgtggtcttgtttgtagctatggaagttgggcactagagtacacggttttcattaactcgggttcactcgataagatacttgcagaattaaacacgagtaccctcactctcatgcaccacgcaaaagcttaagatccattgcaaccttcaagcctgcaagctgcttatccaagcaacaatagtttaaggaatagcaaccatatatctttgcctatactccatccgtcccataaaaaatgaatctaagatcagatgtgatatattatagtactacgaatctggacatatgtatgttcagattcataatactaggatgtgtcatatccggtactaggttggtctctgttcataaaaaaacgaatctagaaccgaatatgacatattatagtactacgaagacatatgtatgtctagattcatagtactaggatgtgtcatatccggtactagattggttttttatgggacggagggagtatgtagttagttgcctgcttacacacaccgttccacaattaattcgtagtgttgttccttagtacgatttgtctctgatgtgtcttgagctaatctttcacgcgattggtaataccacgatgtactactaactagcaggggaatttactatttgacatcctccaacaatcagtttttaaatatcactctcctaaatttctgttgtaatttactacccgatcttcactaattctctctcgtgtgtcactctttgcccaattcctaactacgtggctggtttttttattggcccgtggatgccctcataaaaagaccaaaataccctagggatcacctacaaggagcggcttaagaataggccacactattgcagtcactacggtcagccgcactgatgagcaggatggcaacggcaaaattgcccatggccgacgagtagtagaggatgagaccacctgaggaagccaccagcacacggcccccacgcatggtgcgagcgtggtagaggttccaggaacggtccatagcatcaaagacgagcagtgagtgaggacagttaaagagcatgagcaaccagtggtccaacgagacagggcacaccagttgtcgtggaggtccttgttgtaggtccttgttacaactacagaggttcgtaacagtcctcaaccctcgcggcgggcacaagtggtagggaatgaaagtttagaaaagtgacacttgaaactgtctttttggaaggacggtaaataataaaatctcccctaactagcaaattcagcttcatctccctgctaaaaattaatcagctacctagtcagagcatgattgacagattgagactgaactttgacgtggagatccaacctagctccacgtaaacatttccatggaattcgcacgtgcgaaataaccaatggagaggaaaaggtacatagatccaaaccaatggcaattgcacgtaactatgatacgatcagttgccgaagaagttaaaggcagtgcaaggccaaacgagacgatcgagcgcccgtttgatgcgacacgccaacccctgcagccgtttcgggggctcccggcgagcggctttccgagttaggcgtgccgaagttgctatccatccatcgtatcatcatcatcagccacctcgcgtcacgtcgtgccagcctcccccgcgcgcgcatgctgttcttcttgtacagtgcagtatataagcgtggccgtcgcgcggcgaggtgtgtacgccgccgccatcgtccgtacgtcgttgagccgccggtagccatgcagtatacggtggaagggagcggcggcggcggcgtgcagacggtggaggcggcggtgcgcaaggggccctggacgatggaggaggacctcagcctcgtcaactacatcgccgccaacggcgagggcgcgtggaacaccctcgcccgcgccgccggtacagtggctgtggcatggcatccatatgctccttgtcaactgattggtccttaaccattagtgatgataaaagacaattaccattataaccttctagcttttatacctggcccacactcttaagtacctttgcatctgtaccttctatcttagctctaatatataccaagcatagtagaaaatctctctctctctatatatatatatatatcttcacgccatcaagctgcagggcttaaccgtaccgggaagagctgccggctgcggtggctgaactacctgcgacccgacgtgcggcgcggcaacatcacgccggaggagcacacgctcatcgtcgagctacaggccagatggggcaacaggtaacgcacattaactcgatcgcctccatcgcaaaatattgctatgacatacagcatttatgattccgagatggtcttccgtttcgggctctggcggaatgacggttttcacgaaatccggtacaaagccggtagattccgaacaaatttcgtaaaccaaactttaaatacaacttccctgagtttaccgataagctcgcgaaaaccggtcagatttgttaaattccgagcaaaatcatcgaaatttcatcagtaactagaaaaagaggtaaactgagattgtttttctttttttaatttgttattcttttctttcgtactgtaaatttcagtaaatacatggaatacatcttttttttattttataaatatcatactatttataagattttatttaatttttttttccttttttatcaattcaaatttgaatttggatgaaactcatcaaaatctcagacatcttctattttggagcctcgtcgaaacctcgaaatttcgcgaaattcgaccggttttcgttggaattgtgaaccctaacgacacatgctaatattacgaatctacgtatatatatatccaaaattatagtattagtatgtctcatttagtactggctgacaaaattttggaagggatcatcgatagattgatcacttggattcttcaggtggtccaagattgcaaggtaccttcctggccggaccgacaacgaggtcaagaacttctggaggaccaagatacagaagaagcacaggaaaagcactgacggaatttacgcgacgacgacgagcgaaagcatcatgcctgcggctacagtgcaccagaacacggtggccgaggaccaaggcagcagcagcgtctccggccggaccaccaccgccaccgtcgccgtcacgcaggagtacgccactgaggcgccgccgccgagcggcatgagtagtggtagctacttggaccagctgcagccaggctacgcgagctcaatccatggaggacaagatggcggtgctgctgccgccgccgctggtgacgtcgtcgtctccgacgagttcttggcagcgtcgagcgacaacttctgggccctcgaggatttgtggcccacggtgcagtctctccacggcaattgctgaatggatcatgggtgattgtgttcgatcatgtaggccatagcaaatctatctattaacttatcaaagaaatagaaaaaatagccttcacattcgctctcacggcttaaaaattcccacattaatcggagaaaaagaaaaatagagtccatatagaaatacaatttagaaatagttgaaattcggaattaaaaaataagaaatattagaagataagactagagtacatatagaaatacaatttacaaatagttgaaattcggaattcaaaaataaggaatattagaagaggaaactggagtctatatagaaatacaattaagaaataatagaaattcagaattaaaaataaggaatattataagtagagtatagagtccatatagaaatacaattaagaaataatagaaattcggaattaaaaataaggaatattagaattagagtatagagtccatataagaatttaaaactaactaaaattcagaataaacataataaaattaaaagtagagtttagagttcgtataaaaatacaatttacaaataactaaaattcgaaattaaaaaaaaggaagaagagtataaagtcaatataagaatgcaatttagaagtaactaaaattcgaaattataaattaaagaatattgaaatatgagtttagagtccatatagaaatacaattaaaaataataaaattttagaattaaaaataaataatattagaagaagagcctagagtctatataggaatataatttacaaataactaaaatttgatattaaaaataattaataactaacacgtatataaaatacaatatgaatactatacattagtagtttcgtaaaggtagtacaaaatttaaaattatgttgtcattttaatatatttcaataatacattgagaaaacatatatgttattatgtgacaaaatataatgatgctagccacgcaatctgcgcgggccaccatgctagttagcaaagtatctgtatatgcacatcaattcttcaaaggaaatgtataaaccggaatgtatgatttggcaaatccagttattcaattcttgcagcgaaacaacgatgatacaaaatgtctcgaggtgtaatgcaacacaaaaaattgagcaagatttgggtgtcctagtagcctagtgcgtgtgttcgtcagggaggtcaggcgattgacaccttggcgccgacctcctcgagctgcttcttggcctcctcggcctcctccttgctcacggcctccttggccttcttggggagaccctcgatgaggtccttggcctccttgagcgccaggttcgtcagcgcgcgcaccaccttgatggtcgcgatgcgcgcgctgctcggcacctcctcgatcaccacgtcgaactccgtcttctcggcgggcgcgccgtcctcgccgccgcccgcggcgccgggcgccgcgacgaccgcggcgggcgcgaacgcggccgcggacacgccgaggcgctcctggaggtggtccacgaggcccctggcctcctccagggtgagccccgcgatggcgtccccgagctcgagcaccttgggggaagaagccgccgtggagttgcaggcgacggagtggcggccgccgccgcggccgcgggtggtgaaccggagcgccgcgggagcggaggaggcggtgcggacgtggaagaggggtagggtggaggagacggcggtggaagccatggccatggcgagctcgcgggttcctggatggcgcgctctgctctgcgacggggagaggagaaaaacgcgggaggagggcgcgcgcgataagataaggcgtagatgggttcgagtgcgatgtggccacacctcccgtgttctacagccgttggatctgagatggacggccaggaataactcagaaacttgcctatgcctgacgtggcatttcgagctgttcaaattattgtcaaaaataacatttccaaaatttagcaatggccaaattttagtacgctgataacatccccaacattaccaatagtattaaataacaaaataaatatttattaatttactaaaattatatagttcaaaataacatccatctaaacaggtcctcctgagagtggattttgatcccttgaggggtttgtatctcgctcaaatggttataaaaaaatataaaaaaaatttagaagatgtatcaacatgtgatatattactctagaaacataccagttcaaattgaatttctacatctcacaaaaaaaaaattaaactacagctagttaacatatattcacagtaaaatttatttttttgttatgagatttagaagttaaatttgaacttacatgtttgtggagtggtatatcacatgttaatatatcttcttaattttttttaatttttttcataaccatttgagtgacatgtaaccacaaggggacaaatagtctcccttccatcgtacttttgcactctctatctactgcctaatgacacacactgccaagcgatccttctttgttctgctcaagattcatgcagaaaaggaccagattagcattcagtaacaacttttcaacctctggcttgaacaaaaatccattctctgtcttttgctgtgcacaatgtgtcagaaaaaagtgctaggatccttggctttgtcatggccaaaaaggggaaatttggaaagtagcaaagttccaatcctccccttccacactaaccccagcctttaagctcactccaagcatatttacccaagtgatattaagtagcctccaaattgttcttagctctctctgcactaagcacaggtttgcgtgatgtcgatgtcctcgccggcgacgcctcttctggccggcggcgcgcacgccatgcggccgccgcggcaggacacgtcggcggcggcggcggccggggccaccggcgggggcgggtcgtacacgccggtgttcatcgtgctgggcgtcatcgcggcgctgctggtgatctcctgcatcgtggggcaggtctgcaccaagaagcac

SEQ ID NO: 57764 - DNA, 12293 bp, Oryza sativa
cgtgttcttgcaatgttttggtaagcattttgtagggtttcaatagctacaacttaatattcatgtaaaaaaaatatttcaacaatattgtgctttttcaagtatattgtatctctcgtattacttctctagtttcgcttgttggtactcaatgtttcatatatgtgggggaaaagtatgaattacccctcccccgaactatcgcgctctaccgaattaccccccaatccacaaaatcggacattcttcatcttgtaaaccggacaaataacccctccggctcaatccgcggtggttttgatcctacatggcagtctagtcagcaattcatttataaaaaaataggtggccccacctgtcagtttgtctctcctctatctctttcccaatctctcactccctctctctcttctttagggcgacggcggaggcagcggcgaggcaacacgagcgcggtggcgggggaggcattgcaaggcgaggctacggcgaggtgagcgtggtggagaaggaggcgagcacgagcgcaggtgagtggcgcaggggcaggcggtggtctgcggcgcaggacatgaaggctggacgtcggctgccatagccacggccgaggaggaggcggaaaaagaggaggagtgggtggaggcgggaagaagggatgaggaaccgttatgcttcccctggctgtgatcatataccttccggagaggagaggaagtgggacagcagtgttttacgcccctcttacctaagacagcctcacttgagcccgtccagtcacgtaactagttcccactcccacggccgccccctttttcatctttcttgccccatcctgagccctacatgaccgctgtggctatagcggtgctggaaggagagggtaggagcagcagtaggaggaggagtagtaagataggcgtaagcgggaggaggcctagaaatcctccaccaccgccactggccactttccccattaaagcctcatcattggccgccgcccttacctcgaaccccacctcctccagcaagttgtcgccgacgttgcccccatcatcctcctcggcatggcccatcggccgccgcgccctccccacgagcgctgccgctcgccgcctccagtgtcctcctcggtgccgcccgtcgcctccaccgttctcctcggctcggcccaccggctgccgtgccctccccgtgacaccgccgtccaccacggtcgtcgccgcacaaaatgcgagagagatgagagagagagagaaggatgaatcatggaagagagagagagagagagaaagggggtgagggggagagaagctgacatgtgggtccccccgattattttttttaaaaaataccgatcagactaccacatgtacaccacgtgggacgaaaaccacttcagaacaattagggggcggagaggaaggcgagccaacgcggacgaacagggagcagtcgcgcgaagtgcttcccaaaaaccttattgccgccttctcccggtgcagtacgtcgaaggcagaggttccggagacctactctcccgatcgccggtgcacgccggcgagcgggatggagtagtctacgagtgacggcgcagcacagagtaggaggcaaaccctagattgatttcgcatgtgagcgggatagagtaatctacgagcgacggcgcagcacaaagtaggaggcaaaccctagattgattttgtcgacgggtggtacccgtagaccggatatagagggtattggggtacgttggtacaaggatctacgtaatacgatatcaagcaacaaaagacgaggattatactggttcaggccccttggtaggtaatagccctaatccagttgatatgggattatatggtggaaaacacaggttacaaagggaacaatggaacttgtcggatccggcgagatcgtagtcaagttggttcgactagatctcgatggcttggctccttgcaggctccggcttcgtaggctgtgtgggttgtgttggctctgagattcgatgccttaagccctcaccggggggtcccttttatatcacagatctggaggtctccaagtagaactaggagatatcagaccctattcgatacgttaatgacccagtcttgtccgagtaggattcttcccatccgtagattccgtgaaggatttccatagaatatacaggaagtatctgtatgcgcgcgggtataccataccgatatgttacatatatcgaagggtaaagggtatgcctaacccgtaaccctgacagtagcccccgacttctgcttaaaaatgggctcgtgtaaccattcacgacttcgggtgtcgagactgttgtcattcctggagcgaggaccgcggagacaggccgtagccgagcatgccattcaaagcccaacggtcatgagcgaattttaaattgaagtccaaaaaaccgccgcgcataacggacccagaaatttccggcgggcatctctctctgtccttggaattcgcaccgtcggtagtgcgcctatttaaaggaattttggagatccattttgaagtctgccaaccgtgttgaaaacattccacctgaaaacattccacctgtaagcgttcatcaacctaggccctttctccggcgatcttgaatcagcaatcaacctcggcaagtcatcttccaccagtgcgtcgctgaagaagcttcaggaatacggcgcccttcctggccatggaaccatggagagggaaacaggaggtactaatccccagcccatcttgggtcgcatggttgcgatcgaagattatgttctctgcagtcttctcactccaccttccgagtttcttctcctggttttgaatttctatggtctttctcttctccatttgaaccccaattccattgcctttcttagcatctttgcccatctttgcgaggcctacattggggtagagccttttcttgatctctttcgctcttactatgaactgcgttggatggaatccaacagggtatctggttgcgtcgggttccgacttcgggaaggcctgaagtcgcgttatatccccttccagtgcccttcttctcgcagcaaatggcggaataggtggttctaccttgagatcaaagattcgaaccccgtctttgttgttcccaaagaacaaccggacaagatttcttcttggaccgcaaagccccccttgaccccctctcttcagtcgtttatcgacatcatcgatgatctccgagtacggggcttgtcggggtatgaagtcgttgcagacttcgttaataagcggatccagtcgctccaggctcgggcctatccagcttataactattccggaccggaggacgcgaccagggtttctcctcggggtatctttctcacatttatcctgacatgcttatgttcgcgttcctatcgactcatcgaaatttggttctcgattcacaggtctaaacatcgaggccgtggagtgccgtgtcggccaggtgatgatcagcggtccgacaacggcgagcaacatccccacgcccctctgtgaaaagggggcggctgagcgtgatgatgctatcaacataagtgcatccgataagcatcgcggattttttcttcgagatcaccttatgacttgattaagcgtatgctctttctctgactgacatcatcgagccactcatggaccatcaggtggcggcgtctctgaaagagaaggtcgccaaggaggcgtctgatgctgctgctgccaccactagtggtggcaatgttccgacaaaggggaggaagttctcctctgtaagcggacatcgtcgcaaggcgccgaccccctcggtaatttatcctatcgtcagattgtgcagccagaaggattttgccttactttgcattgaatgtctttcaggcctcggacacgtcacccccaccagcacgacgacaacatattgtgacgatcggcgagaagtaagtagatgaatttttagatttccgtgattctatacaagcgttgtgtgacccgtggtcgtcccgtagggaggcgcgggcaaaggctgcgcaagctaagtccggagggacttccagcgcgtcgcctgccgcggcctcgacggatgtcgtgcccgcagccgggagccgagaggcgacgcctagcggtccagtcagcgatcccgcggcaggtcatgatccaccagctgccatcctcacctgggaggagctccaagtcaagatgggcgcctcctcgaagcgggtgctcgcggcatcggctgcgagattgtggaggcgaggtcggaagcagcgctggcgaacgcgcgtgctgatcggctggtgcgcgagttggctgaagctcgtgaagacctcacgaagatgagggaattggtggccggcaacgagcgacaacggaaggggctcgaggaccgcatgtcggatctcgggaacaacctgtcggagatccggggctcgttgcgggtcacctacactggcctgcaccagctcgccggggagtgcggcatcaagtttacgatcccggtgaatcccgacgagttctcgctgacctcctcccttgcggaactggcgacggcgatgggggagatcccctccaagcatgcagccaggatcatggaggagacgtcgaacgggatctacaccggggcgtgtcatgtcctcgcgtgtgtaaagctgtcgcgtcctgaactcgatctgcgcgagatcttggatcatggggcggctagtgacacgcggagggaggtgatggaagaagtcggtgatttgggggagtctgttctccccctatttgaagagtaggacttcttgtacttccaaggcacaatttgtaaaacctgaattctgaccaccttcgtgcgggcaattatcatcctagtttacttttgtatgttgacctcgggaactcttgtcctttgtagagatgctgatgacgaggatgtccagcagcgcgggcagcccgagtcactggcgataattccggtactcgagtttgaaccacacgtgtcgcccgacaatgtggatcagacccttgatacggagacagggataacgacgacttccttaggttagtagtcccttcaccccttgatgccctcccgactagatcagccatgttctcgaaagaggcgtacagcttgacttagtggttatcaaattatgccgacctagagggtgcccttgctagccaagatcgtcgtatccaatactggaagatgaagtttgaagtggcggaactcgagagaaccatgctggccatgaagaaagagcaggctgtggaaacgctccgaggtcatgaggtgtggtttaactcgtacttgaagagttgctgcacatccatggccagagtctgtacagaacttcgagtggtccgcggagatcctgaggagtcggcggccgggtacatctcgtggcagaacggggcctgtgcccaactcgatggcatcggcaagcgtatcgacgaggccttgaagcaggagtgtcgtcgatcaagccgatacgccggagggcacgtgttggcttgcctacgagatcatcgcccgcgcttggacctcgaatttctccatgagggttttgctcgttctcggaggactccgacggagatagaccatctggcgaggtcgatgtcgccgttggccgagaagatcttccagtctatggactggcgttggccttcttggtagttttcgtaccctgtgacaaatatcttaggaaaaagatgtaatgtagaaaagatttgtgtaaaaactgtaagaagtattgtgtgaaatagtaaagaaatctatctttaacaaatgtctcttactctggatgtcgtgtgtaagagtgcgttctcagttaacgactttagtcagccgtttgagtcgcacactctccctagcccccagccttgtcgtcgaaggaattttctcggaggataaggctcttggacctttgacccgccttggttaaataagctctgatcctagcccccagccgtgaagttggaaagttgatttccgatttcacggcttggttaatacgcacggcgagaactcttacacgaccagatcttacatggtctttcgtctctacaggatctgacaagaccttatcggctctgggcgtccccagccgaagatcccttaggttcctcggaggccttgccaagacggcgtaaagggacataaggacaggtttcaacgctaggtgtcatcagggtaagggatcatcgggcgaaaacactttggttgtaatatgggcctaaaaataggcttcattgatactgtaagatgtcttacaggtatggatggtattgactcatacgtagaatttacgtagttggtcaatgttccaagaatttgctaactcgcgaccgtcgccgtctgcgattttgaatgcgcctagccgcaagacttgtgtgatcgtgtaaggtccttcccattttggtgagggtttgtttcgccctgcttggctttgaactcgtcggaggacgtagtcgccgatcgaaagtatgcgtgctcggatgtgcttctcgtggtaacggcggagggcctgttgatagctggctgctcggacggcaacccgttcacgatgctcctcgagaagatttacatcgatgtccccctgttccccctggtcctcgtcggagtgcttctgtactcatgtactctgatgtcgtagctcgccggggagcatagcctcagagccgtacacgaggaagaagggtgtttccttgttagacgttgtcggtgtggtgcgtatggcccatagtactgatggaatttcttcaacccattttttgtcgtgtgacatgagtctgtcgtaaacgtgggtttttatcccttgtagtactatgccgtttgccctctcgacttgtctgttgctttgagggtgagagaccgaggcgaagcatattttgacccccagcccgatgcagtaatcctggaaatcggcgctgatgaactgggagccgttgtcagttatgatgcggtgcggtagtccgtatctgcaaaatatccctttgatgaatttgatggcgttgtcggccttgatttcccccgtgggtactgcttcgatccatttggtgaacttgtcgatcgccacgaataggaatctgtagccgccctgccctcgtgggaatggcccaagtatatctagcccccagcacgagaacgaccaagttagagggatagtctggagcgcttgcgcgggtagctttgtgtgtttactgtggaattgacaggcttcgcatcgctggaccatgtcgcatgcatctttaagagcggttggccagaaaaagccttgtcgaaaagctttcccaaccaatgtccgaccggcggcgtgtgacccacatatgccttcatgtataccgaggaggaggtgtctgccgtcgtcggacgagacgcatttgagaagtaccccgtttggcgctttcttgtatagatcgttgccgaccatacagtagatctttggtttacgggttattttctcggcctctgtatcgtcctcgggcaactcctcgatgttgatgaatttgattagtggaatgcgccagtcgtctgtggtctcgatgtcgggggtgtccgggctaacttcgccgctaacctctttcactgatggcttcgtcaggatgtcgagaaaagtgccaggctcgagcgattctcgtctgaacgcacgttgtgctaggtcgtctggctcaatgttgtccttgcggtagacgtgtcggacctcgatcgcatcgaaccttttctctagcttcctgacttctgcaagatacttggataactcggggttagagcatttataatctttgtgcacctggttcgcgactagctcggagtcccctttgacgattagtcgcttgactccaagtgcagctgcagctcttatcccagcgagtagtccttcgtattctgctgtgttattggtcgccctgaagttgaggtggattgcatgcttgaattgatcttcagaaggagacgtcaagataaatcctgcccctgctccttggctgttgagtgcgccatcgaacgccattgtccatgtttcgttatcgacttggttgtctaacttgttatccggcatagtccaattggcaacgaaatcggcgagtatctgggacttgatggctgttcgtggcacaaagtggacatcaaactggctcagctcgactacccatttcgcaatgcggccgacaacatctttgtttctcacaactttgccaagagggaaaaaggagacaactgtgactctgtgggcttgaaagtagtggcgtagcttccttgatgtcatgatgaccgtgtaaagcagcttttggatctgtgggtatcttgtctttgcgtcgtggagagcttcgctaacgtaatagactggtcgttgtactttctctctctcgacaacaatgacggtgctaacggaatacggtgtggcggcaatatagaggaataattcttcattaggttggggagcaacaagtacagggggtttgataggtagcgcttgagtgcaacaaatgcctcgtcggcttcctgtgtccatacaaatttgtcttgtttcttcagcagagcgaagaaaggttgtcctcgttctcccatcctagcaacgaacctgctcagtgccgccatgcatccggttagcttttgtacctacttgagtcttgtgggcgacttcatgttctcgattgccttgatcttcttggggtttgcttctattcctctgccagaaacgaggaatccgagtagcttgcccgacggtactccgaacgtgcacttctctggattgagcatgaggcgatatcgtcggaggttgtcgaacgtttgccgcagattggcaatcaatgagtcgcatgtcttggttttgacaacgatgtcgtcgacgtatgcctcgacattgttgccaagctggtcgctaagtgcgccctggaccgtacgctggaaggtattccctacggttatcagtccgaacggcatcttaacgtagcataataccccaacgagcatgatgagtcctgtcttctcttcgtcctcttttgccatgttgatttggtggtagctagagtaagcgtcgaggaagctcaacaactcgcaaccggttgttgaatccaccagttgatctattcgagggagagggaagtgatccttggggcatgccttattgaggtcggtgaagtcaacacacattctccattttccattggccttccgcaccatgactggattggctagccactctggatgaagtacttctctgataaagccaactttgagaagtttgtcgagctcttctcgtatggcttgttttcggtctggtgcaaatctccgcagtctttgctttactggcttggcatcgggttgcaccatgagtttgtgctcaatcacctccctggggacccccggcatgtcggacggctgccaagcgaacacgtcagcattatcgcggaggaaggtgatgagcgtgagttcctatttctcgtttagtgtcgccccgatcttgacggtcttgtcggggttggcactggagagtggaacgatcttgatggtgccgtctggtttcggcgtcttgtttgtcttactcactttcttgggtggcgtagtcgtggcgagtgggctgggcgtttgctcgaccatgttgaggctccgcttgtcgcactgcaccgctagctttgcgttcccttgaatagtgattgttccattcagtcccggcatcttgagcacttgatacgcgtagtgagatgcggccatgaacttcgcaagtgcagttctcccgatgatggcattgtaagctgtgtcgaattcagcgacatcaaaggtgatctgctctgttcagaagttgttggcttggccgaaaatcacgggtaacgtaatcttgcccaatggtttggacgatgattggggagtaattccgtggaagggttgatcggttggtgtcaattcgctttgcggaattcctatcgcttccaaagtgctggcgaaaagaagattgattgagctgccaccgtcgatgaggactcgcgctaccttgatgttccgaatagtgggttcgaccacgatcggatatcgtcctgggatgatggcggtcttggggtggtcttcttccgagaactctatcttctgctcagaccacttcatcttgggtgcagccccctgccatgtcgaacaaacgtcacgttccactttcttgtattctcgctttgaggagtacgttgtggaagcgccaaagatgtgtgaaacgtggaggtcggagtctggatacgctggatccgattcgtgaggaacctcctcctcgttcttctcgaccacgcgtactcgcttgctttttcaaatgcgatgtgcttctcgagcgaatttttgaaaacaaggcaatcttccagggaatgtctgtccgtcttgtgtatggggcaccatgctttctttgtgtcgctactttgtgggtctgggcgcttgggagggttcacatattctgctgcgagaacttccacttgagctttccttttcccatttttgcgatttttctttttgcttgactcaaatccgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgtgtagtgtagcgatctctgacaccggatttgaaggcgcgaattacagaagcatcggtgatttcggggattgtatttctgcactcattgaagcgccgaagatattccctcaatgattcacccgagttctgagtcaacgcgtgtaggtcgtcttctatcgcgtggcgcttgtatgttccttggaaattggcgacgaactgttgccacaggtctgcccacgaagagattgagtagggaggaagatgcatcagccatgaacgtgcagaacctttcaacgcagttggtaaataattcgccaacgcgttgtcgtctgctccggcagcgtagagtactgtggagtagacttgaaggaactcctctgggtcggggctcccatcatacttttctattactctaggtcggaatctctcaagccatcggacatcacgtagggaacgaccgaaagccctacacccagcgttgggggcggtgggttgtcggcggttgtgtgtccttcgtggatgtctgtctgacgatgaggaggacgaggatgatgacgatgacgacaggtcgcttgcttccagcgtacgattacgaggatgtcggcctggatctcgggaatcctgtcgtcgtctcccactattgtctcggcgccgatctccgtcatcatcgtcgttatggcgacggcctcgacctgtattgtctcgcacccgtcgttcgcgatcgttgtgatcgtggtggttgtcctggtctcggtcctcgtttgagcggtctctttgatttccgttatcatggcgccgtgaagagacatgacgccgagaacgattcacattgtctcgtgtgcgtcgtgcctctcggcggccgttgatgtgatctcggagatcgccggtgccgcgaggtggaggggtagctcgttggggtgattccctccgttccaggtcttcaccattgacatcgtcagttggtggctgctccgggtgtgctgcgatagcggcttcttcgaacgtgttgctgaggttggtcactgattcccgtagtcgttctatcaaacgctcgaggtcatcgttcagaatgggatcgtatggagtttccctcagtatagcttgaatggcccttatggtgctgggctggagtagtcaattgtcctcctgcttctgcgttggcgtgcgctgacgtgccaacgtcatcgatagccaatacctcccacgacacactcgttttcgatgacccatagtcttcgagaaggtgtaagactgatggttcgtgaggatcgatatcgattaccccaacaaatcgatctgaaattgaagtcgctccttgttccttgtcgttatccctgatggggacgtatgacttaggagacggatctttcatggcgccaagaaagaccttgcagcttgagagcccgtgattctttgtcttgtgaataggacaatagacatcacgagttggagaaacacgctgaattccacgctctttgcaggcgtgaatttcagcgcggacgttgaggaaaacccagcaggcttgcaaagtgtgttttctggttttgtggatagaacaccaggaccttgtggcttcggaagtcatctttgtcggctcgcggttcatgtcggaagaacaaggtttggccgcatcagaatccttctcgagctcggatgtcgtcgatgctctgttctccgtctcagcgggagga

SEQ ID NO: 57765 - DNA, 7347 bp, Oryza sativa
gatcaccttagatgtctaacactatgctttgtcacacgtgcgaaaggcaaaagtgcagacgtgcattatgcagcaggcaaaaagagaattttggacgctttattatttgcaaataatagatccgatgattataataataggtccaccagttctagtgtaagtgtaaattagttaatatagattttagattgttaatttaatgggtacacaatataatggtgtaggccttattttgaaatagtgcattacttgagaataatagaccaatgtaataaaaagtagatccgatgatttatataatggagccattagtttaagtgcccgtataaattagttaatatagatgttgtttatttgataggtacatgatataattgtgtaaaacttattttaaaatagtgcattatttgaaaataatagttcaaagtaaagagtacaccggcttaagttatatgatggtagattatttatttgtaaaattatgattatttaaaaaatatatccattatatatataaatggaaaaagaagaaaaagggaaaaaagggggggaggaagcgtacgtaccttgtatgtacgtatatactccacctgccaatgcacgggaggagaggataggtgggacccatggtatttagtttgttttaagatcaattttatctaacggtgtataatattaaacccaccaatttaagtgaaaatcaaggcatagatgttttgctttttttcttagaatttctaggattttctctattttattagagtgccacgtggcggattgagagcgtttgtaggaagtttcatggacttttagtataattaatggtataaaatatagttgtgtaacctttattttaaaccgcgtgttttttaaaataatggttctaaataaaattatattatattgttaatataatgggtaaaataatagaatcctaaaaattttattttcaaagattatggatctaatttatttacgtatatattgtgatatatataatctatgtttataaagttatagttctttaaaatttaatatcactaattatagttacgatctcatcagagaaaagaggggaggagatggaagcggatgtaatttttaatgatatatgcaatatatatttatttgtttttaattgtacgttgctgcgttacagttgtatatgtatttttttggtttttttatgagcagtatgtaagtacctttttctcatcggtgtgctgagagagattaggtgtgaggttattaatagatttaatttaatgatctgagataacatatctactaatttcaatgaaaatcgattactagatgttttacatttttcctcagatttgcttgaatttttttctaatctattaaagtgcattttagaacttaaaatattagcagttaatatgtgtattaaattattaatttggttttctatctcatctaactaagaagaagggaaaaaggaaaaaaaagagagtacgtatgtatgtacgtgcacgtatgtggaacagtggaacttttttttttacgtgcaaatctttcacagctaaacatagttagaaaatctgcagatagatataggtgttaactaaaaaataggagcagttaccgagaaaagaggagagaaagagagagaccggagggagggaggtatagcacgttcctgcacatgccgcatatatgcacgatggggatgagggctaccagatttttgtttcttgcgtcgtacgccaagtttgaggtatttataaaagcgagatattaaccagagaacatctatcacgatttctccataaattctttttgtcagtattaattaattgtttaataatattttaacctattagcttcatattgtatcatatataagtaatatctataagcaatcatttataatcttcttcatttgaaaagaaggtagatttattttctttagaaaacatgtcaacgaaagtaaagcaagtgtaaaatagaagcaaggtgtttttttaattgtataatatattatcataatatgttaaaagataaattgggtgggacatgaagctccacgaaatacatgggtttatatagcctaatattattgatatattttgagaggtgatatatttatgaacatttcatgtagagtggatgagagactccacgcaacctagtaggaatacgataacgacgaagtatcattgcacagtaatatttttaaaatgtcatgtaccatgaataaacacttttttatatataagatagatctaacggttagaaatactggttctaccggtttaagaggcataggagtattttaaaaatgtagcttaaaaattatggttgtttttatatctaactaataaagtgagcgtagttcaactagttaggtttcttgttgtgaaacttgcccacccatgttattaatcagaaggtttaaactgtattatgattttttcttaaaaatgcatggataagtgaacaatagctatagttcgtagaatatatatgactaaaagtaatgaatttctttaataatatagttaatttggatcttcaattttaaattttatagttaataatctaatagtgtgcacaaataaaaattatctatctgatttagataatataattgtttaaaatttgttatcataaaatattttttccatataactaaaagaggaaaacatgagagaagaaatatgtggggaggtaagtacacacatgcatactggactggacaggcggagaggatctaggggcccttttttttatcattttgtatttggataaatcataaaatatttttcaactaactaaaaaggaaaatagaagagaaaggaaatatatgggagaggcacataggcacgtacgcaagcatacgtactagatgggaggggtgggatatgtgggcccttctttttatcgctttctatttggataaataaatctaatggtagaaaataatgggtgcacagtatattagtaaaaatcgacggctagatgattaaatgccacgtgacagcataggagcgattgtaggagtgctatgtggcggcgatggtcggatttctcttatttattagagtgccacttggtgacttgagagcgtttacaaggcaccacttgacggtttgggagcatttgtaggaagtttaatggacttttagtatataatagataaattagaaaggtagcccgcgcacatgcgcggacaccttatataatgtgagaaaattttattatgaatatttatgtgcgggtagatttttattaaaatattttttattatattctaaactaaaatgaaactcatcttgtgtgctttgaacgctggttatttttttataactaaccatgcaacatataaattctaaaataaaattatttgagatcatgccgttttgaattggtgagaaaatattgcgtcgaaacaatgcatgtggtttctatgagaaaattttgggtattttaactcgctagaaggatatcttacaacccaaaagaaatccaataataacatttttttattggattgtattttaaaattttttatatatattcattctaacagtcctcgaaaaattttgaatttttctattaagtatgggttttaaatccagcaacgtttgtccaattttcaatttatttcatgtccatttatttttcttttggagattttcattctattaatcatccttgaaatgatttgatctttacaatttgggacgaaaatataagtgcatataacctggcatggggtaaaggcatactttctagattttctctcataaaatattaaagtaatggtcatagtgtttttagtgaatatcactaaagtggattgtcttgtaacaaatacacgtttctagattgttctacgtcaagactttacaatggactgtagcaagttttacaaaaaataaaaaaatagacatggtctttaatttctatatggaatgtacttgatttattgctaaggccactgcaaggtaaggttatttctcagtataatgttcaaccaaccacacctttattttcaatctattgtctatattgctagatgaatatttgttatgattagtgacttcatagatcatatgtgtaattcggacgctatgatcatctttcttaataatatttatttttctcctaaaagatcatcttaaaattatcaaggtcaatttgtataggtacgtagccctcatatgcatgttaagagaaatcaattaagttggtagagagtcgttagatgcctaatgggatttaagtaatagatagaggtccatttgtgttttttgtttgcccatataaataactttaattttaattgtcaaggagataaaaaaaaatagagagaaaagaatggtgcgtgctgtacacgggagggagggagggaggtttgggatatttttgtaaatgattaatctgacaacctaagataatgtgttagatttgctaaaaaataatgtgtcagatgtttatgttgaaaccgatggtcgaatgttttgttttctggtcagaaattttataagtttctctgatttaagagaatgatgtaacatcttaagagtgtttataacatatgtgaccgtctattaacaccacatgccgcaaagaaggatggagggatggatgtttggggtgttcttcttttaaacaatagatttaataacctaaaataacgcgtccatctttttttatgtcaaatccgatggttggattatttttttttgcaaaaattctaagatttttctctaatttaagatgtcatatagcagcttagaagcatttataagatgtttaatggattttaatgctgcaaggagatggggatggagggaaaggtttgggtttttcgtattagaaaactaacaaatcaatagacgaatgccttgttcttttttaagattttctagtattttctttaatttaatagcaccacctagcagcgtagaagcgttcataggatgtttagagtgacagagtgagagttgctagatctagcaggtggaggtctatttgtggttttttaatgtaaaaataattttgactttaatttctcatgaagatagctcgttggtgcgtacgtgacggggaagttccggatgtatgtatttaggaaaaggatctaaccttctaaaataaaataacggattcaccgatttaaatgaaaatcgatggtcggagccacttgatgacctaggagcatttgtaaggtatcgcttggtggattaggagtacttacaggatgtttaatggagttttagtatataatattatttttctgaaatttttaagatttttttgatttaataatgtcatatagtagcttagaggtgtttataaaatgtttaacggattttaacactacacgggggtggggagggatggagagaggtctaggattttttattaaaaaatctaacgacctaaatccatcaatttaagtagaaatcgatgatcggttgcttggaattttttaaaattttctagtactttttctaattcaatagcaccacgtagtgatttaaaagcttctgtaagatctttaatgtgacggagggagagctgctagacttagtagttggtctattttgtgatttttgactgtaaaagtaattttgattttagtttctcattaaatagaaaataaaaggaaggaactgaaagggaaactcacgcacgtaagttcggcaatatgatgccaaaaatattaggtacgttggttccagatgttttttttttgcaaaatagatctaaccatccaaaataatgggtccaccaatttaagtgaaactagattgtcggatttctcttatttattagagtgccaattggcgacttgagagcgtttatagggtgccacttggcagtttgggagcgtttgtaggaagttttatggacttttagtatataatagataatgcaaaaaagatgtaataaaaatagtatcgttaacacaaagaaactggtgtgaaaaatatacggggagtaatatcgagcccctaatttgtggggagtaaagttttaataaaatttaaactaacttgtggggagtaaaattttaactaagtttaaatagaggggagtaaaattttaactacgtagatataaaggtctgattttgctatggaattttttactggaattaatactaccggatgtaagtgggaaaaagattaacaaaataattttattagtgagaatggaccaactgcagtaaatattttacttaacacaggctggcgtcgggagtgctgcatgcggaacgaataagtcgggaggaggtgggaggaaaaaaaaaagaaaagaatagcggtactaagggagttaaaaccgggaaaagcggaggcaggagggggaggggggcgagtgttactcgagatgtcgactagagggggtgaatatgcgatttaaaactaaatgacacctaatcaaaactaacttaagttgctagggttggtgagggtgaactctaactaagcaactaagttatattttgcaaacctagggtgatagtggctcaattatatctctaggaaagtaaatcacactcctatgtcaatgtttagcaatcctagggtgatatgatctcaagtatgtctctaaaaatgtaaattgcacaaatgtaaatgcgacaatcaaatgagacaaggagacaagagatttttcaccgaggttcggaaactcgctggtttcctactccctgttgaggcgagcccaactccaccgctcaaccacaaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccaggcctcctccacaatcttctcggagaggtcaccgggcaactcctccacaagccgtctaggaggcggcaacctccaagagtaacaagcaatgacccggcgtgcagatgatcaatcaagtgccacactagctcttcaaatggaagcaatgcacttgactcttggctaattaaccctctaacacattagatggatggacacaaagctcaagtgggtgtgagagaggtgcaaggggtgtatgcaattgaattgggtgccaagagagcccccttgctgctggagggggagtatttatactcccaccaaccaaaactagccgttgggggcgaaatcccccaactttgtgctctgtcggtttgaccggagatatgtggccagtcagaccgtgctactctgcaacgcctagaaaactagccgttgtagtgctgtcagagggccccatcggcccggccggtcaaaccagcgttgagtgggcggtcagac

SEQ ID NO: 57766 - DNA, 6118 bp, Oryza sativa
cggagatatcagaccctattcgatacgtcaatgacccagtcttgtccgagtaggattcttcccatccgtagattccgggaaggatttccatagaatatacagaaagtatctgtatgcgcgcgggtataccataccgatatgtaacgtatatcgaaaggtaaagggtatgcctaacccggaaccctgacagaatttccgtgtgttgcgtgaaagcggcggcttggtttatatagagataggtcgcctgatcagggcactcgcgtaaaccgaacccgataagtcgcgcataacctatccggacctcacgccattttcacacaccggatttttgcactcgtgtaaaccggcggctcagttatatagagataggtcgcctgatcagggcactcgcgtaaaccgaaccggataagtcgcgcctaacctatccggactccacaccgttttcacgcaccggatttttgcactcgtgtaaaccgaaccggataagtcgcgcgtaacctatacggactccacgccgttttcacgcaccggattttttggaaatagaaacaaaacaaattcgaattaggcgggcattttttggaaaaagaaacaaagcgcgtaaacctatccggactccacgcaccggatttttttgaaacagaaacaaaacaaatccattcgaattaggcgggcattttttggaaaaagaaacaaagcgcgtaaacctatccggactccacgcaccggatttttttgaaacagaaacaaaacaaatccaaatttcgaattaggcgggcattttttggaaaaagaaacaaagcgcgtaaacctatccggactccacgcaccggatttttttgaaacagaaacaaaacaaatccaaatttcccgcagaccattcgacgtgtacgtcgtgcacgcgggccacctgcccaggctaggcgagcgagcgtgcgcgcgtttttcccctcttctctccaccacacatgcttcaagtggctaggagggcatcctcccttttaagaaggtccccctctcctagaataagcaaggtggtactaaactccacatgcatgccatcccatgaggtgggcctttgtgattttctaaagaattaattttcggatgagccttagcccatctattaattccaacactattttgttcgtggtaaatacgagcctacacaccatatcaaaaagtgtcaaataaccagatttttttttacaatttggttatttctaaaaacttattttacaatggcccctttctaaactttactatgaaagtggacccatagctcgcgcctaaggctattggcactgaagttaaatgtctcaataccaatacccaacccttatgccagttggtttggcactgagcatccatatctcatagtatttttcttctctcctcccatcccttttcaaaattttttgattttctgctaaattttagaaatatcatgattcatttccgctaatttatttcaatttataagaaacctaatttgaaatgagggtatggacgctcccgtccaccaacctctaaatcctattggttttccaaggaaattttgacaaattaaaatatcaagattcattttccataatttgttatttataggaaacttaatctaagatgagagttcctttctcctttgcccaacctatatgttgattttttgtgtaaaataaagtgggaaaattgacaatgtagaatttttttaatttatttctagaatttcagtaagtagtttttttttgaaaaacaaaatggtgattcactgtagtaatacttgtgataaagagataatttatcgtcatactatcatgatggaaaaaaaattaaaaatgactacatggaatctatttaaatttttctggaggtcttagttagaacgtgtactgtggtaaattttatttaccaaggcaagagagtcaccgatggcttagcatgaacaattactccctccgtctcacgatataatgaattttaagtttttgcttgtactgtttgatcacttgtcttattcaaaaaatttgtgcaaatataaaaaacgaaaagttgtgcttaaattactttaaataataaagtaagtaaaaaaataaataataatttcaaatttttttgaataagacgagtggttaaactgtgcaagcaaaaacttaaaatctcttatattattggtccgggggagtagttttttttttacaaacgtctcgagagggaggaaggagctagggtgatatattataaaagcatgtaagtagtgtaactcgtcctttagcggtacttcgtaatacgtacttgtactttcatttttgttaccataatcaaacctcctgttttgtactcattaattttagttgtaccaatgtacatttaattctttgtgaaaaacagaacacatctgattatgaaagactcttgtgtcttggtgctccatatagacgccattaaaaccaacacccaagaattgcgtatatatacgagtacatagagcctctcacttcccaacacagctgcagaagcatcgtcgtacaccacacacaaaaaatggcagatcttcacacctatctgtaccttggcctggcgctcgtttccctgctcgccgtgcaactcgccaggcgtaggcgctcgtcggcggcgcatggctctggcgcgctgcggctgccgccggggccatggcagctaccggtcataggcagcctgcaccacctcgtcggcaagctcccgcaccaagcgatgcgcgacctggcgcgtcgccacgggccggtcatgatgctccgcctgggcgaggtgcccacgctggtggtgtcgtcgccgaaagcggcgcgcgaggtgaccaagacccacgacgtgtcgttcgcgacgcggccgctgagctccaccacgcgcgtgttcagcaacggcggcagggacatcgtgttcgccccgtacggggactactggcgccagctccggaagatcaccgtgacggagctcctcagcgcgcgccgcgtcgcctccttccgcgccatccgcgaggaggaggtcgccgccatgctgcgcgccgtgggcggctacgcggcggccgggtgcgccgtcgagatacgaccgctgttggcggcgctcgtgtccgactccaccgtgcgcgccgtgatgggcgaccggttcccccaccgcgacgtgttcctccgcgagctcgaccgctccatcgagctcacggccgggttcaacccggcggacttgtggccatcgtcgcgcctcgccggctgtctcaccggcaccatacgccaggccaagaaatgctgggacacgatgtccagcgtcctcgaaagcaccatccaggagcacctccagaagaatgccagcagcggcggcggcgctggagccaccgacgaggacctcatcgatgttttgctaaggatacagaaggagggtgggctccagttcccgtttgacatggacgtcatcaagtctgtcatccatgtaagtgactacgccccccacgagttatcttagggcactgtttagcatagctccagcttcatctctcctgaagttggagcgcagccaaatagtttcagctccatcttaaaataggagcacagctaggtagagtgttcttaactcgataggtggagctggatttaaactgttccacaactccactttatacctaactcctacattaaatggaaaaattgaagctctatcagagcaagttcaatagtataactaactactaactccaattcatctatagccaatctaatagctaattcatacaatagttacatactacactattaatacctggtcccacatgtcatacgcacactgtatcttgggatccgtgctacagctggctataaatctgtagctcactgcctttctctcttcttatttatcttcataaaatatgtttgcagtacctgctcttaaacagacccttagatcattttccgtgtcatgttccaactgtcaacttgtcctccagcttgacactatggcatctggtcacatatggtttttaaccagaaagcagtacatagctttttagctggtaagcacggtcatcgctttgcttacgtcactacttcacaaaagtaaattgtgtcggatgggaaagccatatagctgccggatttttcactcggcatctaacagacgcactaatgaggagcgctatcgatagaccggcacctataaattgtacgatttgcgaaaagaaaagactcagctcaagtgagttgaaccgatgctccaaatccaacaaaaaaaatgaattgaaaggcacaataacacaagaatgctcataatagaatcaaacaagcattcatcatccaacatcccagaacaagcactagagcactagaacgggcgccgccgctcacccttgttgacgtcgaaggaaggagaagacagatgctgctcggggaccagcgcgggggccaaatccgatggaccccgaactcaggcctgctggacttggcatcggttccaccgccgtcaccgttgccactcgcgagggagaggatgtcgtcgtttctctcgagggagagggtgttgctgccgctcgcaaaggagaggatgttgccactactcgcgagggagagggtgccaccagtgctcgctggtggcgaggggaaaatgagagaacagtgggttagaggactcagcgtgaatggataagaatgagaggctcaacttagcttggtttttacggatacctgtgttttaattagccagcaactataatacattataggtgctggttcttttaaaaaatcaatatcaatagtattgctgctagtttttctctaaaaccagtacttatagttgttcaaaggtatcggttgtatacttttttggcccatggaggtgggaaatggtaataagtaccggttccaattgaatcggctactatgagccgagccctattagaagaagttctatagtagtgtgtataagctgttactgcttagaccaacaaaagataattatgataaaacttttatacatgagtttgttagtaaattaaaatcaaatattgaaagttaaactttaattaaaaaaaccacaaagagtgaaatgtaactcatatcaaatttcggctatagcttataagctgaaggttaaacgatgggagtgtacagagtgaagacatgatgaacatcataagaacactacaaaaccttagaggtgggccagttggctctcttcgtgttcattgctgcgtcttcaaggtagaatggagtggacatcctctcggtttgtgcatatcgtatataaagtcacaaacttttttcttaaaaaaaataaaagatagatctatggtacatcaccccacaaacatgctaaaaaaatatatttatataggtgtcaaatttaaacttacatgtttattaagtgatataccacatacgttaaatttgaacttacatatttgtgggctgatatacaatatattgttctatcttatcaaatttgtaattaactttttagataacactgcaccgttttttaatagatgatgttaacttttgatatgacatatgtccatttgtcttattttcaaaagaaaaatattaatattatttattttgttctaacttattttattattatataaatttaagtagggcttgtatctaactgttattctaaatgttattttaaaatttaatcacatcatctatttgaagaaaacgaagaacgaaggtagtatatatataaaaacatcacctgtagaaactaatagagacctcccccagtccccctcttccggaaattcctactatctgatctcattcctctgcttcttttcagcgcttctccctcatctatgcctctaattgtctgatttttttgtatcttgtatctcgggtttattagagtgagcctacggtacgaatttgatcgccattgaaagccatgaagtccaatctgttcgttctttcgtgatggtcagctacgcagcttcaataaaaatatgggaaagtaaaatcatccatcgaggagatatcccctcgtttcgtgcatatcacctaaatagtcataaaaaatatgaaaaaaattgacaacatagattattatgaaatatatcactccacaaacatgcaagtttaaattcaacttctacaagttg

SEQ ID NO: 57767 - DNA, 631 bp, Oryza sativa
gggcgaattcgagctcggtacccttaattacaaaagatttgtaaaaatgatgattttagcttaaaaattcaaattgaatagaaacattgatgagattacagtctctcctatgcaacttgtaaaatcatttgcagttgatgatctaaatgaacctgccgtttcgcaaaccaagtatgcagcaggagttagtggctactgaatactgagagggcaaaacaatactgccaagttggaagtggtataatttcctgattggattgcattttgggacccacagcctgatactgctgctggataccatcaagctgttgaaacctcagaccatggtaaacaagctttaaaacccccggctgtctctccccacctttggcccttctttcaactgatactttctagttttaagaataccatgaagttgatggtattgatacagataccaccatgaagtgaagttgatgaaaagtggtgcaccacaataaggtactttagcttccctttcttctggatcaagttcagatatactcttaccttcttcctttcaagccttgcttgcttctgctgctgaaccagatatattgacaagatcagaaccacaatttgattttagttcctgatgtagaagagggcaaga

SEQ ID NO: 57768 - DNA, 3637 bp, Oryza sativa
tcagaccggcctcggcttgttcagaccgccatcggctcggtctgaccgaatacggctccgtcggctctatatcggccaccccgagcagcaccatcccggcctctaggaggccgggctgaccgcgcaagtgccgccggtcagaccggccgcccctggtcaggccgaacccagtgaattgcaaggtgatttttgtgtgtgtgatgaaaatgtgagcacaagtgaaaatgcaatgaactaatgtggcaatttaatcatctctttgctaggtcattaccccccttgatagtacggcgaaactaacaaataaactagcaaatttgagcgccctacacctcgatcaattctaaattaaagcactagttttaccgtcttctttctctttgctttgcgccgtcaattttaatccatcgataatcatccatgcgcacatatgacttggtcctaacttaaaatatatagctcaaagacaatagttagtccacaattagtgcttgtcattaattaccaaaattaacaacgggggcctagatgcttcaatctccccctttttggtaattgatgacaaacaccacaaatatatatataatcaaacatagaatacatggacatatattgcaatgtaaatcaaaagctccctctaaacatgtgcatatcaatcatagacaacaaatatggagccaatgcacatttcaatttcacatttcaacaagcacaaacacattagcaatatttcaatgtgaacttcaagaaatattcatccatgagcataacatggtcacatatatatcaatatcacatacaccattcatcattgcataagttcacatcacttaaccatttaactcacaaaagtcacaaatcatcctaaaagggctcacaaataaacataggctattacaagaccacgaagggtccaaatgacatagagtttaacaaaacgacaaataacacacaatataaagtaatagcccatacccatacaaaatatagcccaaaccaccttaacctattagatatgagggcactatcctcactactactagtcctaacccacaaaacataaagcacacttttctcccccttttggtatcaagcaccaaaaaggtctttactcttgtggaggagaaggaggacgcgccgaagtggaaggatgagtagcatcacgacgacgatcatacacaaatgcttgggagctcttcaacatttggactcgagaatccaatgcacccactctagtgtgcaatctccccatggaagcattcaagtctccaacatccgtgcgcaagccacgaacatcctcatgcaaagcttcatgcccggtagacaagcgttgaatgctttcacttaggggattaatagccccaagtaccgggttgaagtactcgttgggttgcattccaaaataagcatactgtggatggaagaaagcatttggatcatacccaggaggaggaggaggtgctgagcttgagctagctccaggatgagaggagggcgccaccctaggagcacggggagctccaagctgaaggcggggcttgtactgcttgtgcttcttcaaagcttgtcttgaatcaacctcatgatgtaaggggcataatagattccctgagtgaaggtcctcttggagatggcaatctcttgcatcatgagagacacaatgtcgaactgacggccctaaataattccatcgatgacgtgccaagccaccccccctaatgtcatcattgttgccaaggcgacggaggatggtagctctcacaatcctgttaaccacactggggatagtcctcaagctggcaaccttcccatatgtgtaccgcactccatcttcataaaactgagagagatagtctatgaagagcggattgtgggtgtgctcctcatattgaggagccatcggaattgccacctagagatagaacactggagggtgtcggacatccacttcatctcactatagtctccagcgacccacactgtagcataaaactgccggatcaaatcttcattgtagtcttgcttgagagtcacaattcggtcaatgccaacagtcttgaagagatcctgcaagccctcaaactctggagtctcattgatgtctctccaagaaatccacttatactctgcaaaagctttccctgcataaacttgctcatacacactcttctggaaagcaatgtgaaaacggggatccggggtgtcccgaggcctcaaaaactgatcatggtgcctcaagatggtatattgcgatggattactcatgttcacaacaaactggatggagggatcaatgtgcatatcatcacttccttcatcctcatcctctccacttccactgacatcatctccactttcctcctcactagccccctcaacattggcctcaacctcttcatcactttgagcgtactcatctccgcttgactcctcactcacgggatcggccgtgggctcacgacgaccatgatgagtgcggggaggcatcactgaaaaaaaaggagcaaaggatatatgagcaatgattttagggaccacatagtgaagtgagaggaaagggggttgctacctgtcaggggcggtcagaccaagggccaaggccggtcagaccgccggcctcaagtcggttagactgacgacccatggccggtcagaccgccggcctcaattcggtcagaccgacactttggggccggtcagaccgccactgacaggagcacacccaaatccttccacaatccacacaaatgattctaaaaattgctaggacaatgttgcacaagattggaatatgatcatcaaaggggatggcctatttcatcaagattggaacaatgggggaaactacccttaaaccctagagattgaaatagaccgatttgagagcaatgcacaagagggagagagatttaccggttggaggggatgaatcacaccaagaaactaccatctattggtgcaaatcgaagaacacctcgtgcttcacctagggttccatgccatggatcaaaaactcaacaaaaacacaaacaaatccatggaatagagagaggaagcggaggagaatcacttacggtgtaaccggagagaaatccgcggtcaaaccgaggggatttggtggagagaggtggctagggtttgggagaggagagaggaggagtttttccaatttgggaaaaaaaatgcttgattggaaaaatttggaacggttaggaaaaaaaggaaaagaaaaagggccaaatttcctggccccacttgccggccgggaaaatgtcccttatggggccgtaaaaacccccacacctggccggacaaaccgtccatatagcgccggtcaaaccgccagcccccctgccggttgtgcacagcctttgcacaaccgggcaccccccacacaataaattctaataaaaaaagatttttggagcaatttttgaaatgtgtgagtttcagtattgctaaccacccaaatatttggagattatgatgatttgcaacaaaactcacttaagtgataggaggtgaccttttatggtctataggggtgtcggtgacatggggccgggggtatcgtgactagaggcttgggtagccgcggtcacccacgtggcctgaccccctcggggggggggggggg

SEQ ID NO: 57769 - DNA, 1921 bp, Oryza sativa
cagtaagaaagtatgggtatagcaaccaatgaatataaaacattaaaaatacttggactgccttaattgaaaaggtcaaacaaccaaagtttcatacaaggacattcacacattgtccttaattagcaacttgaggggatacctccctgaaaaagaaagatgattttagcagcttattatggggttgtggtattaaaaaatttgaacaattattggtatcttgtgccactctgagacaagataaatgttggtcatcagttcatcaccacatgcaactgttcacaaataaacgaaggcccatacaaggtatattattgagatagtgttagcaagtctttatataaccgaacactttagactcatcatcggaccggacagaaaattaggggcctgaagtgttcgggtatactgcgccagaccaacttttacttgctcctgtggtccatgtcccaacacttagcattatttttcccaaccttgcctcctatttgcacgaatctcaaagcaaatccaacgatccaaaatttgaatgttttgccctcaagaaaacttccaacagatgaataacgatctattcgtgtataatacgactagttggatagctcgtgtatctgtatgggtcggtttatttaaaagtttaaagtctagcagtaaacttctttgaaaaggagattaaaataaaaaataaacttgtctttttctaaaagaaaaggaaaatctaggaatatgaagagaatagagataggaagagaatagagataggacattgagcatcaccaagagttttcatatcattccctatgagagaatttgagaatacttttttttaaaaaccaatttcaatagacttcctacctgcactcccaaccgatcaaactcccaaatccggatgattcgttttccacttcttatagggaagagattttgctcccaatccaccacacaccgcttttctgtgagtgcttggtgaaatattcccgtgcggctcatcttcggtaacatcggcgtggcggcgcacggccaccgcggcgagtcgggagccaagctcttggacgtgcaagcagagggtttttctcgtgaaggagatcgtcacactgctcccagtcgagaggggcatcgccacgacaaggttcatgcgtgcttggacttcgccgcaccgacatgatcctgcacgctggtgtggcgtggcgtggcgcgtgctgagacgacgcttgaggacctcctgatccccaacatcgatcggcaactttgtggagatgctcaacaacgtggactgcatacatggagcagatgctggagcagttcatcgatcgacgccgaacatgttggtgactgttcgccgcctcgccggacgccggagataaacgtcgacgaagcccagctggtcgacgcatgcatcaagcgagctcatgcagttagaacagtggccaagctcatcgacggatacctctcaacctctaggttctaaaccatctttggtcggtctggcaaaatcaacaatagtcccggttccaaaaagaaacagaacaaaaggttgcttttagtcctggttataaaaattttgatctttagtcccggttggtacaccaaccgggaagtaaagatggttcatagcctgtcagaggcatatcagggggtcgaggatctttaggccttgtttgtttcagcttaagattactgtaatctatattattgagacaaattactataagctgaattataataagccgacatagaataagttgttagctttttgtttctctggatcattagctggttgttaggtgttagcaacccaataatctaaaaaaagcacaattagagtggattactagattatagtaatttggcttatagattgtaataatctatcataataagctatatgtttatttcaatttactcctaataatccagatta

SEQ ID NO: 57770 - DNA, 620 bp, Oryza sativa
aaacaacaggaatcttggtgaattttacatgttcaaatagcacaacaacgctcttggttctacaacgatgcaactgctaggcaaaatatttggatttaatacacgtaaggaaagatcctccaaggcacaagcttgcaatattctacccagatctccttgtacttctctgagcaccttgcttcgtcccttcgttccctccatatcagcaaaatgaacaggtatgttgggtagaagtatgggatcaccgaactgcaccaaaagggtttatgatttagggtttatgagaatcaaattgaataagagagttgtgtcgaacgatcatcatcacctggttccacagggtaagctaaatgaaagagctagcagtatatccccaagataattgcagtgccttgcaattcccctgtattggatgaaaaggggattcattatttcacattgtaaagagtacttaagaagcatgattaatctaaagcgagaaagggacgtgaaaagttcaaatagccgaacataattattcaagcttttatagaactacaaaattgttgattaatatcgatataggtacgccgtacactacccaaacttggtgcagctgtgataaacatcatttagataca

SEQ ID NO: 57771 - DNA, 1433 bp, Oryza sativa
ggtggccggtggcgtcgccgggggagaggagccacggcaggaaggtggggggatggggcgggagcgtgcggcgccatgacttgcagacggcgtggaagcgggcgaagtcggcggtggcgtggaggcggcgcgagatgtcggcgaggagatcgaacgggaggtccgcccatgggggcaccaccaccaccacgtgctcttcttcttcacttgccttcgtcaaaccggccgatgcgcggcggcgcgcgcgccgtgcgctggtccgtttctttggttcgtcgggcatcgtcgccgatcgtcgagtagctaggttcgatgtggagtaggacaagtactccgtatttgttagggcgaatggacttggcccgtgggccttctccgaatttatttggtaggcccattacatttggtttgttttaaacaagatatatactagataaatttacagtttaattttggcaaagacggtaagtcttgtaccagttttacaacccaaccagttgttagaaattactccacttttgtttaaagatgaacttattgacagcttaactataatcccaactgcatgattttacaattgcaccgccgcatctaacaccctcgtgagtttttgcacaagcattaacaattttcccgaacatctacacaaattaaaaaaaatgaaatctccttctcacgttttttttttcctttcaaaatgtcgtgtatttcttcaatctgtatagatatggcacaactatatcagaggttcagatagctccatctcgttggaggtttgatctgcctctgtcggtggcaatcgcacatagttcagccccaaccattgccatggccagcacatatacctatgcccgttgcgattgctcgagtcccttctgttgtctgattcttcgagctgcctattgatctcttccagtctctctcgcagcctggttgatctcatatccgctagtttcaatgatttctctgcggcatcacgtgccgccattgctgcagccgctgtctcttccttgaacttcagtttgttctctagctccagcattgcctgtttagcttcgtctaattccttgtttagggaagatagctgtgcaacaaagcatagttagaacaaggacaacttatcagctatcggttcttctacaagacagatctcaaaagcctgtagtatgaagagcaaaaaggattcaatgactctatcaagggctccttaagattctgtacccttcacagttcatacagccactgcatagctaatggggaacagctacatctaatgccaacgccaccacagatacctagcaaatttcatccttaggcatctttaatttgttttcttagactcaacaatggaaataaccaacctgaacaaactaaaacccatttggtttttagtataatcaagcaataagaccacaccttaaccaaaaattggg

SEQ ID NO: 57772 - DNA, 15173 bp, Oryza sativa
tccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttctggctgtagactagccctcattgtaaaaagcatgtttcccttcttaggcagctagaggcccatgtggtgacccctgaccagataaaaaggaggcccaggcctaggaggaaaaaaggaaggaggggggttgggactctggggaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctcccgctgacgttcctcagatcgagggcgaagaacctcacttagcgcccccggccgaaccggcaaaggggggcctgcgcggtctcccggtaaggagccccacgctccgtcaaggggtttttgggcgaatttgattttcaaataacttttgaatgatttggtttgtgaaataggtttgaataccaaaaacttttcaaatcttcttctctaccaaatttgttttgaaatttttctcaaattccttctcaatctcattttggccaaaactaagaatctagattcttcaaaaaattgccaaaatggcattttcattcaaaaatcatttttcttgcaatgtgaggcttggaaaacataaagggaacctttttaaacattttccaagagatagttttcaaattatgttggcttggccgttttgaaaatactactagcaccactagttgatttgctcacatataaaacgaagtagagcacatgtaagagtgcaaaactcccccttaatgtgacatgctccattttcgcaatgaagaaccaaatggcaataaatccaaagaataagagcaaataggagcaaatatacaaaatgcaaaaagaagcaaccatggtgcaccatctcaagccacattagagaaatctatgacatttaactcattcctcaatttgcaaaagcgggtttcatcaagaggcttggtaaagatgtcggctagttgatcctcggttcttatgtggctaatgactatgtcactcttggcaacatggtctcttaggaagtggtggcgtatgtcaatatgcttggttctagaatgttggaccgggttattggctatctttatggcactatcattgtcacataggagtggggttttggtgaaggatatgccatagtccaacaatgtttgtttcagccaaagcaattgggcacaacaactacccgccgaaatatattccgcctcggtggtagagagggctacagagttttgtttcttggatgaccatgacacaagggatctaccaagcatttggcaactactggatgtgctctttctatccactttgcaaccggcataatccgaatcggaatagccaacaagcttaaacttagcaccttttgggtaccacaagccaatagtagaggaatgctttaaatatcttagaatccttttcacggccactaagtgacactccttaggagcggcttaaaatcgtgcacacatgcaaacactaaacatgatatccggcctagatgcggtaaggtaaagcaagataccaatcatagaacgataaagctttaaatctaccggtttacctccctcatcaaggtcgagatgcccgttggttgccataggtgtcttgatgggctttgcatcctccaagccaaacctcttgagtagatccttgatgtacttggtttggcttacgaacgtcccatccttgagttgcttgatttgaagtccaagtaagaagctcaattctccgatcatggacatctcaaattccctagacatcatatcaccaaattccttgcaaaatacctcattagtagaaccgaatatgatgtcatcaacataaatttgacacacaaagaaatcatcaccaatgatttttgtgaaaagggtggtgtcaacttttccaattttgaaatcctttgacaaaataaaatctctcaatctttcataccaaaccctaggagcttgttttaaacatggttaggatttttaggatcttcaaaaccggaaggttgttcaacaaagataagttcggcaatttcaccatttaaaaaagcacttttcacatccatttgaaatagttttatatcaaagcatgatgcaaatgcaagaaggatgcgaatagcctcaagtcttgccacgggggcaaaagtttcaacaaaatccaaaccttcaacttgtgtgaaaccttgtgccaccaaccttgccttgtttcttaccaccaacccgttctcatcttgtttgttcctaaagacccactttgtccctatgacattgtggtctctaggtctttcaaccaaagtccacaccttgtttcttgcaaaattgttgagctcttcatgcatagcattcatccaatccggatcacaatgagattcatctacatgttttggctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggatcttgtgccttctcctcttccacttcaacttgagcttgacttggcatagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacccggtataccttgctatttgaggcataacctagaagaaacccttcatcacaccgactttcaaatttggttagtctaacaccatttcggtaaatataacacttgcaaccaaaaactcgaaaataggcaacattaggcttcctcccaacaattagctcataggaagtctttttaaagagacgatgcaaataaaacctattggttgtatggcaagcggtgtttatggcttccgcccaaaaggaatcgaaaacaccatattcatcaagcatagtccttgccatctcaatcaatgtacgatttttcctctccactataccattttgttgaggtgagtaggtagcggaaagtttatgtttaataccaagatcatcacaatagtcctcgatattggtattcttaaagcaaagtgtcccttctcaccacactcaagcacctcaagttggagagagtcttgttgggtcttctatttcttctcctatttgagttagagcccattcatctctctttctccttcccaagagatcattgaaccttctagcaagaagagcaatctcttcctccaagtcctcattgacttcattcactttgcccttgcccttatcttcaacttcggcttggagagcaatgcacttcttggaaggtgaggcttcatccatctccttcttcttcaacttgtacatgtcattggtgttgatcttccccaagaggcttgcgggtttcatccttgacatgtcggagttgatgagcatggtgacaagtgtctcatacttctccggtagagccctaagcatcttttgggcaatctcaagatcggtgtagtttaccccaagccccttgagatcattcacaatgacattgagcctcccatacatgtcattcacactctcatgaggcaacatggagaatgtctcatattggatcttgaggaaatgaagcttggcatccttgtactcgcttgtgccctcatggatctcggccaacttgttccaaatctcatatgcggtctcaaggttgctcactctatcgaactcctcttggctcaaagagttgaacaaagcattcatggcttgggcatagagttggaggttgcggtgatcaatctccgtcaagggcgtgccggtgatagtaaagcctatatccacaatactccaaatatggaagctcatagctttgaggtgagtagacattttaattttccaagtggagtagtttgtgccattgaacatgggagccttccctacatggttcaccttgttcgacatcttctctctaggcggtgaagcccaatcaagagagaccaagctctgataccacttgtaggatcgagatgtcgactagaggggggtgaataggcgatttaaaactaaatgacacctaatcaaaactaacctaagttgctaggcttggtgagggtgaactctaactaagcaactaaattatgttttgcaaacctagggtgatagtggctcaattatatctctaggaaagtaaatcacactcctatgtcaatgtttagcaatcctagggtgatatgatctcaagtatgtctctagaaatgtaaattgcacaaatgtaaatgcgacaatcaaatgagacaagaagataagagatttttcaccgaggttcggaaactcgccggtttcctactccccgttgaggcgagcccaactccaccgctcaaccacgaagccaccgcacgcccccttcgtcaaggggtgggcaaggcgagagccggcccacagagaggactacccaagcctcgatcactagcgtagttcttccttcactccgaaggtggtgaactccaaaccactcacaaaccggcgccgggcctcttccataatcttctcggagaggtcactgggcaactcctccacaagccgtctaggaggcggcaacctccaagagtaacgagcaatgacccggcatggagatgatcaatcaagtgccacactagctctacaaatggaagcaatgcacttgactcttggctaattaaccctctaacacactagatggatgaacacaaagctcaagtgggtgtgagagatgtgcaaggggtgtatgcaattgaattgggtgccaagagagcccccttgctgctggagggggagtatttatactcccaccaaccaaaactagccgttggaggcgaaatcccccaactttgtgctctgccgatctgatcggaggtatgtggccggtcagaccgtgctactctgcaactgctagaaaactagccgttgtagtgctgtcagagggccttatcggcccggccggtcagaacggcgttgagtgggcagtcagaccggcctcggctcggtctgaccgaatatggctccgtcggctctgtatcggccaccccgagcagcaccatcccggcctccagggggccggtctgaccgcgcatgtgccgccggtcagaccggccttatgcgccggtctgaccggccggtctgatcgcccctggtcaggccgaacctagtgaattgcaaggtgatttttgtgtgtgtgatgaaaatgtgagcacaagtgaaaatgcaatgacctaatgtggcaatttaatcatctctttgctaggtcattaccccccttgatagtacggcgaaactaataaataaattagcaaatttgatcaccctacaccttgatcaattctaaattaaagcactagttttaccgtcttctttctctttgctttgcgccgtcaattttaatccatcgataatcatccatgcgcacatatgacttggtcctaacttaaaatatatagctcaaagataatagttagtccacaattagtgcttgtcattaattaccaaaattaacaacgagggcttagatgcttcagttactcgcattacgaaactcggtggcgcgtacgggcgctacgtagcgtcaccgtatatatatatatatacatatatatacatatatatatacatatatacatacatatatatatatacatatatatatacatatatatatatacatatatatataaaagtagtgttgtagtataacaatagtactagtaagtagtattaggctctgtttctttcagcttgggattattataatccagattattagaagtaagctgaaagaaacagacaacttattgaagtagcttattataatctggagcccagcttattataatctgataagctcatttaggtgagctttttccagattattggatgaaaaattacccaccatgccaccccacctcttctttagacttgcaaacctaataatctaggctctaataatctaggaaagaaacaactaaccgcttattctactgtagattataacaatctatagtaatctgactaaataatctagattataataatcccaagctaaaagaaacagagccttagtagtagtaccattagtatatagagtagtactactaccaccacctagcagcagcagcaatactagtagtactagctgcgcacggggcccactagtagcagcagcagcaggccagcagcgctagtagtagtattagcagcgcttgtaataacagtagtagactagtagtactagtactagtagtaggagagacgaactggtcgcacgcccacacccccgtgtgaccagtcgcgcattaggacccctacatgtaggggccgcattcttaatccataattaaaaaaaagattaaaagatctatgctggacaagtacaaactaaacacacccagttagatgatatggcccagctaggtttttggtcgggctgtgaaaagcctaacaagaaaacgctaaatgagcctaggccgaagataagaaaaacattatcactttccttcttttcgtaatcaaatagtattagtataaaggaaaagttgtaaaccctcctaaatgtcaccctaagtttgagagtcctccctataaaaagatttgttgaaaatccccacctcctaattcaccttaatttgatgggaaaattgcaaaaactatcccatgagtcacttgaagcttgatatttcatcccataagtcattttgttgcaaatgcctacctcatactcggttttgatgagacaaccatcctagggcgcacgtgcttaaccgaatcagtctattatcgttgatgtatagccatcacaggataagctagctaagtcaatataatcttgtccaagttcttatattatacttatttttcatgtttcattgaacttttttgtgatatagagaaactcagtacgataatgtttaagctctcattagaaattatcttcaaagaagtgttaaggccattctctatatgtatttaattttgttattttggtaaggaccacactgataccttataatttatgagaacatgttaatatggttaagcatgtgcgcacaagagtgatttgtgcaataaaactaattaggtgggtgggtatttgcaacaaaatgacttatgaggtgaaatgtcaaattttaagtgacttatgggatggttttgcaaatttccctagtataatacattgtatggctatttggagcaatttcattcacagacgcatgttttcagcccgccaaggcccacgacatgtgtcttcctgcgctaatttgggaatcccgccgcgggacgttccatcggcagctcacagattttccttgtggttttttcttcgctagcattggtcctaagtgtcaatcgttttttcttttaaaagtaaactttcagtgggatcacctatatatttgtcactaaattttttaaaaaaaaatatttgtcaataaattttttaaaaaaaaattgacagatgtaattatagtataattgtaatgtaattacgctgtaacttacatgtaacttgtatataactttcaaaaatctctccgtaacatgctatttctgtgaaatgaaggtcatgggaatgaagcatctcacatgtgtccgcgctgtagctgttttcttcttcacttgcacaaaacttgaaacagatctaacgaataaaaattatttaaaagttacatacaaagttacattgtaggcaagttacagcataattacactatgattgtatgtactttagttacatctgccaaatttttagcagaaaatttattgacaaatatataacgagtcaaaatttcataattttgaactaaaaattaaaaaaacaatcaaattctagaacttccaaattaatttcaaaactttcagctcaatttcaaagctgtcaatttaatttttaaaacttttaactcaaatttaaagctttcaaccaaaaattaaaaaaaaatctaaaatttaaaactttcaactcaaaataaaagatgagtaaattgcattcaaagtatcataacttggcatgtggttgcaaattaatacaagaatttgagaattggacgtctaaggataacaatttgataagtgggtacgtcctagtagaataaaccgtcaacctagtattttgatgcagcagcttagcttagtatgtaccgttttggtcaatgagtggcatggtgagaggaaggccaacccaatcttggatagcaacttgtgcccaacttgttcaagcgaatacgcactccaccaagatatggtgatccgcttccagctcctacgcatttacacatagggcacatggtatgactatccatcttgcagatgcgtatttggttagtcgtctaacacaaccgttgaagtgtaagccagaggaaaagtttgcccttcacgggaccaatgctgcgtcaaagtaactcagagcaagaaaagaagatcgagcccttaaagaacgcattgtagttcaaggcggcgctatacctaccacccatccagcgccaaatgaaatcatcttggacaaactcttgtagtgagaaattctatactctatcccagagtgtgaggaatagggagagtacatgcacagtcagtgcaccaatgatgttagatatccaagtactgctagccaggccaacaaccaccgaagtggaatttcggtgacgagttgggacaacaaggaacaactatagggcgattagttgaaccgatcgcccatcgagccagttgtccaactagaacaatgagcggcatccatctccaatgacgaccatggcagacacacgtagcatctccgacatacactactcttacggtagtttgaagccggcctagtaggggtcgctaatgtgttggagctagggccatcgcatccgtagggtccagccaatgatccagaggtctgtgattcctaacacccccccctccccagctctttgggccgacacacgttgggccaagcgacaaggcaactcccgccatggaccgagtctgactccttccaaaggaaggttggccactatttgtcaacgactttcaagacccaatctagcaacccaatggcaagggagatgtgtgccggggtggaggggacggattgcaccaaggttagccttcccgacatagccaagagcctccccttccaggcaggcaactgattatgtactgagtccacaagttgttgtaggctactcttcagaggctgcgtgacagagagggggggatacctaggtatttgcatgggagctccgtgaccacacatagcatgatgtgagagagtactgccatatcatcctctgatcacctgattggagtgatggagcacttgtcgaggttagtaagcagcctcggaactaccccaaagcaggagagaatctccttgatcacctccaaatcctgggccatcggtgaaaggaagagggcgaggtcatcgcatagaacgaagctctgtgtttgacagcactcacgtcaagcggaagatgccgagctcactagtcctaccaatgagggcattgacccttcatgaccaagatgaacaacattgttggttgattttattgtctaatgccggttagttaggacaagaataaaatcccaccgtttttcctatcctaactagaaaccaaagaagagataaaatatattttgtgtgatcggtacaaaatagattcgaattttaattgaagataagcccccgagccccacaagtgtcactatatatgagaaaaaggagaagaggcagatgctatgccgaactctctttctaaccctaaaactctaagaaaatcgctcgatcaatttaggcactggaaggggttcatgaggtatctcacaatagaagaaatggagaagagaagaaggaaaagcgaaaaccaaatatcagctttgatggcttcatctcaggtcagttagatcaattccacattgttgtcgaacgacaactgcgtcacgtcgaaagacatggttctctcaacaatggttggaaacgataacaattgtattgcttagtaaaaaatttcagggatcccatgttacatggccctatggggctatttatagccctattacggactcctttagggtttaggttttacaagagaatttgcatggttacccttataatagggacattattgggggtatattgcgtcctttacttgcatgggcccctaatgggctgggtgactcggcccagttattggtgaagcccccagagggcatgatggcccgttgggcccttttcaagtgaggtccggctcttggcgaaacccgtgtccttcgcggcacggcttccaccctgcagtccttgcccgtatagccctccgacaaggtccatccttggcgaagcccacgtgcttcataccacggctttcgccatacggtttccacccatgttgtctcttcatgggatgtagtcacgccttctcagccttcgagcgtgcctccggcctgagtcctcgcctagattcctggtttcggtaggcacggtcgaaggtcctcgtggtatacctccaacacgcataattaagcagaggtgatcatgtttagactaagattcaaattaattaagtggattaaattccaatacaacatcagattgaggggatcgccttagacaggtcagatgtcaaatcaaccatatccatagcaaatatataaagtttagttttacaaactaaaaattgttacagttgaaagcacaagctagtagcaacttgaagaagatttgatcagcttgaagaggaagtcttgatcagcttgaagaagattacaaaggataatccaacaactactccaacaataatcacatgcatgatacaataatacatcatatttcatcgcaacaatcattgaattgaagctagtttcccatggcgttgccctcaaaccggctgatcctgaagtgccggagctccaccccggcctccgccgccgtcctcgcctccccgtccatggccatctcggccaagatcctccccaccgccggccccatcttgaacccgtggccggagaacccggccccgaccaccacgtcgtcgccgaactcgccgccgaggaagtcgatcacgaagtccttgtccggcgtcatggagtacatgcacggctgccggacgaccggcccgccggcggcctcgacgtggtccggcatgaactcctcgatccaccgggcgacgcgggaggccgcgtcgccgccgccgccggcccagtcccggccgtccgggtcgcacggcgggccgccgtcgtagttgatcttgatcaggcccgggagctccagcgacggcgtgccgtacacgtgcgggtcgccgtggctggagaacgtcgggaagccggcctccgccgcgagctcgcgctcgcggccgggcttgaccttccagtacaggacgagcgcgtgcagcggctggatggggaggtccacgccggcgacggacttgaccagcttgctcgtccaggcgcccaccgtcacgacgcacttggcgccgtggaactcctcgccgccgctcgtcctcacgaagactccggcctcaccgtccttcttgacgacgccgacgacctccgcgttgtccctgacgacggcgccccccttgacggcgagcgcctggaacatggccaccgccttggtcgcgttcagcacgccgccgccgagctcgctgacggcagccacccacccgtccgggacgccgcggaacgcgccgccccacctcccggcgaggtcgtcctcgtccacccggcgcgcgccggagttcccgacggcggcgagcagcgaggcatcgccgggcgggcccacggtgagctgcggcgccggggtgagcacgcggtagccggactcggcctcggcgtcggcccagaggcggcgggcgaggcgcaccatgggcgggtagtgcgccttggcgtaggcgtcgcggatggtgcgcgacgcgccgtgcgaggagccgaggtggtggagcaggtcgaagcgctccaggagcagggcgcgcgcgccgcgggacgccgccgcgtgcgccgcgcagctgcccatgatgcccgcgcccaccacgatgacgtcgaagtcgaaccggccgccggcggcggcggcatcatcggacgctgcggctgcggctgcggccatggcgcggtcgaacactactcgatgtgcaggatggagtgagtagccagccacagtgaacatcacatcacaccagcacagtctattatagaggcgagcttgtgactggcgaactagtagtagtaatttgcaacttgtgctcttataaaattgtttcattggaattcactttaattttattttttaaactcgtgccaagtcatcgcagaaaatcgtaaaaattcgaaaacgcaaaggattgggttggtgtagggatgaaaacggtcggaaacggtcggaaaaaccctctaccatttccattttcattttattttctcgaaaatggaatcggaacgtatactcggaaacggtaaggatatcggttatatcggtatctcggaaacggaaccgtcggaacgagaatataccgatatcggacggaagtcgaaaattcatgtcggaaacagcgaactgtggtatcatcccgcatttaactatgtatgaagataaccttataatttcacctttgcatcattatgctgccacacaacaccgttatatgatgattaataagttgacaataagattgacaaataatataaataaagttcaatgatacttcaacatcaatgtggctaaagcatacaatgtggcttacatgataggattatagcataactaatattgtccgactttttttaggatatagatttgaagtcttcgagaacaccaagcttacaagctggcatggcttcagctgatcagctccttgtcaaatatcattcattatttcatcatcaattgacatagctatatcgtcgtcctacagtgccacattgcataagaacttttatgttgacactgtataactaccgttgtaattaagtttcatgctaaactagactttttggtatttccaggtcgatcacagagaggagtcaagatggtggggcccgccggtggatcccacagcctttcttttcctctctttcttttattttctctctctcttatccttcccttctctcggttccttttcctgctctctcgatttcttctctgttttctctcttgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaaggtggccggctgcgacggaggccgtcggggcgaaggaggttgcggccggcgtcggcgacctggtggcggcgcccaacacggcgcggcggtgccccagcgccgatgaagacgacgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaaaagattaccgtttccatttccgataccgacaattaccgataccgattgaaacggtcggtgcaaaccgaaaacggtagccggaattctcggaaatttccgtaccgttttcacccctaggttggtgtaagcaagcatataggcgaaacttcaagcagctttcatatatatggaaaacaaatgaagccggctatttctttaacccgtcggcggctatcagatcaggccatgcaccggttagcgaatactaatggagaatgaaatcttcttcctcccattctaaaattcttaccgttttatataagattattatttgaacttagactatttactctgaagacactagaacataacacgaggtacagattagtcttgaaaggtaatttaataataataaatatttactcaattatagttttttggagaccttgtaattgtccaaaatgctacttcctccgtttcacaatgtaagactttctaacattgcccacattcatatagatgttaataaatctaggtatatatatgtgtctagattcattaacttctaaatgaatatgagcaatgctaaaaagtattacaatctgaaacggggggaataagaattatggaaccttggagtagtgactagtgagttcaaaaaacaaactcccatactttgcatacctgaccatccacaaattgcaagatgttttctcttgtgccaagaaggaaaaaggaaatcggcaagagcaccatgtcagaaggtagtgcgctaccaaggttgttgttataaaaactagccccgaaatcgacatcggtagctaaacgcggaagaaaacgtcataggagatccaaaacgatgacgacaccgagacacgatatttggtaacggagttcagccgtagcctacatctccggggcactgattacgggcgctcctccccgatccagcatatacagcgtatcagagttacaacgactcacagccggtcgacgccggcagccgctccctctcgctatgctaagtcgccatacggttacaacaagcacgcccctctatttatgagagaacctaggatagagtccaactcatactctagtcctaatacctattataactccaagtcctaaactgtaactgactacatacacatattcgacacaaactctaacaaactccaccttggcgaatatgccacgccaacttgaatctg

SEQ ID NO: 57773 - DNA, 1924 bp, Oryza sativa
cggccacggcgaccgcgcgcagcagggcggcgacctcctcctcgcggatggagcggaaggagtggacgcggcgcgcgatgaggagctcggtgacggcgatcttccggacctggcgccagtagtccccgtacggcgcgaagacgaggtcccgtacgccgttggtgagcacgcgcagggtggcgctcagcggccgcatcgcgaacgccgtgtcgtgggtcttcgtcacctcgcgcgccgcgtccctggacgacacgacgagcgtgggcacctcgccgatccggagcagcatgacgggcccgtggcgacgagccaggtcacgcatcgcgcggtgcgggatctgccccacgaggtggtgcaggctacctatgatcggcagcgtccatggccccgccggcagccgtagcccgccgtcgccatgcgctgccggcggcggcgagcgcctgcgcctggcgagcagcacgacgaacagcgacacgagagccaagccgacgtagacgtagccatgagacgcgtcttccatttccctttcctttcgcaaaggatttatgtggcagtgtgggtgtacatatcgagacgacatttatatactacctcattactagtagtactatctaatcttggataaaccaagattatcaagaacaaaaccaagattatcttgtatgcacgaaggcgtccatggcgagagctgttccaagacgattgggttcattacatagattagtatggtatactaagttattgacatgcatgaagcgcgcacgcaagcatatatgcgacataaaaatgcccattgaggaaatcaagttgactttgttaaattaaattaataaggataaaattcagtagggaaaattaaatagggtaaggtttatcgtcttccgttaagaatgaacgaatacacaattcgatgtcggtccctcgacctcaacagcatgctcgtgcacctcatggcaacaattaataacaaccttcccgctgacttatctcaggctaccattagctccttcaaagctactcccccgtctcaaaataacttaatctaaaagaggatatgaccagaccactctaaagacaacgaatctcattccctcttaggttgagtttttttgagacgaagggagtaagtttcagtttccccctagtgaacaaggtatcgacaaggctgacacattggcaaggaaagcttctgaatcaagccggtagatccgcccttgtaaggccctgtttagttcatgaaatgagaatttttggatgccacatcaaatgtttgaccggatgtcaaaagaggtttttggatacgaataaaaaaaactaatttcataactcggctggaaaccgcgagacaaatctttcgaacctaattaagccgtcattagcacatgtggattactgtagcacttatggctaatcatagactaattaggctaaaaagattcgtttcacgatttccatgcaaactatgcactatttttgtttttatctatatttaatgctccatgtgtgtgtcaaaaattcgatgtgacgttgttgagaaaaaattttggaaactaaaccaggcctaaaggtggtgctaatctcgcaacccatctaccatctcacctccatcaggtttccaaagcggtgttagaggcgctagacaagctcaggagaaaattcctttgggctaggggagagaacttatcaggaggaaaatgtgaagtgaattaggaatggctttatcgctcgaaatagcttgggggactcggggtcctcgatctataatgcttcgcaaacatataaatttaaattcaacttatacaggtagaaataaaaataacaaatttaactatgaaaagaacatgtaattcactgccaaatttgtttttttaattatataaatcaaattttaactcgcatatttataaaaagatataccgtatat

SEQ ID NO: 57774 - DNA, 2456 bp, Oryza sativa
ggcagcagcgcggggcattggggctccgccgccggcaaccggaccatgtcacgccatgccgtgcacacggtgtggaagcgggacaagtcgacggcgtcatggagttggccggagatttcccggagcaagtccggcgggaggttgggccagccgcagctggacgagacggcatccatggacgtcgaccagattagatcagatcagatcagcggctagcgagcgatccaatcaactgttcatccattggactgccctgtatgatgtatgtatgcaaaaacgtaattaacgaggacgtactaccctacatgcaacggaaaccaacgtatgatatgatcgtttcctcagataatacagcatagcctgatgaaacctaatacgacacgattagaaaaaacaatgcaaaggtgcaaacaaaacccaaaaggaataattaaggcgggtgaacaagcctgatccaataagcagtttccgcaagagaaacagcacaaatgccacacacaccatgctcttcttttgcttaaatagataaatgttagacaaaacttttggatgcatcgacaaattggggtagaggggcatcataacagtagcctacgtgcatcaactcgtggccacaaccaacagttaacaagaaaggagcagtaaacagcaggcatgagaaaggacttgggaggatacagaaccaagaatcgcaagaaagctactatttgagggactaaaccagtatcagacgtgctatgatgcctccgatgctgttaaacccccacaaagcctgctatcccattaaaagcctcggcgcggtggtcgctcctctgcaacattcactctcagcgcacggccatccaaactctgttgaattcagattggaaaagtgtgttacttgggtaagcaaagttaaaagacacaaaagttattgatggtatgagtcaattagcatcagttcacagcctccatgtaacaatgattaccagtggttgcttaatcccagttgtaaagatgtcagtgaatcgaatatacacttacctgtccatcgagggctgcaatagcgtcgtccaattcttcctgtgtcgccattgttacaaaaccaaatcctcgtgaacgcccagtttctctgtcatacacaactctggcgtcgactactttgccatgctcgctgaacagctgtaccaacctagagtcatccacttgccaagggagattgcccacataaatcctgaaagaaggcccaaactgacggggaggtctttccacccgagcgcctctaggagctgccttgtttacagtcagaagcctcccatcaacatcctatccacattaaaaaggtttatcatcaaagcatgaaatctgtacattctttacatcatactaccatacttttaaaaatttagtagcaacagaagaacaagttttaagaggtctgtcaaagaaagttaaacatagaaatcacagctcttacaactttagaattgttattcctcatagtcatatcagtcaataaggatgacatatgcctaatatgaccctccctttctttttcacttaaacattatagtgtacccttgaatgagaaactaagagaaactatcatgtccatccatgatcattcagaatgaaacgccaataccacaatgccatagttgaaataaggaaaacaaatgcaaactgtttgaagccagttacatgcatactgcaagtacagaaattactgtgtacacaatgaacatgagctgtaactaacataggaaatcaggttatcttgagcttcaacaaaatgaagaaaatgttgaggggaaatagggcaatttagatagagagagactcacgtagcgatggaacatctccacagccttctcagcctcctcaacggtgctcatggtgacaaatccaaatccacgactccgatctgtttctctgttgtagatgacctgaacacgcgaaaatagaggttcatttctgatcaaaagaacaaaaccatgcatatcctaatattttgtctaactgcctctatacggttcacataataaataaatgaataccctaaagacgggaaggtaaatatcaaaggcatctttcataacacaagtaggatgcccacagagataaataagccacagctgcccatcttgcaggttttaaatgtgaaacacaaaaataactgtaatccgcagcctaacagtaaaacagggacagttcttgtaaacactagtatcctaccagcctaccacacagatgagccagctagattaaaaattataataagtttcaacagagcaagtgaccaagcaggtaaatgaaaaataaaagaagtgcatttgcacaggagtccactgaagtactgaactgaagttcagtgggtcattttagttttgcatatgaaagagcgcggagaatggagagggtcacacctcggagacctcgacgatgccggcctgttcgaagagctgggcgaggcgctc

SEQ ID NO: 57775 - DNA, 5939 bp, Oryza sativa
agtccaacatccacgcttctccagacttctcgtcagacactgtgagaatctcatgactgctgctatctgaatcatcaccacgagctgctaaacttgcaatgccacctttcctcttcttcagtaacgggcaattcctccttatatgtccaaactcatgacacttatagcaccgtgcccccttctccttgctcttcgacacccctgtttcatgatcatgcttcgctttgaccagcaaactctcaccctgagaagcctctgttgcctcgtttttctttgatcttctcaagtctcgtgcaagcaacgacgaaattatctcctcagttttgacagtatccttgccgtgcgtcagggtagtcaccacatgttcataagacggtggaagcgagcacagaagaattatggccttgtcttcatcatccaatttcacatctaacttacttagatccacaacaaactgattgaagacatccacatgcttcctaagatctgactcctcttgcatctgcaaaccatacagttgttgtttgagatacaacttactcgtcagcgacttggacatatacaggcttgccaacttgtcccaaatttccttcggtgatttttcatccatgacctggtacatgacggaatctgagagactcaagcgtattgttgcagctacctgcgccttcatctcatcccacttatcagcatccatcatttccggcatcgtctcatcaagaaccttggatatcccctgctgagccaacagatccttcagcctcatctgccagagaacgaaattcccggtgccatcgaacttcaccacctcaaatttggaaaccaccgtcgccgccatcgacgataatcaactcaacagcggttgccctgttaaattgatctgccctgattaattgacccaccgactacagtcactagccggacaaaaccaacccgatcggttttcttttctagtcaaaaagccagtcaacagcggtcaaagaccggctcagatcgagccgatcccctttttccttcggcttccttccctcctctctgcacccgcgtcctccagatgcgtcgccgcctctcgccgccgtatcgcgcctgcaccgccgctgccttgcgccgccggcccagcagggaaacgccgccttacgcactgggagccgccgccgccgaagtcaggcgtcggttcctcgccgggaactatcgcatccgccgccgcaagctcctgcgaaccccgacgaatgccgtgccgagctccacgccgccgcacaccgcctacaaggatgcgcctccagccgcccgtgacctcgccacccaaaccacctccgcctctgtgaaaatcaggtacgaatctcgccctctgctaggtgatttgtttcgattgcgttgttgcaatcccgtggtcctctgttgcttttatctgggaaaaattgagtccgattcctgaacgaatcgaagtcctcgtccgattccctttcgtgttgaaacttggtatccactgtttgtcttcgattgtgtccgtgccatgaccgaaccggagacgactccatgtccgtgtcttccacaccacaaaccctcaagaccgaaccctgcacgacatagctaaaccctagccagctccttctcggcatcgccctgatctccgtcaccggctcggcttcgacgcaggacgcgcacaccgtcacgaccctgacctcctgggcttcttcgtatctctgacaacatctagcaccaacgccaagcaccactgacgactccaccaacaactgttgtcattgatctacagcccgtgtggttttcttcttgtctgctagagggaaaaacaggttgaaccaaagcctctccagggttgaaccgctactggatgccggtctattcgccctaggctttgttcagccatatgccacaaaatacgccgcctttgaaacaattccatcgtgcaaatacctcgtcaacacctccaaacagcctatgggatccacccgctccgacttccgattgatcgccatcgatctagtcgcgagccgaagccgacaagtcgcatgccgtcttctcagccgccgaacgacccgagtgctatgtctagccatctccctgtcgaacgcaactcatcgaaaggcccgggccaccccgcccaaagtgttcgaatccaccgatcgagaacgccgatcgcctccaacttcaatcaacccgagcatgcggccgcacgtctccctgtcgagagtagctcaccggaaagtccgggccacctgcccgaagtgtccgacccgccgattggatcgccaatcgcttccgccaccatcaacccgagcaccacgtctagtcatctccctgttgaaagcagccatcgacggtttcggccgccgccagaagtgttcgatccaccgatcaagactccgttgatcgccgccgtgctccaccttgtgccaatgcccctccctgggcattacagcaggctacgcggtgtggagcacctcggtcgcgcctctaccatagaccttctacaggctctgataccacttgttataaaaccagccccgaaatcgacatcagtagctaaacgcggaagaaaacgccataggaaatccaaaacgatgacgacaccgagacacgatatttggtaacggagttcagccgtagcctacatctccggggcactgattacgggcgctcctccccgatctagcatatacagcgtatcagagttacaacgactcacggccggtcgacgccggcagccgctccctctcgctatgctaagtcgccatgtggttacaacaggcacgcccctctatttatgagagaacctaggatagagtccgtctcatactctagtcctaatacctattataactccaagtcctaaactgtaactgactacgtacacatattcgacacaaactctaacaattgttttggtgcttttgtgggtagattatcagccttaacagcattgtcagcagctcatacaaatttgatcctccattcaaaaaagatttctactctatatcactttgcacttcaatagatcattcatattacattatctatattatacaatcctatattttagtaatatcttacagctacctatccatttgtattactttgtaatatttattttttaacatctatatttccatcattggtacttgatgcagatctccatgcttcacatacatccggtgatagtatgttgtgaagagaaaaaaacataatcgaacagataagtcatcactcccaaaggggaacagataactcatcccccccacccctacacgcacaatgcgccatgtgatgcattcgttgctttgtagctttgggcagcagcgcatgggggtgggggagcagtgttcctcgaacatggtcagcactagcagaaaagccgtcggctgaaggtgtagtagaggagcggcatggttgcgagtggaggtggaggagcagcagaggaggggaggggcgtggaggagcagcagaggggtgacgtggctcggggcggtgaagtggcgcgctttggtgatcagcatagcaccagagggacaatgccgcttctactccggtaacctctctagtgatccgttagctctccgcttctactccgagcctccgccgctagatccagtaggcgtgtctctcctctgtacctccattactccacatctacccctggcacaacgacgtgatccaaatggtggcgcgagttcgatccggagatgaccagttgctagatggcgtgaggagagagaaacgccaaatttgacgtttttgtttccggcatagcggatgcgctaaatttgaaggggatgatggtgtatctattggagccctttttctctctccttgtgcaagtggcatgtgttatatagaggagctgctacagatgttctaagtttcactctttcagtttttcctggtttgtttgcattgttatataggctactactactagctaaatgcctaaatcaaatgatattgtagcaatcttatgttaacatgtggagccacaattcatgtagatcaatataagatgagtaacatgtacatgtgtcctagtatgaatcgaataagcatctagcatctgaactagattacaagtgacaatatgtgtatgtactggagggaaaattaataaagatttgtccattagctcgtaagatgtaatagattatgactcgataaataatttagttaagaaatgcactagaatgtgacaaggttctaccagaataccccaagtcataccgaatacatcatcgcatggtgcatatgtatgcagccactcctaactccaagttcacttttgcatgcttagctcactgcttacgcatgtatcaggagcaaaacaaagtttatcatgcggcacaagcaagtacatgccaaaatacaccattatcaattttaagcataacttgtgcccaatcgaacgccctaacgaacgaatcagtagttcagcagtcaaatagcagcaagtgataccaggaaattcaactgctggcacagcatagatcatacatgcacatacagaattctcgaaaacatgctcacacaactactgattgccccggaacaacaaatcaactatacatacattgatacatcagtaattagtttgaccacacatcagcacaagctgcacaaaagaagcaaggaaattgattcctcagaactgcggtggtatatataggtcatgtagatatttcatattttaccaaaaagtttcaagtttttgcctcaaggatccagcatcctcacatcatgcttcttgcgcctacaacggtgatggctcttctgctccccaaaattattgtcaccaacaatccccatcttattcatatctgctatacaatctgcattgtaaaaattcggcagtaattagagcgtttgttaggtggataccaaaaggtactttgcaaattacatcgcctctctgttgcaggaacaaacaattgtaccaaatccaagacaagggcaaaagacaattccaatgtcaaacataacaaaacatttctataaaataaagaaactgtggctagtatttataagttacaacagtcagatctgacagcttcagaaattgacaggcatggctaacaattactaataacataacttcaaaaggacatcataaaaataaaagcttctgccatcagttcttattgtttcactcatcatgatagcagtgtagcacaaatgacaggggtacaggattacagtagaacagacatttggtcagcacacatgtttcaaacaaggtcaagttaaatttatctagaatttaatcgaaatattaccttcctgaacacattgacatagtcaatgctttaagcaatcatttagttttggacgagacaaatataactaaaatgcatggtggctaaaataaaatttcgtcagaatttcgagcacataatcatttattaagcttattatcaattccattaaatcaatactggatagagcactaaatgaatacgtgtgctttccaccagtcattccattactcaaaacatgcagcaggcaagtgcatttccatcatcttcccatcccacagcccaaaaaaaaggagaaactagaaaatgagtacatccctttgatcagaatccacaggtagaatatacattgatcaagcatccgatatcctagaacatagttatgtaaaaaatcaacaaattgttcaatccaaaccaagaactctagccaacaagctaggatcccaacccatggattttacaaactaagcatattatatctacggaatcatatcaaataaatgcacacagtaacgatgaaaacgatgtcaatctctatacatgaaaaggaaagcgtgagctaaatcagagattgtcccaagaattgggctcagggacgccaatcacctccgatttcctcgccccagaagaacagctgctgccttccgtcctcttcctcctcgtcgatctcatccccgtacc

SEQ ID NO: 57776 - DNA, 20960 bp, Oryza sativa
gtatgtacgaatacaaacttggtatttatacatcttgaaaaaaaaaggaaaaaaaagctgaacagaagagaaaccgaaaaataacaaaccaaacagaaacaaaaaaaccggaggaaaaaaccaaacagaaacgaaaaaaccgatgaaaaaaccaaccgaatataaacgaaaaaaagggagaaaaaaaccgaaaaactcgctcctccctccggcacatcgccgccccctctccgcgcgcgacacgtgtccagtcgcgcgaggaggaaggcgcgcgactgatcgccgaatagcaatctcgcagattaggttcctcggcggtttttagagcggttttggctgacgtggcgcctacgtggctaatttgacttgatattcatctgatgtgacattgacttggcgcttacgtggcaatttgatatagaaaaaaataataaatctcgtggaacccacatatcagtttcatgtaaaaaaattaaaaaaaaatagtgggacccacgtgagcctgacgtgtcagtccaactcattcctcctgttcttcctcctctctccgactctcccctctgttaatctctctctcctctcctctctccaggtgagagaggcagccggacctcggacgccatcaaggacgcagccactccggcggcgacctcggccgtcggcaagcaggcggccacaccggcgacctccgtggccggcaaggaaacgaccacaccggtgacctccgtggggaccgtggccagcaaggcagtggccagtgcgtcggctaggcatacgagagcccaacccacggaggagcatcaccagcaatcctgctagctcttgcctgttcatgttgcctccggccacggtgctagacagttgcatcgccgccgccaagccgaacgttgcagtggtggtttcgtatgctgtcgttaaactttcggaaccgcttgttgtatatagatgaaactgattgatgaccatctcaacaatctcgagacctcgcaggatccaaaacttgaatgttcattacattttcttttaacacagtaatatcataagcaaacacaatcaaaactgctttttttcctcgtgattcatgaaaagaaaccaaggctcggttcttcaatttctgaacttgaagcgatagtgctataggttactaggggctcagcgacggaactcaagcgcagtcgcatggaagacttctctgcggtggtgttcaggttcgtgtggtaaggtgcagtggcgccgttgcccggcatagtggccggaccaccggatggacagaaaagcgccaccatgaagcaccagagcgcggcggcgtccatgcggtcgcacatccaccagagcgcgccccggacgtcggcgggcggggactcaacaacggccgtggacagtgccgcctcgacctcggcaaggcgcgtggggagccggggacggcggccttgcgggcatcgagcgccgcgagggattcggaggtggaggcgttcgcgacgactagggccacctctctcgccgtcccttcctcttccgcccacagccaccgtgtagcgtccgttccgtcgtggcgtctagcgggaaaatttaaattctaaaaaccctaattgcgaaaattgtttctttgcttgtagtcagtctccgtgccaattccagatctcaaatccccaatccatcgtcgaattcaaatcccgaatccaattccttcccaaatcgaattcctccgcaaaagtttaatttgcctccctcgggtttggtgggccgattccctctcggcccatctttctctttctctctctctctctctccccccctctccctccctcgctctgcccgtgcaccgggcgcgcgtgcgcgtgagccgcgccgagccgagcgccctccctcttcgctctcgttgccgcttcccaccaccgccgctcaaatcgccgtgcaccgttgcttcccgcgcgcgcgctgtggtggccgaccgcctagtcgccgccgccgtcagcgcctaccgcgcctgcccgcgcctgccgcccgtgtcgccgttccgctccacaccgcccccgccgtcatcgccgtcatcacgacccggccccgccacctccgcgtaagcttccaagggatggaggcagagcccctcctcccactgccccgtcgtcctctctctccctcctccttttcccaaagtagcaaggggcaagccccccctttcttcccttctttttcccttttctcttgccgccggcgtcatgccctctgccgccattttggccgcaagcgtcggagcgccagctcactccttgaccacccaaggtcgggttccgaaccgacattgccatcctataaagcccaggcgccctcccttccttctcctcttgtttgtcccatcgcctccactccattctcgtcgcctcccgtgttctgttcgccgccgcctttcgttgccacgcatgccggaggagccggcgcgttcgtggatgcggaaggggactccgggagctcgtcttcttcctcttccccggcccgaggccggagagatcactcccgtgccgtcagcctctcgtcacagcgccccgtctcgtctcggtagagctctcctccgttctccctcttcgctcctcttcctccccttagattgtgtggtagcactcgtagtacccttagaagctcgcaggcgccgcacaagaccttcccaccgcccggcgcggcctcgccgccgttgccgctcgccgccgcaaaccgccgctcgtcgccagcttctctcggcgtagctccgcccaatccggtgctaggaatgcaatcccgaggtcgtgtagatgctctagttcgtcgtcgttcccctcttctctcgccgccagtggccgccgccgcaatcctccaccgacgaactccctccggcgaatccgagccgttgactcgtctcccctcgtctcgtacaaccacccggtgtgctcgctttcgcctgtatcgccgtggttcgcccgccgttcgcagccgccgtccgccgtccgttccggccgacgtagtcgtctacctctcgccggcccgcgtggctgccacgaaggcgccacgtcggcgccacctcggccacgaccgggtcaagccgaccccggtcagccgctctcctcggccccgctcgcgcgtgcggtccaccgcgagccgtgagactgcgtgtgggcccgccacatccgcgcccaccgcgagccgcgcgtgcaccgcgcctccccttcccaaaccctagcacgccccgcgtgcacctcgctcacggtgagccgagccgccgacaagcaggtcccacccgggaccacacaaggtggacccggcccaccggctccctctctcctcccctccccgcgagcccccttgggccgcccctcaggccggccggcccaatggcaaggccgagccgtgccaacccctctcgggccgcgctcaagccgcccgcgaagtccgttcctcctccctctttcttttctttttcaaaagggtttaattaaatcctttttcctttagataaaaaatccaataatcttagaaattcaatatcttcccaaccgtaagtccgtttgactccgttcaacttccaaaattcctcaaatctcgagatctatctaatagcacgcttagaggtcaataatagggctttatttttgccgtttgttgagttgtcccgtttcgcgtgtagtttcggagcccgaagacccgcagtgcgaggatttcgaggatcaagctcaaggtctcgagcaaggcaagtcacctttgatcatcttgcacctataatttaaatctaagtatttcttttccgcaaatattgcatgaataggattaacacgagtaattcggccgcggcttgcgagatagcctgtcggcccccatcctaattgctgcaattaccctccttgaattattgaacacttagacctcctttgttgactgttgtgcttcgatgcacgggccttcgggcacgcgcattggaacacctcccctcaaatttaaaacatccaacgatgggtaaaacttggggttttacaaaagacttggaaaacccgacacctgggtcggtgcttgcgaactaaatgaatttccaaaatcgcggaccggagaatgtaccgggagtacggtttcccgctcttgcacttaaggaccgtttccttggaatttcatccgagcataagacaagtgcgaccacatgggtagaatgggacacccctggctgagtaactagctaatcgagggaaccatgatgccaagagacatatggattcaacggggtggtgccggggagaacccccgggtttcctggcacagtatggtctgggacctaatctggtgttggtctgggacccctctcgttggcatatggtgaacctgtgtcggctttcaaaatgccctgtcatgaaagccttaaggtctctagacgtggccgttctgcacgggctggatgatccgggttagtaatgccgtgtgggtaaagtgtaccccctctgcagaggttattaaactgttcgaacagccgtgcccacggtcatgggcggatgtgaggtgattcctagcgtagttttgtttgactactgctttgtgaaattgctgctgtggaatgggttcgatatttggaaaatcggcggctgatgggatcagtcaggcccgtgtggccgtttgaaagttgttggctgggtgccaaccttgaatcaattcaaagactgatatattgcacatactccgaccgggcgtgatgcactgtctcatccgtgtcgtttgagaagcactcacttagtggtttcaaaaaggagtttaaataaaattaattgcaaaaacaacagtctttccttgaagcctgcattaaacacttaaattcccatggcttgctgagtactcctgtactcacccttgctctatataaataacccccccagttgctgaagaagatgatgtggatcccgctgatgagttcttccaggagcaagtcggttacgatgagttttagggtttcggcctagttcccaagtcgcgcctgtgatgattggtctaagtcttggcttccgctttctcttttgtaatgcagttgtgagctcgggatctgtccacagcccaacatgactgtactcctactctgtaataaagagaccactgttgctgtgatattctgtctttctgtgatactagcattgtttcctgggactggtatcgattaacaggttaatttggagcgtcacgggctagttccgttcggggctagttcggggcgtgacacaccggagccgtgcctacgccgccacgcgtcgctccctcctctgtcctctcccgccggccgccgcgcgccgctgcctctccattgtgagagaggagaggggagagagatgaactgatgagtgatgaagagaggggagagaggaggaagaagagggatgagttggactgacatgtagggttcacgtgggcttcgcaatttttttattaatttgtaaatgaaactgacatgtgggtcctatgaggtttatttttttccatatcaaattgccacgtaagcgccacgtcaatgccacatcagatggagaccaagtcaaattaactacgtaggcgccaagtcagccaaaaccgctctaaaaaccactgagggatctaatctgcactggttttgatagttgagggacccgttgcgtctggtttttcggttgagggtcgaaaatcgaattcgttgacaagtatagggacctcagatgaacttattccccacaaatatggtccttacgtagctcgcagtgccatcccggtccatgtaagtatgggccgcccggatctcgcatctcctcttaaccatgggctgtgagcgacgggctgacggctggtgagaagccacgtcagcatttaattcctcatggcccacatgcttacacacgcgctcccccactgacatgtgggaccagggagcccccgccgcattccggcacgtggcgtcgcgatcatttttcacacgtcggacgctagtccacatcaggcccacggcattcttaccggtcccacctgtctgtcaccctgggtaagttgaccccggtaactcatatggcggaaaactgaaaaaaattacagcaaggaagcaaacggttcaacctgaaaatccacaccacttagacaatggcatgtgggtccggaaaactgagtattgttgtgggtcccagatgtcagtgatgttgtagggtcagagggtaggttattgttgggtaggtgtggaattgggctctgcttagaactgccattaataaaaccaggctgcttccctccgctctcttggtgtctcctcctctactccgcttctctccacctcgccgcgacgagagagagagagagggaggggggagagagagagaagtatcgatccatccgcgtttatctccggtaagcgagaccttcgagtacctgttcgagttctagcaatggtttgattcgtgtgctttgcttcgggattggttgttgggagtagtagattgtattcgtggaggaaatgggttttagattaaaactcggagccctgtcgctcccgactccggggttgctaaatttcgagttctttggtcgtctctgcttggatggtatcgttcgtgatggcgtttgcgcgattcggtgccctcgcgttgtttggggggtggattcgaggattcgaatgggcgccttccgcggggttccgcgctccgtccattttcggcgaagcagggatcgaagaatacgatttgcgcgcggattatcccctttttgctcgcgttttgaatttgtgcggcacgttttgaacttcaaacacgtgattttctcaaaaatttaagtttttgttttcgtgtctatagtgcgggcgattttctgtgggcggcggtggtttaaatcattggtttcttttacttatcataggactaaggatttggctatgccccgtttctcgtagcttagtcgaaatatcggatatgttgcatcgaaattgttgatcctctttttttaaaaataaaatcaataagtgatagttcggggaattttactcttttaccgagttagcaaaaaaaaaaaaactttgctttactgtagcaacttagcattgctagatgtctacccgctgctctcatgattttgcacttgctgtacgtctaaatactgtggttttcttctctctttttttttaaaaaaatgatattgaattgtacttgctgtacgtctaaatactgaatctgagttagtatattttgtgtagaaactaaacatactaattgaaatcagcaccagcaaagtgtaaaaagactgttattaccatttgaaatagatttctatgctgttatggattgtgtgggcgaggatactttgttttttttttccaggaataggaatacatgattgtttgcccttattgtatgattatgatgaaccaagtaatgattaaatcttggcatggtttgtctccgaaagatgtttttaggtttctcctatccatttgtgtttacacatttattttttcattacatgaaaacttgtactggtttgttgcttttaagtgtattttatccacaaagaaatgatgatggcacgttcatttgtgttctattttgtattcattttgtttttagaatattattctagactcggtttgctttgtaatgaaaatattcttttgtcaaatatttgcagcgtatgtattatagttcatattgccgcagcattcattaatatgctaacattgatgatgaagaacaattgtaatgatgatgatattgggagtgagttttatgactcctttaatttagataataccatagagaatgtacattcacaaaacaataagttggagctggctaaaactggagagttcaatcaatatgagcaaacaaccggattttctttgccttgtggagatctgcagtatggtgagaaacttaactaacagtttctgaatgccctgtgtgtactatgttattagagaaactccactttaatgcatctataatctgtggctgttatttttcagatgtgtacctaaggactcagatagccgggcaggataataagagtggggaaggtgctgattttatggatgatggaacttttactttgcttaaggtaccagttctgctatttcttcctctcttttttttctcttcatgaaaatgttgtacttctttagtcatatgttaatatgatattgatatatgttgcatttattgattctacatttattatttaataattgctcttgatttatgttcttatttgcattcctttgaacttttattgatttgatggaggctatttcatgtacacaaatcaagtcattcaaaaagaatcagaaaaagtttatttgcttttttcaatcccgttggtaagatcactgccgaagtaagaaatgttcttggataacacatttttatttattgatgtatctgccatgtttttgcccatctatgattatctttggttcctttagtcaagttgcggaacaacatgtgagaatgactacttcctttagtcaagtgcaccatctagttcacttgatgtagtaaattattaataaaatgcttcaatcaagacttagcaaagttatactccctctagtcagcaatatttggtgtcgggagcattaatcttagtattcacaacataaaatattattagtccctccgagggactaactcatttgtagaaaatcatctatgttataatgatatatgcagtatgggattgttgaaaaacatgcatatgcacataccatgtttaccttcaatgagatgaggatgatcatgagatccagttgacaagtgaaaggaaaaaaaaatgcagagtggggtaataccattggtttgccatgcccccatccactgcagtctacactttcttctagccatagctctaggataaagaagatggttacgtgaaatctataaatacatgtaatctagaaaacaggtaaacccagacaggctgcactgttctactggtttggccaaatccaatgatgggacaaaattctaagatggtgattaaatgcacgtctcatgctttgattaacaactgttgatcttactcaaatttagacaaataaaagtttttaacctttgtaatattgcacatgataggtttgcttccaaaaatcatgtagcatttagaattgcagatactgtacatttgtttttttttattttgacaactttattaagtgtactctgtaccaacattccttttggttaacatgaactatgcattcgtctcaaaaaagatatgtacatgttatattatttccgttttcttttgaagttgtaactgcatcactctatcaggataattgtttttctctagattgaaggaattctcgcctctagtgctaactaagtggcatatacttgcaggatttggtaactgaatcaagaacttcgtcaccatattatgagaaggatcatcagttaaattcactaaattatgtcaatcaaggtaaggagttatgagttaccctttcccctgaacaagactacactgacctgcttgcgtatgtagaacacacctatttaaataatctgtttagaaacagaccattaaaatgctccttccaagaatctattttttatgggaatattgatttagttattactgtgttaatatgccactggtttactgcaatcgatgcagctaacataattgaggggttttcattgtcaacaatgatgaccattctggattcctgtatcaggctactacgggcatgctaataaccttgactgcatttaggttttcacttattgccaatgccaaagccttcttgcaaaatgtgaaatttgcatgtggttttgcattcccatccctgtcctcatctgatggttgcttcgccatcctcagccccattaggtagtatgttattggacatgggttagtgcaagaaagattgtggaattgttactccatatatctatcaacttaaacacactattacctatttttatcacttagtattaattgtttatctgccattgcatttaaattccatggtaaggtcaaagtcaaataacttttttctaatggagatacgggttttgggtattgtgtgtttctcagatggacatggcattcctacaacaacaaatcctacctgggacttgactcagagttgcaatccgttgaaccattccctgacagaggattctgttcctttcaatgttggtacttcagctggagtcctgactaatgccacctcaaatgattttattcccattgatgagctagcaatcacgagtgggagatatggagtactaccttccattgagaaaactgaagaaggcagtattgccatcgacgaagctaactcgtttggggcaactgcaaccatgtgctataatagcgttcatttctctcattggattgaccagaatttaactggtccattgcctgatttagctgatcttcctgacatatatccagacagtttcttaccaacacctagaaagaacatcactcttgttcttgatcttgatggtaagtaatgaatgacgacctttacacatgtgtttctttccttgcacttgagattaacgtcatattcgttttctttctgcacagaaactcttatccactcatcagcggttgaccgtgatggtgctgacttttcatttcctatgtaccatggcttaaaagagcacactgtgtacgtgaagaagaggccacatgtcgacaccttccttcagaaggtgtctgagatgtttaaggttgttatcttcacagctagcctaagctcctatgcaaatcggctgcttgatatgttggatcccaagaacatattttttaccaagcgttatttccgggattcatgcctgcctgtagatggtagctatcttaaggatctgactgttattgttgctgatctcgcaaaggttgtgataatcgacaattctccagaggtgagtcgtcgtgataatccatcttaaggtgccttttaattttgtccaatttttatggctatactaatgcttagggttttgaattgcttcagtggatcttggctttgagtttgaaacctgaatttatgagttcgggaagggtcctatatcatctggtgcctgaatatttttctgtcacatgtgctgtaggttttccggctacaggaggaaaatggtatacctatagagagttggaccagcgacccggctgacaaatcattggttgagctgatacccttcctggaagccattgctgttgcagatgacgtccgaccaattatcgcccaaatgttaggccgtccaagatcaattgcttagatgttgcgacaaatatcagaaactgctcatttgcttattttacaaagaattttttccccatagttgaacaggatacctgtgtggtacatcatcgaactagtttcccattgcttcttttaccgagtttgattcccaagattttgtgaattcttttggtgggaatgttaatttttgtacttgcagttctgtacgtagcgtctaccttaaactagcctatgtacaaacaaattcaatcataggagactaaagattatactccctccgttttttaatagatgacgccgttgactttttcttacatgtttgaccattcgtcttatttaaaaattttatgcaaatgtataagatataaatcacacttaaagtactatgagtgataaaacaactcataacaaaataaattataattacgtaaattttttgaataagacgaattgtcaaacatgtacgaaaaaatcaacggcgtcatctattaaaaaacggaggtagtatttcctttccaagttcatcctctgatttatctacatcatatggatgtggataagtggattgatgttgtccaggagtaaattatatcatcctgcttgatctgacaccccttcatcctagtccatgagtcgggcaagctttgaagatgaagaagagggaggttgaagatgatggacctgaaggcggagaaggaggtcatcgctggaaaagctgtggcgccggcggagaagccaacaccgaatccggtggaggtggagatatatccattatacatgtgtcatgtgtattcgacttctgtgctgcctgctcaagctggtatcatctgtgctgcttgataaataaatttgcttatggttagcactggataggaaaactttctgtctatcagtaatatcagtcaggattcatgagttttttggcccattgttgttgttccttccttggtgttaatttgcggttaatggagtaaacaaggatgtatttgtcagtgagaagttagggccttggtagcaatcaattttgcctgtctagtgactggaatttcagctggtattgatgggtagtagccatggttctttctttggtgcagactgcagaggctttaacttagctgacaattcagtaattccatagtaatatttgtcttgtcctacttctgatttctgaagctccgtaatatgtaacaaaaccacattcttttcaaacacaagaaacatgtcgaccaaatttgattacaattcggacataagcatgatatattttacatttgcatggacagaagaagtcaatttgatttgcttttgcatcttagtacaactttattccatgtaacaacttagcacttgacaagtgtagtatctagcatgcttcctttaaaacaaaaaaaattcaaaaacaaaatcacaaaatctgtaaaactcttttttttttctgaagatcctacaaaattattggaatcctgcaaaattactgggctcgcaaggattccaagaaggctgggccgatgaagaagctctcacgggccatggctaaaagcctaaaacccaaaaaaccctcctcctccctcccctatcctctcgctcgctctcctcttctccacgctcccagcgccaaatcccagcagcttccccgcacgccgcgaatggcgcctcccgccactgcctccgcctccgcctcggcaccggtctccctcctcttcctctccctcccgctctccccttcctcgtgtcgcggcctccccgcgccacacacccacctccccccgcgccgcctcgcgctcgcgccggcccgtcttggcgccgcgctgctctccagcctcggcgacgcgcaggaggaggaggagtacgatgacgaggaggaggaagagctagtggtggtgggatacgtgagcggcgcgcacggggttcgcggcgacgtcctcgtgtcgccccgcaccgacttcccccaactccgctttgccacggtacccatccctcgttctccatcatcccgctccccaatttcggagctaatatgtaatcgggcgttgttttttgttcggttgtttgatcatcacgatcatgccacgctgacagccggggaagagatggctgagggcccgtgccgctgggaagcagcaggtaaaggaatttgagcttgttcgaggaagagctcataccgggaagaagagttggatcgtcacctttgatggggtcgattccgtggatgaggtctggttttttactttgattgcattcctatacagtcatttgctcttaatttctaggactcgtagccttaaatcagcttgctatagttgatactagtttagaagtgcattggggtatttgtaggtcgtcggaaacaaactaagttgatgtttcatccatgctgtatttttgctccgcacatgcgcacatacaactttacaacaacaattatcggctgcattgagatatttataggtcgttggaaatgaactgatataatgtttcatctatgctgtacattttgttccatacatacaacatcaattgtcggcttctggcagatcaagtttacacaccatcactgagtataactgcatgattagttcagctcaacctagcgcacacgaattgtatattatggtcggcatgtgtctagatcagaatccttttatgaatagcattcagtatgtaatgtgtaactaatgcttactataagttggcatatatacctagcttctggtgtaattcgtttattactctattttcaggccaggcaaatagttggttcagctatacttgtgaaagttggggatagaccaaaaatggaggaagatgaaatctattcacttgatcttgttggcatgagagttattgtcaaggtacatattttccttttcaagttcgtgatttagttgttggtttaaataacaaaatgaatctacaacgttagcaaaggcatgatcctactatttggtgcctaggcagtaaaactgaaatatagtggtagctggatgacgtgtacatgtaatacattactggctctctggctgtttgtcttcgaccctgcctttggatactcaataaatgtgccatgtccaacagactaataattgtggcattcttttattattgagcgtatgcattcctgaaaataaaactatcttacaaaaacgctgccttatatggggttttttccctaatgctggaactaggaacttttactcttcaattgctctgtccagcttaaataagtttttttcccacctactaaaagtaaacaacactggcaaaatgtgcactggcatggacataagaacacagtattgatgcaatgatgcttgttttctcattgggcagttcttcatccaatttctaataattaattaaagttgttttgataattagttaaagttgctctgttttcatcataggacacgggcaagcttgttggaacagttggtcaggttttcaactttggagctggtgatcttctacaggttatggttggtggcactgaggatactgtttctcagccaaattcagaaaatcaaggttccaccccatctggtgagcatgtgtggattccatttgctgaggatattgtacctgatattgatatggagagtagagaaatgtggattacacctccaaaggggcttcttgagctcaacgcgcgttctgataagagatcaaagaaagaaaggcgtgctatggttaggtctgcatcatccttttcttgcatgttatgttccatgtataaagcattctttcgcacataaaagtaaagaatatgtcaggtctaaagaatttcacgtcattatagaagggggccacccctgtttcagaaaataaaaggttctaaaaaactcaaacgtttatttcagcagctgcacagcttttgcaaatattgaatgcacatgtcacattttttttaatgaatagatgcagtaaacacattgaactctcttgcttgtggtgctaaccaagaacgatgcaatcatatgaaccacctgatattttgcaaataaagcgtgaccagatgtgaaatatcacaggaatggaaggaaaagaagaggttacagcgtcgtgtaattgcagcaaagaagatactatctgaaatggaccagggtcatgttctggaaggtttgctatctggggacaaggttcagaaggcttcacttgcagaacagattgggtccattgactttcagttgttccgacatgcaatgcatagtgttagcagaccaattggcaggtgcagacttctgacaaccttttctgttctgcctaaatccttttcaagagaagctgacttgtgctgcaatttttcactaaatagatgtcagtaatttgcctctagttcttaatctagcttccttttttcgaacatgttactatttgcagcttgtcaaaagatgtctttgtcaaatcctcttcatcgaggaaaaaattgatgagaataccttacgaaaccctcttgaaccatgaagagaatgcgaacttcgctagtgaactcaatgaaggcgctgggatcattcagaagtcgaaagcagccaccatacttattacaaatgactctgataccctggatgctgagtttcagggattgcttaattcttttaataagttaatgaaggtatgcatttcatgattgtttattgcagttctttctgtatgggaactaaatatgcatgcccaatttgcagttttatgttctctctgattgttccagtaataaatttatatatgccatgctgccataaggagagagagattgaagatcgatttagtctcagtctctctcatcgttcatagtactaatctatttagctacaacaaacattaaaattatgactggttggtttgtgcttgtttgcttcatgtgctttgttgttaagagctttaggctgtgttcttctcccattttcctaacccacctctctcgttttccgcgcgcacacttttcaaactgctaaacggtgtgatttatgcaaaaactttctatatgaaagttgttataaaaaatcatattaatccatttttcaaaaaaaagttaatacttaattaatcatgcaataatatgagcttcgttttgtgtgccggggaggaggggttcccaacacctcctgaacacagccttagactctatttcattatgaatgtttggagaaaattgatatatcttttgcttgatacaggttgaagaaacccgaggctctatcccttttgttattgtttgtcctgctggtcatgtggggtcagttcagaattgtttggtagagaatgactattttggtttagacactcagaaggtaaatgttgtcttaaaatggtcctcacgtggttctatgttttgtgtagtgcgtagaaagaagtttcagccaagatgactagttgtttctttttttatatattatattagatcagttgaaacttaatcttgttattatttttcacccattgaacacaactcagtacaaagaaatagttgttttgtgttccaatttgtaaaatgtatggagaacctcgaattcgttatggtggggacaagcttacttgcaatatacagttgtacacgtactttttttcatgcctgccttctccagagttggcgtatcttttcccccctttgcagatcctaatagtgccttattctttttcctgaaaaataaatggtttcatcatggattctttgatatttttagtgattatttctttatttataacttggaatctggatattaccgattctccttttgttttttcaatttttttgtggaatccatttgcaggtatgggttctggaagaaatgaaacttccgattgtcagtatgtcctctaagctaaacagcaggaagattctgttgaagtctccatgggagatactacagaagccagcaggaactggggtgattttcagcttgctatcatcaaataaaattttagatactctaaatgaaatgggtgtggagtatgtacaggtaagatccagtgcagttcaccttcttgtcctggcactcatttggcattcagtcatttactttgttttttctaataattctgttcattatgaactgggaactccgtacacaatagtcaagaatgaagaggaacactgtgttatataaagccatgatataattgttacattttcatttcgattacctctttagaaacttgaagcacaccctttttatgtagcttaccatttgttactaccgctgcctgaaaacatatagtctaccaaatgccagactgccagtgaggcagtgatgagtgtagtatactaataaaacaaacgagatttggagggagacgtctctccaaacatttttttaagaagaaattgtgagcgtgttgggggttaaaaccacacacccccttgacactgcactgtgaaacacatctctgagtgtagtatactaatgtttcaaatccttctttcttttgagttttgaccatgcaagctggaaggttgcacttcttcctctttattttatccaagttatttcttgattctattccttcataaaccggtacctgaaatgtatcttacctgtacggcagatatgcagcttatccaataagccaaaccttgggcatccgttgctgtttggggctgtcagctcctttggcgcggatgctggcctcatgcttcgcaagagcagcaaggaaacagaagatgattttgatctgattctttccatgaaccacgtaaacaagatgtgcagagatgttactaagctcaggttctctgcgcagcaggagcaacatgtgcacgtcgagcatgtcgatggccaatgggtcgatgtccaaccagaggcaacgaactgtcatcgcttgcatgcagaggtcactagtgtcttgaactactgctctcctgacaaggtgtgtgtcatagagattgtccagcaataggttctacctgacaaggtgtatcatagaaatacagtaagcacaaggtagtagttttgtttttgagaagtgttggatggtagatttaacaccagttgacccattcatgtgcggcctacttgtatgttcttcggcaaatgccacagagaaagatggcccgctagaatatgggtcgtgaataatatttgtggcttgatccacttaggagtttggacatcaaaattcaacgaatgatatttttgcaatccaatttgtccgtcagaatatggatcctgcgtgagatgcgagcagaggaaaccaggcgcccaagcctgaaactgaaacaaaggtacatcaaataaattgctctttctattgacttttgtttgcttgtttaactgggctggaggctcaaatatcactagcatattttgcttcctcatttcaacaagattaaactttggatagctagcataacattctaccaaataatccgccgtctcaattttttggcgaatgattcattttcggagtatgcttttgcaggtttacacaagaagcaacagcttctagcaagaaaacaagaaaaaaaaatcaagggttgcaggtatgtacacaagcccagcctagtgctgttattcacattttctccttttctccacaacaaataaagtgcgagaaattccaccatgaactttctctccctcttttcctctttcaccatcgcgagctcactgccatttcaaatggacaatggccgcctgagatggaataggagtttcccttctcctttcttcaaccttcgcctgcatccatgaccagatgcgaccaattcccttgccagccttatatctgggtggatgggcacaacacaaagccatgctccggcattcccatcttgctcatctatggagcaattccacaactgcctgactaaaactctagtacatccttgaaacaccatattgaacggcaccaaccttgctgtatccaccagcaactgctgcgatgccgttgaacggagcaatgccgtatagcatgctcccctggagtgcagccctgtctgttagatcagttctgggagcactcctcgtaaagtagtattgtgaagaccgtatgtccggggctgtatctggagcaactttagcatccatcaagtgttgtgcaggcctgtactgcacacgatctttctcaagctcttcctgatgttgcctatcagagtagtctgactttaggttgtagctgtatcctgacttgttggcagctgctggaggaaccatcggattcctcaccaccctccgtgcgctgtgcggatctgcggcgcctggattctcgaatggtaataccggaccaaccgttcttcctggtctagctgtgagtgacaaagatgaaatatatgagatcaatgctctttgaattcaaaattaaaatgtacactggattaagtcacaaatggtaaagataaacagatacctgttgggatcctttgagtaacttgggatgttgcatctaggccttcatttggaggaattgatgtagagtgaactgttgtagccctgcaaagagccgatcaaaggtcagctgcaaagttcaagcacaatatctaggatctgacagccaagataacccaatactaatggtaaaacattttttcttcccttgtgtattaattttaacagatgcaatagatggcagcacaaatcactgaattggcaattatgatcacattggaaagaactgtaacgatgtaagttaccttgaaagagaaacatgcttcctatctagtgcaccactctttcctccgttttcctctaagatggcaaattgcctccggaaattatcaacagcgctacataacaaaaataaaggttgtgaatatagccatataaacagggaaataatttataagatgtgtcaagataaaaaccttggatatagaaagctcttgttttcggagccattcatgtaatccttcagaagctgaggatgatactctaatatctcacggaatataagttccttgatatcatctttggtaacctttcttcgctcaaactcaaactccatttttgaaattgggtggcatgatggttctctctccacttttgcaaggcctttaaaatatggatcagccaacgcctgattatacacaaaatagattgttagaataacatctaaagtaggcatatataactatgtttagtagcacagatgacaatgcaaaacagtagcatgaaaactaatctaattcaagtagagcttgcatgcctcttctgcagtaggtcgatccttcggatcaaatgctagaagcctttgtaagagcttgagtgccaaaggatctacatttgggaacttttctgaaaaaggtactggctgcttcctcctcatgctgctcagatacctccttgccttgtcattccgaatctgaagcagtcaaaacatggaaaaatcagacctggaataatttgtgctggagaattaaacatgtcaatgtttctgataataataataagtcatacccttgaaatagcatccattgatggtgtacccaagagatcagtcatcaagtccaattgatgaaccacatttttaccagggaacaaaggttttccagtcaaaatctccgcaaaaatgcaaccaatactccatgtatctatagctggtgaatactgcagaaaagaatcaatttagtatcaccaacttagcataggaatggaggtaaaaatgaaggtagggataacaaaaaacaactacagcagattttacaggagtacctgcaacattaagcagtgtattttggcttggcaaaaatatgttcctgaacaagccacctgctattaatatgctgctacactactctaaaactaac

SEQ ID NO: 57777 - DNA, 16102 bp, Oryza sativa
cctccacgcgctttcctttttcgcatctgcgcgcttcctcctgtttccggtttccctttcgcgcttcctccacgcgggccggttgttgggccttgcagtttatattcatgggccttctcccgtttcactttcgcgcgcgattccctttcgggacgcgggccgacggtccaacatcctccgttgggccttccagttttagcccatcaaattacatatttttccctattatctttctgggatgtggtaagtagggataagtatagggtggggagatcaatgaaagtaacttttaaatgataaaaactgtagctttcttcgtcaattatactgattttctgggatgtggtaagtagggataagtatagggtggggagatcgatgaaagtaactttcaaatgataaaaactgtagctttcttcatcaattatactaactttctgggatgtggtacgtagggataagtggagggtggggagatcaatgaaagtaactttcaaatgataaaaattgtagctttcttcgtcaattatactgattttctgggatgtggtaagtagggataagtatagggtggggagatcaattaaagtaactttgaaatgacaaaagctgtagctttcttaatcatttgtactgaattgaaaaaaaaacaatgcaagatataaaaaacatatagttaaagtaaaatgtgacacgctagatttcaggtttgcactatggagttgatcagctcgtcatttttgtatatggcaaattgacaggttgaaaaaatgttgataaaaatagttgaattgcacaataaaaacatgatgcgggaaaaaaagagaacattgtgtttcttttttaaaaaaaaggagattgccaagttgcacttcactagcagaacattaggatcgttgaaaatggcattgaactcaaacctgtgatgagaaaaaaaaataaaattgttacaacttaaatgagagaaaaaagttgggcaaaagcaacatgataagttgtgagatgtagaaatattcaatttaatactactgagttttgtggaaacaaagagccattccagcacatgaatatatgacagttgtgatgtacataaagttgctaaaattgggtcacatgaaatccatgatgaacaaaacataacaaaaaaaaaaaggggaagaaatgacaatgtgcgacttaggcatcgttcgtttaggggtgataggggagattggctctcgttttccgcgcgtacgcttttcaaactactaaacggtgcgttttttgcaaaaaatttctatatgaaagttgctttaaaaaatcatattaatccatttttaaaatttaaaatagttaatactcaattaatcatgagctaatggctcacctcgttttgcgtatcttaccaatctcctcaatccccttctcctcaaacactcccttagtgatccgaaactacactacatagaaaagttcatacatgggaagaacagcctagcagtttaaaacaaatgctacatggatatagcaatctaacagttctagtagtctaaaagtgtaatgacatggaagcatataaaagaagtaatggagcaaaaaaaaaatggtgttaaaaagaggaaataaaaaggaaatctggaacagtaccatttcccttgtgaataaaaattatattgtcacaccctacatatgaaaagaaagagagagaatgtcaaacctaaaagtagtaaccaaaaaaaagttatatataaaaatatagaaagaaaaaagaacttcattttgcaagaactcacatattttttccgatggttctaattttagggttgtgcttttcatgatgatcattagccaccaggaattatgtgagcttctcacggagtgttttagcatcatcctgttttgatgatcttatgttttaaaatatcaaataaatgaatgagtgcattaattagtttgttcatcatgctgctttaaacactttatacttcgaaaatattataaacacaagaaattagcgggggatgaaaacaaagacatgtgtattccaaaaaaaacctatcggacgaatagtaagtttatacacctaaagtttgtgcacctcgggtttacacatctgaagtttatacacctaaagtttgtacacctaaagtttatagacctaaagtttatatacccgatttaaattacaattcggattcaaatatttttttatatagaaactttatacttgtaaactttacactaataaaaaattcaaaatccaaaagtttatagttgcagaaactttatgctaataaccattatgcctatgaactttatacttataaagtttatagttgcagaaactagaaactttatacttacaaacatgctgctttaaacactttatacttcgaaaatattataagcacaagaaattagcgggagatgaaaacaaagacatgtgtattccaaaaaaaaccatatcgggcgaacagtaagtttatacaccttgagtttacacatctgaagtttatacatctaaagtttgtagacctaaagtttataagtcaaaagtttatatacccgattcaaattacaattcggattcaaatattttttatatagaaactttatacttgtaaactttacactaataaaaaattcaacatccaaaagtttataattgcagaaactttatacttacaaacattctgctttaaacactttatacttcgaaacattataaacacaagaaattagcaggggatggaaacaaaacatgttaattaaaaaaaaaacctatcgggcgattagtaagtttatacaccttgcttggtttaattgatccatggtatcggatagaataccagttaaagagaaacagggaaatagactagtaaaatcattatcacaaaaaaaagtataccttcattttgtttattgcagaatctgaagactgttgtacttcaactctgttactttcagattctgccgagctgttatctttgcctgcagagtgctcaccagtggcatccttgcttggaacataatttgaaattgaacaatttgccttgctacagtccgaatcttcacgagaactaataccatgttcctcaaaatcatccatactgcccgagtcacgtaatggaattttttatctgcgcaacagttacatagacaccttgagctcctgaccaactgatttattagaaatcattgatacaagcagatagtggcaaaggaaatcaaaaaggttatgcaaaaaagcgaaacaatggaattcagaaaagcgcaaaaaaaagatactattcatccaggagattttattctgtccaagatgtctgttctctatgtgatgaaggtactctctctaccccttggttttcagacacatgtatgagcatttttggtgacttggtgtactgagaattttttatatgttgtatattatcaaagacatagtagcaaaaacactagatcaaaaaaattgtttatatgtatggactagtcatgttagtcaccatgtcaagcaccccctgctatgtacttaccacgcatcacatatactttaatactttatatttaccagcacacagtttagccaaatcacccattgtcccataaaaaacagagcaaaatcctgaaacttaattgaacatctaatcctataaatatgagagcaaaattagttgatgaggacaccagtcactactagtcacaaaatatgagaatcaactgaaatgtgagtcaaaatcagttgatccaagaatcaactgaaattgaatcagaaaaataaaattcactagcagtcactaccggttcccccaaaaaattatctagaacaaagaaaaatctgcctaagttgattgcttatgagtgctcatgaggtggcaaacatatgcatatccacaataacaaaaaaaaaatagttaagctaacatgaacccacaaaatggcaaatagtgagggcgtatatgacaataagccatgtcagttataactgcatttgtattgatgttactggcctgatagatgggaatggtagactacaaccaaaactaaggcaaaaagattaccatttagtgctagtggccagaaatgccaaaaagtgcagatgggccagtcaatcacaaatatatatgctcatgaaaattttaacaaaaaatcatcaaaacttcgtgactaactacaaccagactgaacttaactcagtataagaggattatgagttgatgactgcaggaatacaaacttagaaatgcagaggtgtataaatctgcagtatataattaaacacaacacaagcggctgctaggttttctcagttctggatggttcgtttatatttaccagcacacagtttagacaaaaagtgcacccattgcactataaaaaacagagcgaaacactgaaactttactgaatatctaatcctacaaatacaagaacaaaatcagttgatgaggacacctagaatcaactgaaaaaatcgagtctaaaacaaaattcaaaaccagcccctatttgtgttctcccaaaaatttgtctagaacaaagcaaatctgtgcacaatcgtttcaggggaaaaaaactaactgcatagggaggaacgcaaaatagtacatttctgacaaaaaaaactcagtacaccaagttaatgcacaaagatgtttttgctcctattaaatcctttgtagttttttctctgaaaatctgactcaagtatgaatgttattagaaagcaacaactatatgatgacacctacaaaatcagattgcagctatccatgcatcatgtgaaagcctcatgataataccaggtcaagcagggcatggagatagaaaaatttctccgtgaataacttgaatcatgctagcaaaatttgctgaaagatggcaaaatatactcaagctggcaaaataacttgagatatgtagtatttcaggagccaaatatgctccaagattgcagctggatattgcactggattgaaaatcacattgcaaaaaatgcagtcatcaattgtgcagcaatatgtagtcaaaaatagcattcatttacagcaatctgcccaaatattctagctatatcaatgcattgattcagcaatatgcagcaatctacccaaattgtccattcactccaggatacacatggaaaatatccagcaatatgcagccacaaatattcccatttgcaatactcctgcttacagtagttcattgcaatactagagcttacaagattcaagcaatggcgttttgggtttagatccatgattttgctagggttagaccctaaccctagcagcgacgggcggcggtgaaggtgtcggcggcggcagcgtcaaccgcggcggcgacggcgtctacagtgtggtgcatgtgtaatccatggtgttttccctttcagtttaacggcatgattttgtgacggagaaacccaaaactccatggatctaaacccaaaaaaccaaggaactaaaacaaaaaatcgccaatcaaatcaagctagctcgagggaacagaaaatcacttccaaaaattaaaccctaactacaataaccgagaaataacaggaggaatcgcttccaaggatgctcgaggagatcaggagacgcaccacgttgcgttggagaaaaatcgtcggagaatcacaagagaaatcgaaatcgccaggagaggaagaagagggtactgttcaaaattgcaacggcatccgcttccgcttctcataagggcgataaaaaaaaaaagccaaaaacgatgccgtgctgcggatgggctctcgtgggccaagcccaataggaaagaggctgagaaagccagaaaaggcaagtggcggacgcacgtgtttggactagaaagaaaagggaaatcgatcgccactcctgtagcccagcgattgatcgcccattaggagtttcggctttgtcccgcgttgtgaggtgtgcgggtgagtggggtcgctcggtctcttgctccgatatatgtacacggatcgggagaattttggtgtcctgctcggattcggagccactaatccgtacgggaaacgaagccgaatcgttcatcgttgtccatcgtattggcgcttccgcctacgtcggcagcggcagaaaacggtcgccgtgtgcaacaactgaatcgaaggcacagcagttgcagttcgtctcagcaactaatcctctccttttcttttcagttttccttttgtttttccccctacaacgctaccgtacatgtttcatttattcccttaaaatttccgatcggcatagttcccagttgatcacaacatcgtcgccttttctttcttcagactttatgagaacatcctaaacagtaaaacagaaaagcagaggctgcagcagatcgagccaggctccgctcaaccgccgacatgcttgataatctagtgctacttaaaatgatcagagtttagtaagcttaatctgtgccccatgctgtggctggagcgtggggattgggaacggtgcgtgcgtgtaggacggagacagcccgaacgagaaccgttgcaggatcatgctcagcgccatcttggcctccagcaacgcgaagttctggccgacacagatccgtggcccccaactgaagggaaccaacgccggtgagtccttggacgccctggagacgccctccgcgaacctctccggcttgaactcgccgacgtcttctccccacacgtctggatcgtggtggatgcccgcgatcggcaacgcgaatgtcacccccggtggatacgtgacccctccgagctcggtctcttcgtatgcctctcggccaagcagcaggatcggtggatacagcctaagaacctcgtgtaatatcatggtcacctgtgacagagaacgggaactaactaaaaacagaacctgaacattttcttcatcttggtatatatgttgcactcacgactttgagatggtttatgccctcgaaatctggactgttctttccgaaaacgcgcagcacctcctccctggcacggtcctgccactcggggtgcatgcttaggaggaccattgtccatgtgagcaacaccgcggttgtatccgatcctgcaaagtagagcagcttcagctcctcgatgatgtccttcgtggtcatggttggcttggagcttccagcttcttggctctccttgatgttggtctccaatagcaatccaagcagatcatcgttaaccgcatggccatccttcatcgcgctctccctcttggtgattatgcctttcagaagctctctgacctcgcgtgcgtttgctttcgtccttctgttgagctctgtaggcagaaaccttcccaataagcaaaaaaaacaataagcaaaaaaatcgcatctcagatgtaatcaagtaatacctaacctctttaattcgggtttaattttgctattagtcaatcacctgtaacctgggaaatacaaagcttttgccatcttcataacgtttcgtgcctgctctgactgcaactggaagatcctcctcccttcactgaagctgctgccgaacgccgaccgggagatgacatcccccgtgagattctggaactccggccagacatcgatctcctgcgcaccatcagctcccacagaatcctgccatctgcttatcagctcgctggaacatgctgcaaacgccggcaacatcctctgcacaaagcatcaagcaatcctttcactgtaagaaattttacgatcctcaagaagtaaatacagacatctagactgacaaagccagaaaggatgtaaaaaaaaaatcggttatggacatgtggttgtgtcgtgtgtgcaggatggtggtgtctcaccttcagcttctcgagatggaaggcgtggttcattatcctccggtgagcgacccatttctcgccttggtggctcgtcagcccatctgccaacaaattctggacccaaagaatggacttctgcttcccgaaccgcccgttcttgttcgctaaaatctctcggaaaagtttaggatcactcacgatcactcgcacctccgggccgaaccaagtcacgcaaacattgcctgcattccatgcaacttccgtttgatctctcacgtttgcaggggcgtgtgtgtaagctgctgattaaaaggagagagccagtactacgcaccgtgctgcttgatggcggcgagttcgaacggaagcgctcgcgaggcgacgtcgtgcgacagcggcggcatgggcgcggcgagggcggcggcgagcagccgcgcgaactccttcaggtagccggacgggaagcggtagtcggtgccgcggaggccctgggaccgcagcgcccggcccagccgccgcgggcggagccagaaccggtcgagagcccgccacgcccaccacagcgccgccaatgcgccgagcgcgtagagcagcaagctccatggatgcaacggcggtgaagcgccatcgacaatctccatggtttcgatctcgtcgtatgtgtgtacatacctgcgtgttgacgtgatatactactaagtagcgtcaacaggaaatgcatggccaagaactatgttcggttgtccatgttcccaacccctcctcctcattttctacacgcatgcttttcaaactgctaaacggtgtgtttttttttgcaaaatgtttatatacgaaagttgtttaagaaatcatagtgatccattttaaaaaaaattagctaaaacttaattaatcgcatgctaaatgctgcttcgttttacgtgtaggggcactcccgaacacagccaaaagagactaagagtgaaacgtaacaaaaggagctttgtcacaagcgtccatggccaggcagatgcggtgatacaagttagctttgatttttctttggttgctgtatgcatgaagtacacaggtgtcgtttgtgtcattgctccaccgctcacatcgtcaaggaaaacaagagaactcttaactttaccgttgatttttctgcatctctatcggaggagttgctttggttggtctcccagtctcccagaccgtcacatcatctaagtcttggcctgggaacgacgccatacgcgactcgaaggctcaaaacaaggcacggctaaggattagatttagaatgcgctctcggcacggtaggagtgttgggttgttggcacattccgaccatggaagcatgatgggccgcacggactaaacatggtccaagaatcaccagcccaaagaaccttgtaccacagtggaattgtgaagttattctggagcaactcattagaacttagcggacatatacatttctctacagacatatagcaacggtgaggtggaagagaagcaggacaatagcaacgatgagcttctagatctgaaatcctcctttctccttccttcaacctcagatcctcctccctcctagccagcaagatatcggtgccgtcagaggtggcgcggcgagcttgggacatccgacggctgctcgttgtagccattgaagagatgagatgagggggaggggctccaatggctgacgggttccatgaggcgatggagatggcgacgaacaagacaacgcttgaaagagcaaatgggggtgagggaggtgaagggagcgcgaccccctatcgccccttgcacgcgcttgcccccacgcctgcacccacgcaaccccaagcctgcacccgtgcagccaggatgagcagcgaagctcgccgctagcgtttccagcgggcctggctcggaagaccgatttgcacgagcagagccaggccccgatggccatgcaggcaaccaaacatggctggcctgcacccacgcatgcgggccaggcatggtgcgagcaaccaaacacacccacactagacacaagtacacaacattagttgtcatcttcttaaatgtacataggtccactcttcatgagagcacacgtgactgacacattttgtacaaccatccgagcgaatcaaaagcacttaacaaacatcacaaaaaactaaaataaaaaaaaagttcacaaccgctcctagttcaggtaatttgacttgttctgaacacattgtccatgcaccaattatgctgtacattcagactagaaaaaagatagaccgaccgagcacgcagttctcgtctaggacaggacccaggaggtgtttgtcatcagtttagcctcgtgagcctgacctgcgcgccgtgctccggctgaagcaggccgacggggaacggcgcgtgggtgtaggacggtgagaggtcgaaggagaagcgctgcaggatcatggagaggcccatcttggcctcgagcagcgcgaagttctggccgatgcagatcctcggcccccacccgaacgggaagaaggccggcgcctccctggacgccttggagatcccctccgcaaacctctccggcctgaactcgtcggcgtccgcgccccacacgtccttgtcgtggtgcacgcacagcagcggcagcgtcagcaccacgcccgccgggtacctcaccccgccgagctccatcggcttgtacgtcttcctctgcagcgccgtcagcggcgtgtacagccgcagcacctcgtacaacaccatggtcacctgcaaaacccaaaacccaaaacccaaattagacttttatatctttaatttcgtgaatcatcagttaatcgtgtcgaagtgcttacgattcttaggcggcttaagccgtcgtaatccggggcgcggctgccgaagacgtggaggacctcctcccgggcgcggtcctgccactccgggtgcatggagagcacgaccatcgtccaggtgagcagcaccgacgtggtctccatgccggcgaagtagaacagcttgcactccccgatcacgtcgtcgatcgagatgccggagctcgcggcgccgccgttgcccttgctgtggtccaggttggactccagcaggaggccgaggagatcgtcgtcgctgcttgcctcgccggccttcaaggcgctctctctcttcgcgatgatgcgtttcagcatcccttcgatctccgcagcgatctgcttcatcctccggttggatttggtcggcaggtgtctgcatcgcaaacacgtcagatcattcattttgtcgcgtggaattcattgcactaccgtttgctactatcagcaggaggaaaacatatgaactttgcaggggaaatgggccgaacgagagatgatgaaagtgagaagggagctcacatgtaaccagggatatgtatcttattcatggtggcgacgatgagctcgatctgctcaccctggagctggaaaatcctcttgccttcaaggtagctgctgccgaatgcggcgcgtgagatgacatcccctgtcaggctctgcatctccggccaaacatcaacttcgtacggctcatcacctcctttggctaaaccttcccacttgtccaccagctcggtgcaacatgcagcgaacgctggcaacatgcgctgattattgagaagaaaaaattagtccgaaacaacggcgcctaggcccgatcactgttgccatgtccgtgacagaaatatctctctcaccttgagcttctcgagatggaaggccgggttgatgatcctcctgtgcttggcccatttctcgccctcgtggctgcccaatccgttgtgcagcaacctctggaaacgtccaaacttgagcttctcgaagtggccgaacttgttggacagcacttctcgcaccagctcaggcttggtgatggtcaccctgggcactggcccgaaccaggtgatcgacactttacctgccaacaaatatcacataattacgacaagacttcattttcgctctgaatttgtgattacatggatcccttcattcaaatgtatcatcgctttcacaaatatcgtatgataagttgcagttattttagtttataattcatgattatatatgataattgaacatgcttattcaagaaaaataaaaacgatagttttcactaaaagaaaataaaaagatatttctcacaaaaataaaaaagaaatccttgcaaaaagaaaaaaaataaaatttgtagtaacgactaaaaatagggggaaagggagataaggaagcatatcactcctctatattattgacttaataagagacctcgagtgctcatatattagattgtggaggatagaaaattatgcgaaataatggtgcatcccaaatagccaaatgggcatgttggggttcaaatgatagaaatctattattgacaggtatgcgtgaactccaaggtgccacaagattaaatccatatgtaaatccttggccttaataaatcaactgcagataatctgtcaccatcatgcaggaaatctggtttcatctctacgtgtatacctttacataccatgtggtaggacttctccgtattggaaatgtcgttggactgatttgagagaagtaatatatattcccctgcctcaaaatataagggattttaggtggatatgacttactactgcaacaaatctaaacagaaaaagatttgttggactaaaaagtgtcacatccgttcaaaatcacttatattagggacggagggagtgcacacacacacacacacacacacacacatatatatatatatatatatatatatatatatatatatatatatatatatatatatatatacacacacacacacacacacacacacacacacacacacacacacacacacacacacacacactaggaaagagcccttagatgctaaatggaaattttctgctacactcttttaagtattagcaggttgtatacacaagttcatctctttaagacaggagcccttctacagaatctagtgaagtaagaggctacaataaatcctatattcatgtattttgccactaaaaattaaaaatatgatagatttggcagcctaagctgattcttatggagacatgcatgcaagccactttaatttccaaatatgtaatatgtgaaaccacactcaaatataatccagagcataacaagatttccactgttgcttttatttcaattgcggcgtttagcgtctacatattttagtgttatcaatcagattcaaatgttgtttgagattttacattcaaggtatgaaatataattggcatattgtattttaaatttgtatagagcaatatatgtggcatcattttactaattacgtactccactcaccttattaacagtgttaattctaatggtatattaaaaaaaccatttccttccttattatgaggtcttccctctaacaaggttaataggttatataaccaatggatcaaggtctaaaagctagattagtccataaaaacttggagcgccaaaaaagatccaatagttagcttctggacattcatttgttccagatctgttgtactgtatgaaaacaatgattaattatctcaacagtgcttcaaattttatagcttaaacaggtggagcctgaaactatttgccagtgaggcacgcctttttctttttttaaaaacgaaagcaagagcactaacagatcattgatagtaggaaagtagaaaggtcaagccatttacagttacagagatcaggtgttcggccatgtctcgccctgattaaaatctcaaaaatttatggctatgatcaaacgagagagagagagaggagagtagaacatgtcgtaccgtgctccttcatggcctggtggaacagcggcatcgcgcgcggcacgacgtcgtggcagccgagcggcatggtccgcgccctcgcctcggcgctgagctgcacgttgagcggcgcgtcgcccgccggggagcggtacggcgtgccgcggaggccctgggcacggagcgcccgctccaggcgccgcggcctccaccacgcccactccatcgcccgcacggcgcaccacgcgagcaccgcgcccgcgaccgccgcccacacaagcatcagcggccgctcgtcacctgcggcgaagacgaccatccccatcgatcgtcccactcgctagcttatcgcagcagctaccctcgctcgcagagcagcttacttcccgcaacagctataacaaggagtgcagcagtgcgcagcagaaagagaaggggggaattgatcggtggtatgctcacgaccggttgtctgctactctgcctctcggctcaccaccccgctgttatatatatatatataaatcctatgtacaaacacggcgcgtgcgtggtttgttccccggcccgtattattgtttattctgcctttggaacatatgctccggattgctacttccgcgacggttctacagtctatggctggcatgcatgtcgttcactggggaaacttggaaatgtgggagcggtacggaaaggggaaaaaaaagaagaagcgaaaataagacttgtgttaattcgctgaccatcgatgttggtcgttgcatacacatctccgtccaattgggggtcaaatgatttaatttgtagcagctccctgggtctcgaagatcacacacacggtcagaagtcaaaggccagaacatgcccgcgaaccgtttcccctcgcccggtcttctcagaacggacgcccttttagattatgttgatatacatgttgtttctaaagtatattaataaagagattagcaaggagtcattggtaccgtaagacaccaatattgcattacatatggtggatccgctccaagcgatatgggtgcataatgatgattcggcagcctggtggggaagcccttatcttaacgagatactagccttttctttttttctaaaggactcattaacgagctactagctctccccgtaaaagctttatttttagctataaacttataaaaaaaacttgtctagatgcataagtataaataaaagtcttttccgagcaaacatagaaggtttttataaggactcattaacaactcaagtcgatttggcttattcatactaacaagttataaaacccacactctgctcgacgagttggcacgcttagctatttagcttgcttcaaaatatgtgtccaagaatagagcaaagatgtgatctctgagcgttagaagtggtcggatggtggataacagcatcaggtgacgctcatttcaaaagttatcaacaaagataatataatgcaattatgcaaatgaaaatgtcaagctctaggagccattccagccaaaaggttcgggagaatgggatgccaactaaaacatcaccagttggtagatctatgtatctaaatgtaacgtcccgcctcccccaggccgggcccacttacatctgatagctttcataggtcatagactgccctcacagaccaacacatgtcttcacgtccatgtgtccagtgccagttgcgctgtgtaaccactacactttgtcctcactcgtgtgcacccgggaagaatttcccggtcggtcacccatcccaaattgctctaggccaagcacgcttaaccctagagttctttggagattggcttccggaaaagaagttgcaacttgttgatatgagtattctattaatcctattaagccctaagccgggatattacactaaacctttcaatatgaaataaccacataagttcttacaaaaaaaggaggaagtcgacctgtggccacaataagggagaaggtgtggcatagctactgacggagcgtggggctcctcaccgggaggccgcgcaggcccccctttgccggttcggccggggccgctaggtgaggttctttgccctcgatctgtggaatattcacgagagagcaaatgcacaagacacgggcgatgtagacaggttcgggccgctgagaagcgtaataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctacttttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcataaatgggtgaagaattgcaatggctgttgccc

SEQ ID NO: 57778 - DNA, 2076 bp, Oryza sativa
cctcttcgaggcggctcttccccacaccttccgttgctccactgagcgcagaaccccttctgcaggccttggccgtcgcaaacaccacggtgttggacgggttaaatgcccaggtggaggccctgcaagcagagcgggcggagctcgacgccgcatgggcacgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggtggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgtgccgtggagagggacctagcggatcgcgaggctgccgttgccatccgggaggcaacgctgactgcgcacgaggccgcctgcgccgaagaggagtccgcgctccgcctccgcgaggacgcgctcaccgagcgggagcgagctctcaaggaggccgaggccgcggcgcaacggctggcggacagcctatccctccgcgaggcagtgcgggaggagcaggcgcgccgtaatctagaaggtgcccgcgccgagagggccgcgctgaatcagcgggccgctgagctcgaggcgcgggagagggagatggacgcgagggcgcgcagtggcggggcggccgcgggtgaaagcgacttaaccgcccgcctcgcagctactgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggcttcccgaggagctcgagaggacgattaagtcatcctcgagggacctcgcccgaggagcggtggagctcgtactggcgagttaccaagccagggatcccgacttctccccatggacggcgctggacgagttccctccctggaccgaggacggcgcgcgcgcgcaggtccgggacgccgccgaccatatcgtccacaacttcgagggttcggcccctcggctcgcgttcgccctcaactccgacgaggaggacgatgacggcggagtgggcgacaatggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatacttttattgaaatacagatatcagagaaataagaatatgcatatgtggtagctaccggccaaccctgcacgcccgaggggggtgcggagttcgtccgagcccgaaacctgacacccgatccccctttaggggtagaagc

SEQ ID NO: 57779 - DNA, 30725 bp, Oryza sativa
attaaacagtgctaaattcgtcgtgactcctttgcttattctgcatttttcgaaaaggtactcccttcgttttacaatataagtcattctatcattttttatatttatatttacattaatgaatctagaatgagatcaatataaatatggaaaatgctagaatgacttacattgtgaaactatatatctagattcattaatctcagtatgaatgagggaaataatagaatgatttatatatctagattcattaatctcagtatgaataagcgaaataataaaatgatttatattgtgaaacagagggagtatttaagttaaagaaaacttcacgcaagagacgaccgtatgtccttgactcctttcatagttgctttgtttttttttccgttgcgatcttgctttctcaactcatattaaccatcctcacacgtcatccatatttctgtttacaacaggaagatggagtgtatacgtagattcatcatgaaatataatttgataatgtcacaattcttcgagcttacaattaataaatatacaccactagagaaattagtagtcaatttgtatgggaaatattgtgacaatgttgtttatagcaacgaattctcgacataattgggattggtaattaattcttctcgcatttaacatttagttttgctatttttatttcagttgtttgtggctcaacttcagaccgtagatattactggatttagagtttgcaagaacaatgttgtaagatcttatgttttaatctgaacaaaatgatgcatccaaacgttttttaaacctaggaatacgcaactctaaatatcctaaatagatatggatcacgtgtcaatccgagcatttttctcttcattttctaattaacataaaaggttatcttggttttcgttaatatgtatttaaacagttaaatgatgtatttcgtgtgaaaatattttattatataaaagttattttaaaacatcaggtgaatatatattttaagtttgaaataattaaaacacaattactccctccatcacataatataaggtatggtaaaagttacacgatctccaaaactaatatttaacttataatttctcatatatataaggtttgtagcaacaaaattataatcatatgaaagtaaatttaaatgtcaatttaattatataatttttaacaaataaaattaatttcatattacattaaatattagtcaaatgttttcctattaaacgaagttatgtttactatgcagaaagatattgaactttttaggtacaacttagccggtatattactgtgttggaaaacaaatatggcggctgaggcttccaatgttgaacaagtcgaagatacagacaatgaaaatgatgttgtgatagtgggcagtcgtcaaagagaaagatgggacatgaaggaatctaaagtacgctcggcaaccaacgatcacaaatatagttcccttctctcggtggtttctgctatgagtttataggagttgataggcggccttttccagtacatataaataaattgtgccgaaaccttggagtaagccacttctatataatatatctaccccatagttcaaagatgcactaacttattttttttattgattgacaggaatatatgggtgcaaagttcacgtccgcacaccataaaattaagtctcaaaacacttcaaacagtactaaaggatggaccacttgaccgtgattgcttcaacatggccatacgcaagttcatgtatgaaaacatccagtcgcttcacaaaaccagcgaagcaataacgaagcattgcctggacttaccatttttggtaagtttttataatctacccaatattgattcttttgctcatattttaaacaattattgtacatcatatagactgctactggatttggtataagtccgatgttccataaggatatagatcttgcagggtcggttggtagctggtcgaaaatccattatgaagttgcaaaatgcaaatcggtaagctaactatcctttgttcttatttgaatgtgttttttatattatcttgacggttgactttttccagattcttataccagtatgtgctgttggaagctatatcttggtcatactggaccaagaaagcaaaacactttatcttctagaccctaatccactaaatccaatgtatctatgagatatatcaaaaaattgttaaacgttaccaactatttcaacagagccatgcgtgtggcatgtcttggctctaggtggactgaggatatcgacttgtggcgccatatatatgtcacaaatccggtggctaactcgtaagttttcttgtaaaatcttgtttgatccaataaattatttttgtctaacgcatggtacctaactattcaaatttcataggaatttgtcgggttgtctcgtacatctgttcatgcgatcctggaaagatggagcacttcatttgccgtcttttaaggtcattctgactagcattgacatttagaatattatattttattttataatacaattatttattttataaacatatacatttgcaggatgttgacgagctaaggaaacaaatttttgctatatatattgatgtacgagcaaaatgagtgcgcaagcaacgttcctagcggcgcacgagattttcttcactgtatcgcaaatgcaaaacattagaatagtcattctttacctatggggtgtattctatacattacaaatgctttatttaaataatagaataactctatacttctctaacatatttttctgcccgcaacaaataatggaataactctatacttctcttacatatttttatacgtatattgccttttatattgtgtacatagggtatattatatataattaagtctggtaaagttttactgtgcccacgtaatatcatagtactgtacttacatgaaatatatttaatgtactatatgaatttaattaaagtttaaatgcacagatcatataaaaatattttttggtaacatgaaatttttttaaagatacagttaaatagaattgcaccgtagcatttagcacggacatattactagttacattaaatattagtcaaaaagttgaattttgaaacgccttatatcatggatggagggagtaatattattgatttatccgtcgctttcgaaatgggcaccacgcacgcatctcaaagccacacacgcgtctccacaacacgtccctccaggtccaaccccaccacatgtatcggtttctcgtgggcggccagatttttgtcgcaggtcggtttcgtttccgctctccgctccacgcggcgtcgcctccggagcccccagaagcttctcgacccaccaccaccgctctccctctccccgtcaggtgcgttcgtcggaaatcatcgggaaaaaccccgaaatcctctcccagctttcccttttttttttcccttcttctccgcgcgcgtgttctcctcgatctctccgatcatcatcgcgtgtggtggccgattggctgcggttcccttcccggaaattctgcggcgcgcgccgccatttttatccgtctgtctacagggtagggagttctcagattagaaaccaggggttctcccgttttggcgctagttatggtagagatttcgttacctttgcatatgccatggcttcgtcggctctatgcacggagcctatgtatgtatgtatgtatgcttttatttttaagtttgtctcgtctagagtacgcggtggcgatgggaaacagccgctagatttgtttattgtttctttaccctaatcacaggtatgggtatttgagattagttacgaaacatcttagatatatgcggctattcagtttttttttttaatgtgcaagaatccaaaagtctattaattagcatgtaaaaggacttgtgctgataaattctttagtttttagtacaagtgtctgtatctagtttcaatacaagttgcaatccagactacgttaataacactaaaagattgtattgatacaaatccatgattattatggcgcattgaagagaggaaacagaggaaggtaggcttgtcctgcacggcttgaagctctgcttgccttggccaaggtttggacagaggcccttttgagttctatacactggttgattactccctgttacaaatctgagcaatctttatcgacgagggcctagctaataatcaggaaaaatagagataaagtggaaagtagataacaaacgccaaactaggaaatagatgactgcatatctttcagccggatatggtccctcctgctgtaggcgcggacccagaatgcttgtacagctggtatttatacctatttggcaggtagataatgatgattgaacatggtattggtgctttgggtgacagttaaatatttctaaggaaatcactgcacaaatatcattttttttgtttgggaaatatcttgtttttgttttgaaaaatttaaagtttatggtgaaatctcttttgtgcagccttggtattatgtaaatctccaaattctgtagtttagtgttatactgtcgaaatttgccctttccccaatctttgctgttgtttgacaatatgcgcctacacaaaattagtacagtgctacgctcctttgtgcttgaaatgtttccccatattatttattaacagaatcttgaatttacaaggtcattttatcttgcatatttgcatctataattttagttgacctgctttaactcctatatatgcagaaacaatgagcagacgcaacagccgcaccatctatgtaggcaatctccctggggacattcgtgagagggaggttgaggatctcttttacaaggtgagctttactgctttacaatctacctcagttcttctcataagcaactaccatttcaatctggtcgtagctgtataggcataatacattgcttattttcctacctgttaagttgccttagcttattaatgtgagaaatagctagcggttgaaggatttaaatcactattatgctagtggttgaaggatttaaataattattattatagtattataagagttataaaggattattgttctgtaattcgtggatgagtctaagggtaaagcaattgcgggaagaaaggaaccatctggccttgtgtcgccaaagaagcgctatttaggaagttgtcttgtctgtattaaatatctgttggctgtttcaacttgcgatgtcttctcctgctgttttggtagtgaataatcattttcttaatagcacaaccattgatgctcttgagcatccatcagcgtaaacagttgggtgtgatttatcctagatgacaactgataacctgtgtgccattgcgaaaaagtagtcatatattgcagatgggaacgtgttgacaaatgatatatttcatgagtcatattcagattaagggtgttgtatttgtacttattttctaagctaatgtggaggtgcagttgtgaaaagtttcactaataagtccaattaagtttatgtatatatgttattccagtgtttttatcccttacaattgcaataagaaccttaatcttgataacatgcatgcttttttttctcataaatttattctaatgcagtacggtcgcattttggacattgacttgaagattcctccaagacctcctggttatgcttttgtttaggtgagtgtccttttgcaacagccatgtcttctgtaagggtacttgtattgaaaattttattgaaatttataatatagtccctattattaccctgatattaatatcatttcttctttaaaggatggttgttttcaataaaatttacttctagatttttttcaagactaagttttagtttaggtatagctaagttttcttaagatgtaagtgcatcttttaagatgtatagctaagtattggatgctaaatagctaatagaaaatatgtgcttttgtagtttgaggatccccgtgatgctgatgatgcaatttgcggccgtgatgggtataactttgatggctacaggttgcgggtatggatatcaaaatgtttttcttccggtcttctggtctgctttggttttctgtgcctgtggctttatattttctgtacgtaggtggaattagctcatggtggaagaggtcaatcttactcatacgatcgcccaagaagctatagcagtggacgacgtggaggtgtttctaggcgttctgaatatcgcggtttgtaattctttctcttgaatgtgttagtcggtgtatcccaacaaagaatgtgatgtttctatttgttggaccatgcagttatggtcactggcttaccttcatcggcatcatggcaggatcttaaggtattggtgttgtacataacttctatttatagatttttctctaatgacctaattattacctacattcaggaccatatgcggcgggctggtgatgtctgcttctctgatgtataccgtgaggctggaggttagtaataaatgttctcttcttgttatgtcatcgtaccatgggccctgggatgagaatcaattgcttatgtgttgatcttagttttaattcattgtcctccgaaatcaagattcatgctttaatattttttctgagaatacaaaagctgtgtattatttcattaagacagagactggatgacgtctgtcagctggtcatcaggcccgtcaaaccccctcaggtcagggaaaaataattataaaagaagtcctaaaatgctaaaactgaaaatgaaagaaacgacaatgtcctatactcagaagcaacctctgagcctgcagaggcctttctatatagtttgcgggctatgtcagtaatatttgtctttctgtttgtgttgcagcaaccgttggaattgtggattatacaacctatgaagacatgaagtatgcggtatgtttgatatcttctgtataaagtgcattctgaaaatattatactttttggtaattgatgagggaacattttcagatgtgttattcctgttatacactttggtcatatacgttgacatttatggcaagatttggtcaaatttttgaaatgttgactatcaattttatattagaataagtttataaaatctaataaatttatgacattatgatagtacttttcaaggtaaatctagcctaccatctttttttttcaacaaagcatttgaaaaattattaatgattgaagtttcataagtttgacataaaaatcaaatatttatgattagagggagtatttggtatgtatctcttatgatcttttgatgatcttgcagattaggaagcttgatgactcagagttcagaaatgcattttcacgggcatatatcagggtatggatttatttgttttttgaccatgagggtttttcctgtttttgctatgataatagataatatgtcttctagatgcatttgattgtgatctttcgtcaacgtgttcttatttctatgataggtgagggagtatgatgatagatcaagaagcagaagccgctcttactcaagaagtcgtagttacagcaggagcactatggcagcactaattgttgactgcattgttccacagatctgtttctcggtcaccgtcacctgtggatgaaaggtatatccttttataacatcagctttttactggcatgccttttttgtcgttaaagagaaacaggagtatgtgttggaatttgggtttttatatactttggaacttccactgtggttcataaaacatatgattgaaaagcttgtaatgtatttccttttttttgaccgactaatgtatgtctccttttaaattgatatgacttaaatttcctctatggcccaatgactaaaacacagtgctggtggctaacttgcaatgttcaaggtttgcttttgtttttcctagatctggccatgcggcaatctggggactgctttcatagattttggatatgttgagaatcgaaaggatggtttggaactttggatagtagagctggattgtgatgcatgtatggcaaatgggcaacaaccagtcctaggagcgagctaggcctgacagtaaggatatgtggagtggatttgtgttattattgagaatttgttgaccgtaggcacttcaatttcatatactgcatgacatggacctaacttacatgagatctcaaagttttcttttaattattcttgcatcctgataaaacaagattatggtacttggtaagcatttttctggaatatgtacgtgcttttttcacaacaaaagaaattgatcctgcttagtttttatgcggattctgttgaaatagagattttgttttgttcattggcacatattagccatttagcatgaatacaaaaatgcttacttatcagtgtggttcttctgtaatttgttttgatatttctgttagtagtttttggatgaaatcacactgagtgattggttttgcctgtgaaattttgcagatcaatatcaagatcacggactcctgtttcttcagtaagtcttgcagcaagtcatctattattaaaaagtgaattaagtcctattttcaatcattttgtttattgcaatttgcctttttttggcagccttctcgtggaagatctgttagtaaaagcccaagcaggagcttatcccgctctccctctccggtaaataccaaataattcctcccacatttacaatgcccctcccgccctgaacaaaggaaaaaaaaaaatagagagaactcattacactggtgaaacactttatgatcatttgctgcctacgttgttgcaggtgaagtctgattgaacatgaaaaccctccagactgtgacggctacttaaggatccaggaacctggaactcgaggatagcatggattagatcaaatcatcctggttatggcttcactgcgctacaggcttcgccctttgtttagtaggtcgacttctgtttaatattattcatattgcattatatttgcgaaacagagatcatgtgttctgtagtcatagtcccagtacttattttacatctagtaagtggaagaaactatctgcacattgttgtcgactgtattttaaatatctgatgccatatatatgttgatgtaccacctttggttgtcctttgaaccgtggttgatgtgctgacgtactagatgttctgtgttgctgatttatattatgtaaacttagggtgtgtttagttcacgtcaaaattggaagtttggtcgaaatcgaaacgatgtgacggaaaagttgaaagtttatgtgtagaaaaattttgatgtgatagaaaagttggaagtttgaagaataattttggaactaaactcggcattagatctgtactccatttagttgtttcagttcactacgttaactgcaatgacagcaggaatgattggtgtctatgtggctctcaatactttttacccaagcttgacataggtgtatgacgaggtcggcacatatagattaaaatttgaaagtagactgtttattgtttttttctcacaaatgcgtactcgaaatatttgcatggtactgcagcgcggtgatgcgaagtagcaagttcgcacggtgggaagcgagcatgaaatcgtgcattggtaacgcaacgcgaaggcgagatgaatcgtaataacatttgtttaaatagacatttataattataatactccctccctccgattataacccgattgaggttataagatgttttgactttggttaaagtcaaactgcaatagtaatattttcaacctaagataaatttattataaaaaatatgtaattattaatttaatacaactaatttggtaatgtcaaacttatataagcagtataactttaaacaaagttaaaacatcttgtaacctgaaatggagggagtagaacggatctgatttaccttttttgggtgcctcctaagtgggcttcctcttccttgagatccattttcccctttttttttttgacgacaaaattttgaaatcatactgttgaagtttttagaaatatactagatgcgaacaaatttacacaaacataccatcgtcgtggttcggcagtgtgaaatcacgacggaatcacaaatagaccgtcgccacggttcggcagcgcaaaatcgcgactaaatcacaagacgaacacacaatagtgacgaaagcgcgatggcaggggcggtctggcaaggttaaaatgcgagaccagcctcggtgtcactagttggccgagcgagatggccgttgagccttggtctcacttgtgggccgcactggcagctaatgacgcaattaatcatactaattagcgagtaattaattactgatgatcttaattaaagaaataataattaattgctaacgactctaattaattaattaatcgcgtgagtttgtgcggtctcgcggactagccgcgcgagactcgcgcgaggtatcgttcactcacctcccggcctcgcacttccattttgcgataacggtatttctgtcattcccttctaaacgtgtatattccagttaaatcatagaaaaatatatatctatttttcttgttttgaccgtactcctcttcaattaagtaataatataattagtactatgaaaagaaattggaaatataccttttcattggtttttagaaatgtaccttgtcgccaggagggtatgtgtgccatggttacaaataagacatacctcatatcctacgacttatagaatatacggatataacatatctttgcatatacgagatattttcgtgtacaataacaaaatttacgaggtgatatagaaactatcctcacgagaagagaaatgtcagagtcctacttaaaaaggattgggtttatactatattgtggagggtccgttgtcttcgagtcctactcagaaaggattgggtttatactatattgtggagggtcagttgtcttcgagttctacttacagactaaggtgacttacgatataaaaaagacacacccctaagggtctggatcattgaatcatagcaccaatacaaccaccatagcctacaatccggatgacgcgaaacatactcgtcgggagatctcatcgaacccatctcgatagggatctcgccgttaatctcgagatcatcaattctctattgtaatatgtggtctttccatatcaatctcatataaattggattagggctattaccttacaagggacttaaaccagtataatccttgtcttcttgtttgcttgatgtcgtatcgtgtagatcctcgtaccaatgtatccaaataccctatttatccggtctacggatatccaccatcgacaatgtgaactcactgcggtctgcatccatgtagagcgaaccgagcaaacttgttgtggagattatgagtaccatatacctacacgtacggctagtttattcgactgattataggggatatgttatatctctaaaatatgtaacggattatgacttgggtattacgtttccttgagtattaaggaaacggtttaaagtcttaatcgggaatatcgtaaaatatattctctattcggttaggtttgtatctgtaatccgctcccgatctatataaggtgggcaagaggcctcttgagggcataaccacactaaaggtcgtcagatcaatacaatattcggtggagtcaaatccctaaacaagagtcagtattacttttcgtcaagagggcctgaacctgcctaaacccttgtctttccacccatctactttagctctcgtgcactacccccttttcatattgtcgattcctagtatcgacaattggcgcgccaggtaggggttgcgtcgagttttccgtcgacaagtacgatgggttctactccaggagtcaactccttctccttccctccagggcaggcctaccgctttggcagtctcgacttcatcactgacaacttcggcaacatctctcttcttgactcggattcgaactagtcggggaagaggtcgtgaccactcggcaccgtttggcttaccaaattccgccgagatgtactccaacactttatcttctaggctggcttcaaaccactcgggggattcatctacatcagtgcgccctcgcaatctttccaccatcaccagtgcatatcctcaggtcatcatgcaacttccccctctgccacgttcgaatctggatctgtctatccccttaggtcccgatctgagcaagcttcggcttcgcctagattgggcttcagggagatgggcgtcacgctccaaccactcggatcttgttcggacacggagattgccaactttctcagctcttttgacgtctatgacgaccgcaccaccgaaagtctaggaagctcatagttcaacgacgactacacccaattcctttttggtgtgttcatggcagattcgctgaaccaagaggaagttgcccggctagccagagaagctgaagaggaacacgctagacttgaagaggagcgcaagcgcagggaagaggaagaacgcatgaggcgagatctagctcatgctggacgtgcctctcacaatagaatgcttcagactcgagtcgacaacactaatgtcttcgttacacctcaacaaaacaaggtagcggtagtcaccttgcaccattattgacgcggctccggctaacttcaggcctatcctgaacaaagtcaagactatgatcgctgcaatagtgccccccggaagttggaggcagctatcggcctgaggaatctacgattgagacaccgtcccagacccgtctcccactagagatttttttttgaccagatctcccaccagagattgtcgtgcatgctcccgagcgcagcagagggcacaccagatctaatctacaccatcatgaaagacgatgactggatcagtcggtcgactctcgcgaccggcagcacgacagtgaccatcatggtgactcctactacgacggacactgcgcccacactcctagcgatatgaggcacgcgctcaatcaacattattgcgaccgcgaaaatcgcgcctaccgtgacggccaaaggcattcacccgagagaggcgatgaaggtgttccgcttttacactcgacctacgtcgagtggactggccgattggttcacttgggaaataagaggaaggaataagtttacttgactcccttaattagcggccgaatctgattcatatccttaaactacaatactggatatcttgaacctccaactattaaaacgggtacaatttgactccctaggcggttttgaaggatagttttgctgacgtggcgcctatgtagcggttttgatttggtctttattccacgtggtgttgatgtggcgcttatgtgatattagaattaaaaaaagtgtggtacccatttgtcatttacaaaaaaaaattatagggcccactgacaggtgggtcccacatgtcatcctatgtccttcccttcctcctccctttctctctcccttctctctctttctctccccctttctcttcacggcaactcgggcaaggacgcgccgccatgccgtagtcgtgggtggtgaaggcagcggcagactcggcgctggcgctcatgttgagggggtagttgaggtggagccgcgccatcctttcgctcctgatctttccccagccggcggagcgtcgtagatgagcgcgacggaggaggggcaaccggacggtgaggcagattgagggagattgcagcgggcgagcggcgatgggtgaactaaggggattgtggctagattggggctaggattgtggtggcgagcagcaatggtagagggagcgaaggggccagccgatggtcgatggagcgaaccggccgattgcggcaccgggagagggcttcttcttcttttcattgaggtcacgagggccttgatgatgggcgtggggacgaaagccggcggtagcaacggatgagataggaggtcgatgggcgtgggtgggcccctcccgatccagtggcgcgacgacgagcatgcggcagcagtgccctcccgtcgctacgggagggggtggttgtggggggggggcgaggtggtggtggtggtggtgacggcggcggcgtcgccgagagcctcgggaactcctccgagctcatcgtccgccgtgtcgccactctcgccagggacaaggtgtggaacctttccttagacaagctgctaggtgaagatggtgcgcccattcgcgctcgcaaagtccgccacttgccgatgcaatcccctcacccgcctaccaccgccgctccaacgaccgctggtgccactccgccatcgccacggctcaaggggaagagagggagggggaagggggggttaaagaggtaggctaacatgtgggtcccacatggcagtgggtccacaatatttttcgtgaatgataaatgggtctcacatatctatactttctataaagttatagcccactaagtttaaagctcaacacacaaccatgttacatcatcacccactagcaataattacatatttaacctcatgcgagcatacaacatcatctacaaatttatttaattatgcaatcaacatacaagcatatccaattatcacccctcacatcatttgcacaatattttaacaaatctatctattattttttttataatatttaacataaaattatcaatatgtttcacattaaagcgcgtgtatcatttgtttatttcatgataagtactgataaaccctaatgtttcattatttttttcctttttacttctagtttgattgtcaaaaaaatatatattgagaattgattagtaatttacgcagcaaagcgcggggaatcatctattatttttttaattctaatgccatctaaacgccacgaagtacgaaaaccaagtcaacgctgccacgtcagtgaaaccgtcatccaaaaccaccgtgggagtcaaattacaccggttttgacaattgaggggtcatccggtattgcggatcagggatacgaattagattcgatcattagttaggggagccaaagttaacttattcctaagaggaaatatgacttgggcggacggcctccgcgccgtgctgtgctcgccatgccttaccggcccataatgcctaggtggtgctacgacggcccatttgccatcgtgctcgtgccgtggctggcgtctcccgtctactaccgtatttctcctttccccgaccccaagcaaagcacatcgactcctatcggcggtcgcgcgagctccagcgccaaggtgcgttcagttcatccgattccctcctggatccaaaccctaattttcgctggcctcaccgatccttgcctatcctatccaggggatccgttgcgtccggcgggggttaatttcttgcggttgtaggatccccgatggcggatacggcgaaggccgatgcggcggcggaggcggccaagatggacctgctcgaggacgacgacgagttcgaggagtttgagatcgaccaaggcatgcaccgatccgtttccttgtcctctattcttttttgttgatgatgatactgctggtgatgtatgggtctacttcagatctagcgcgtcctactagatttgctcttcttgcaagaggtctcgccgcaacgcaatcgtgtggtctacttgtctgttcagtgatctggtgattagtgtcttgtcatccctgtcaaattactcacctagcttagtagctttaatctgttggtaaataacaagaacaaaactacccgaaaaaaaaaagaataaaactagctcaccataattctgtctgtctatgttcttttaaaattcagtactattaaggatccgttcttgtgtcagtacaattattatagtcgcacttcgccactagtcagagaattcctgtctacgccctccaaaaatcaggattatggatctgttcttgtgtcaatgccgcaacttagggaattccaatgtgctgtccgagcggtatatcacgtcggctcgtttgtagtatgaaccagtgttttttcatgatgtttatgtttattggttcctgtatctataagcgcaaagctcgtacataattatcacttgcccatgcttcaatttttttcctctagcatatgaagaatggtttgtcatagaagttcagcaacaattttctttatttccatcctatgatgatgtgatttgccttcagccccgagttcttgacatacaagtgactctttttgggccgtccgattacgcttcatttagttctgatggtcaaatgatgctcaatatagatgataggtagatgatactctgtagttcagccacaaaaacatttcagggtttatttcaataagtatgcaattttttttatctcaatctgttccttgcaacatcccgaacaatatactggtatatttattgttcaaataatacacatgacatacacttgttactgtatttctaacgacatctcgtatacattttggaacttcagaatgggatgacaaggaagaaggcaacgaggcagttcagcaatgggaggatgactgggatgacgatgatgtcaatgacgacttctctctgcagctcaggaaagagctggagagcatcccatcgaagaactagaacttgtggtcttgtattcagtactttcagataggaagtggtatctgctggatttggcatgtttactgttatatttaccaactcgagcattttgcttgttctgtggtatgcctttccgttatacattttattaccaaatacggttcataaaactatattgcctatgtctagaaagtggtatcggttgtagaaccgtaatccatcaactggctgaacctttttgttccgtgaatgcagaaaggccattgcttagtgttttttttatctaattaatgtgaagataatatgtttgttacttgtgcttcggtagtgtaactctggaatacgatgaaacatgatgaaaatggaagacatggacatgaaaggtgtgattaacggctggtttggtttgtagcctaaattggccttaccaatatttggcaatttcaatagtgtttagtgactttgaagttaaattttggtatgcctaaaaaaataagtcatttcaatagttagcttaggctattttggtttcaacccaacacaattttgtcttgtcaagattagccatgtcgaaatttaacattgataaaaattagtcttgataaaagttggaaagatcaatttagaccacaaaccaaacacgtctaaaagacattgttcggtgagctgatcagcatgtatcgaatagcttggggattgtggggttcacgcagacgttacagttttaactgaaaaagcataccatacagttacttttatatagaaaattttcatgcaattacttttatataaaacgttttcacacgaaaaatattggttaaaaagtatgctgacgaaaatcaaaataaaatctttaacttaataataaaaaagggacatcaagcccaacaaccatccacgtaactgatcatatgtcctcaacctaaatcaaaatcaagggaaaatccttagccacatcctgcaatccaagggaggaggatcctttacttgccccgactttaggtcattgacagataggacagatagattcataacaaagagggtttacatgtcagtaacttaaaaattatgtaagatctcaaactatagtggcggagttacctcccgggtaggtcgagcgaccgtccgggctccgttcctgccatctgcaccgtcgatagtcgtcgacacctataaaatttaatctatcagcgagaaacattattagttgtttgggcttgacgacgccgctggctctctgtcaatctgcaatccaagacgtagtcttgacccttgagtctttcacgaattctgctgatcccctggccaatgcagcacggggtagttgggttgggtccggacgcggcgcgcctccacttcttcggcgtctacgaggacggctctactagtactagtattgcatcgtcgccgtatcggatgaaatttcgaggtttcgacgaggtttgaaagtagaagtcatctgacattttggtgagtttcatccaaatttaaatttgaattgataaaaaaagaaaaataatcaaataaaatcttataaatagtatgatatttacaaaacctgttgggatataaattttcaaaaaaaaatgatgtattccgtgtatttactgaaatttacagtagaaaagaaaagaataacgaattaaaaaaagaaaaaaaaatcagtttacctctttttctgattaccgattgaaatttcgatgatttcgccaaagctgaccggttttcgcgagcttatcggtaagcttagggaatttgtatttaaattttggtttataaaatttattcggaatctatcggctttataccggatttcgtaaaaaaatgttattccgccgtaatccaaaacggaaggtcatctcgacattataaaccctgtacaactacagcaccgccccgaaacaaacaatatccaccacctagttgctgccacctcctgagaaccaagcaaagtttccgacctcaccttgctttttgatcagcgtgacgctgctgcatcttgttgggaacttttcctctcctctcctctcctctctctctctctcctcttcccgaaagaaataaaaccaagcggcgccgaaggaaaggcgagcgccagggccatgccccaaatcgatctcgcctcgagctcgaggccctcgcgcccgcggattccagccgattgaatcccccccacccctaaccccgttctctcggtgctctgctcgttataagcgggtggcctttagccctaggttttttgttcgattgggattttatatatcccgcttggttgggggggggggggatcggatttttcgtttcggtgccgcgaggtttgcgaattctactcgcgtcgtgcgtccgattctgcgctgtttctgttcgtggattctgttgcggtttctctggcgtaatctctgtgttccttttcctctctgcaggtgccgggggggtttcctcgattctggcgcggttttgcttagaggaattccggatttcttagcggaattctgatttccgggctgttgcgaggtgcatctaccagccatggcgccggcgccggccgtggatgcggagggggagtgtggcggggggaagagccacaacaccctcaagcccgacggtgttcgtgtagctgcagcctctaccaccctggactcctcggatagccatggtccagccgctgatgttcagggcgggggtggctccggcgagaggttggactcctccgacggcgagggacgagccacggatgttcagggcaggagcagcgccggggagagcctggtggtgaaatccgagcacgcgtgcgcggcggatgaccccgtgggtgacggtgcccttctcgcccctgccaacaagcctactggcgcggaccctttggcggtagcatcctcctcgcatgacatcgatgcggcgagtgctgatcccgcaaacgacgaggaagacggggacaccacggaatgctcgagttcatttgggaactcttgctgcgagaccgatgatgaggctgaccatggtggttcggaagtggattctccattttcggagaatgctgatggtgttcaagcattgattcggcctaggtgagcttgtttattgattccaatgccttgtatgcactaaatgatagattgattttattgttgttggaggaaattaacaagtataagacggcaactggagactaatttactactcagttaggtttcccgcgcttttggggatcttaaaaaggaaggttgtattaaagtttcaactgccaaaccatatcgtaactaggattcgtatatctaaaagttgtatgactagagcatataaagttcgataatattagatgtcttcgtatatcatgtccaagtgaaacttcagatgttatttatttactaacaaggtgccctgttcacttgtacagttagtctcattctcaatatttgtttcagctgcatatgttttttatttgttggccatatattttatctattgtgtatggatggatataagtgtgtcagatttagtcttgttggtcttacagatgtagtttatgcaaaaatgtggtagtacctatttcctcgaatggcgcttatgtgaaagtataacagtaataatagcagactctgaatacagtgaacattgggaccttttaaattactgtcagacttctctcacactatgttaaagaatataaataattgtgagtaatgaaaattgatggaaattactcaaattggaatatggagcagtcataaccagtgaaccaattaagggctcaattagaacacgagaaattaaagcttaagaatagaagaaaacacaagaataggaaatgaatacaatgcagaacataggattggggaatccatgaatttcattggaacatagatgtttagattggtgacaattaaaaacaggaatatttagaagtgaacttgtgtaattgcatacatacagaaaaaataaagaaagagtgaattgcactttggactatattttattacctaaatttcatgttggactaggctttaacactccttttcacattggactatgttttgttgccaagcttttgtactttgggctgctcttcttcctaagtcttcctgagcaaacatggcacactggctaactcctcgcctctcctcccacatattgttagcttcagcgctagcggcatcggggtgggtaccagatggaggctttggaactagtcttgccgagggataaccataacctttatccatgcccatacccttggtaaacaggtagtgtatgggtaaaatttgctttacccattagaaatgggttgggtctggatatacccatttataatagggtgggggggggggggggtggggtgcccgtatacctgtttgaccaatcttatctttctctccggttgcttcttccccaaatcctgagagaagctgacaccatggcgtatccctcttcctcgatgaacaccttgcgggagtgcaggacgtgtcagctcaccagtctcgtgcagctgccggacctctttggcgacgctgacgaggtgatccctgacgaggagcagcaggagggagaagacacagccccgtgtggcgagcaacgattggttctcctgccggagcgaagtgtccatgcgctcgtccacggccttgcggaacctgtgcagcacggtgcacgccgcagagtgatgtcgtgtacattcccattccgttcttctgctgctgccagctgtgtggctcctcctggatcctcctcaggtttgggtggtgccttggcggcacggtggtgaatggccagatacgttggcttcttggagaacggcctgacaaaaccatggccaaattcatcatctctgcattttccaagatcttggctccattgttgctagttctttgctttgcttcctggttagatcgttctacccaattacccaaatacccactgtatatgggtaatttgattaatggggaaattggggagggtaagattggggattctgttttatgggtatgcggaattggggatgggtatggccgggtaatactcatataccctccccattggcaggtctaatcagaacagggtcggcgctgagcctgggcagctacttgatgtctacagatatcctccgaactgacaactcatggatgcatagagctagcatggccaggaacatgaaccagcagccagtttgttcattgcgtaccttgatggctcgatctcaaagatcatagccatccttcttgctttgtcacattcatatgcataccttcttgctagcatttgtcacatattcatatgccatgcttctgttttgcgcatgtaacataagttcctcgtgcaacctgaagacatatcatgccatgttgatctttgtcatatattcatacatttttcttcaaatttgtgtatgtaacacaatcaaaattcatacattttgctttaaatttgtgtatgtaacataagttactcccacaatctaaatgcattatatgtgttagctttgctataaatacacacgttttcattttttttaaaaaagaacattatacttccaagtcgtgaatgtaacatacatatcagtataccagagttgagtcccactgtaacttcatatgaaaaaaattctattaattttaatatgctttcatattgtgtcagtgtttaacatgtacaaactatctttcagaaagaaaaaggtaactgctgagtggaggagtgctgtccgcccaatgatgtggagatgtcagtggttagagttgcgcatgaaggaccttttatctcaagtgtcgaagtatgaccgagagcttgctctaatcaacaaaggaaaagaattgcagcaggcagtaaacatgacaaatggttctaggtcagaatcagcacagtcttccaaaagccgtgaaaatagttgtatggagaggcgaaagaggagaagacttgaagaaactgtgaatacctcattgtacatcaagaagcacgagatattgtcatacttctttggtagggcattcatttcatttttctaggaataggataacagtttcttgcattgtctaatcttgcaccaggttcctatttgttggtaatgaagttcttgcattctttaacagataaacagaataagggtgctgaaacagatggcatcttaattgatgacgatagcagtggcccaggtatgtatatggtagtgtgtccacttgtatagttgtgctggagtttacacaggaagcattgtagttagcaaaaatttgcattaaaccaatctgcaatttacctaattatgtgtgtcacatttctagtggttaattgataatagagtctttaggagcttaaggactgttaaatctatcattagctaagtgcttgcgtgtcgcaagttctcccctacacttcacaggttcctctcccgattgagctgcttgttttcatctcctctttgttgtattaatggatggtatggccttgaatgtgtaagaacttatcaaccaaatggagatgaaaaatgtaaaacattttgctgcatttttaatttctaaatacttaaaaacacaacattgaaatagaccatagcaacactgtactgatgatcaggtacaatgcactaataactaggtgttgaatgattcatctgcgcagcctatagtaatcagaatggcatgtgtgtcctcgccacgattgccagcacagttgaccaggacccagcctggtgtccaccaatgcgtgttgacgtccttgcctagaaaccgtgcgggcaacccacgccctatcgcccaatcattcattgcctgtccgcatgctatgctttaagtctttcccaggtcccaattgagatcactcccatttcctgactatccattacccaggtaatcaacagaacaatgcaactctagcccaaattaggtggtaaacataaggtagaagtttgatgacccacccaacttctaagcctgaccagttaatctaagaccaaggcagcccagtgtggcatcttattcttcccagtcccagctgccagccatgtctaagaccaagcgtacttgctgccccttgccagttatttgaattagcttgctagtgtctatggactgggtacctggggagttccaatttaggtggggctggaacgcccacaagccccaatggtaagttcacagtcacggagaaaagcttggctataaatgacaccttgctggtatccttggtaaaatgtatgtgtcttgttaatgattaaaagtagtatacatctcattgtcagtgtgttacccacatctttccttaccgcgatgtaaacattttggtatcttcgtacttttatttttagtgttatccattataattttggattgaactaatgaagggcagcatacttgagctattcagacattggttatgttggcattgcaaaatgaaatctatcttcattacctaatgtctgaattttacatgatttctcattgccaacgctaactctttatacgatcgattcctacagttggcaatgatgttaaaggtgggatccatactgttgggttgcttgagcccaaggaatatgatatggttgcggagcaactcacactgcagaaatttcttttgacaattgatggtattcggtcccaagttcttcggctacaagatcgtctcagtaaggttcgttcaaaacaagaaaacatggtttccttggtggaccatgcccatatcaaggtgtctgagaagaggctaaggactcaaaaacggtcattctcatataagaaagatagatatagtaaatcaaagaaaaagaagaatctaaacattttatcgaaggaagaggataaaccagctcatgcagtaatatctactttgtctaagagggcaccagattgccaaacagaagttacaatgtacagtagcgaagaaaaaagtggagagaggtgccagtcacataagaaagccatcactgtggatttactccttccaaatggtcatatgggagatttgtgcaaagtaagtccttgatcctttccttatgatgtttttatttgattacttaacttccatacaaatgttttgactagactgaacgaatgttcaattgacaatattggggatgacaatcctcaattttcccattaacagtagagagaatagcacttctttttttgcatttattaaaatagtgtggatttcttggatcgaattccaataaataatgcgtgtcaaaaagtgttattctccagtggaacaagaattggagttaggtgtgcatgtgggccactcacggatacaattatagttgattattggttctacgttctgcatatggttcttacgttagtggtaaagtagggttattgactttgttgttcccctcacccaacctagtggagtcgctgattgtaagtctaaaaacatgggattgggacccatgtcagatgtgcagcatggtaatgcatgacatgagttgccttggactagtgcagtatttgttactccctccgtcccaaaatctagcaatctgtccagattcgtagtattaggtggtgtctaatcgtgtactaggttgctatattttggaatggagggagtaggattcttgcagaattgaaggaaatcagttcgatgtgctaaaggaattcactctttggttacgctatgcagttctagtatgttgtatttctttggaacaatggaattccagtgcccagatagttttgattatctcatattctttatttcttcatcctacaactgtttgtgatcaagaattatttggttgggctgtcaagtttttcaatgttagcttactcttcacaggacaatgatgacgtcctcatagacaatcaagcagccaatgaaggataccagccatttgagaacgccaagcagccgatggataaatcattagaactaacagagaaggtctgtgaaactgctaatttgagagttggaagtaactcttcccctgttgaagtcacaagcacttcagctccattcagagttgagaacgcttctgtttccctggaagccaggagtacgcctggtcaagtggtgaagcaagaaccggtttttgaaaaaccaccagctttgaagcatgtctactctggaaagaggaggcgaaaacttaaaatgaaggagggtagtggtcctgtatctggattgacccagagtaaagaggcctctaaaacacctgctacaaagaagaaaactgagagcacatccccagctgcaaaaaagctgaaaattgaggagaccacagccccagatgaagggaagaaagctgtgaagactcactcaactggaaagaagcgaaaagctggaaagtcatgctcatctaccaagaatcaggaagctgagaattcatcctgtgctgcaaggaaggatataagcgaaagcaccccctccaaaccgaggattgaaaaggcagtcttggtggcggtgaatagccggagaagtcagagggtccggaagccgaaaatttactgaaacaaagcagtctctccaatttcaggattgtgtatgtatcacagacgcgtctttttatgttttccgtgctgctgaaatttatttctatacgttattatgtgctcgccatgtaagttagtgtatatatcagcttgtctagataaagagggttcgtaatggtttagccatacctttttcttttgggctgccagactaaatagtacagttatcttgtgctgtctaaaggaaatgtcgtgtttgatactgttcatgttgtgcttgtactgcaaagatggctgcagccaagatggcactatttcgatatctggtctttttagtgacagcatttaggtatgaccccctggctggctgctagctatttggatcagagttggccgcagggctcgcaaattcaacgaacaccacatttctttttgcagtttttgatcgatgtgagctggtttgaatcctgaaaaagaagggaactcggtagaattcgcaaaaattcaaattcaagctgaaaaatatggagaagatttgaaaaaaaaacaatcatggtaatgctacatgacatcaaaatctgttaaaaatgtgaattttgatacttcaacaataattaaggaacaacactttgttatattttgttgaaattcaaactattatgttattgatgtcatggtctcatggatactataatattcttcagtcatattatgttgtttgatgacatagtaataatgttggtgctggcactttaaaattttggattactgttataatgtttctaattatgtattggattattgtaatattgtttctagttataatgcttttaactatgtacattccactattatatagttgatgtcatggatattataatattatgttatttcattgacattataacagtgctgatgatgtcatggactttaaatgttttaagtattgatgagctcacggacttaaattaacttttcaatcatagctatgcttttaactgtgaacacccgttactattatgctatttatgtcatggacattataatattttgttttcatataacgttgtgtgattgacattataatagtgttgatcatggcatggatattaaactttctaattgctcttctaatgtttctaattgtatacgtgcataatcacatcaatgtcaactttattgtctataatctggtatgccaaaattataatgccatgccaaatgtttctctcttctccgtcattttttcaaatttgtttacttttatttttttaattttcatttttccatagaaccttttggttgtcaaccaaacagtttaacaaaaatattatgtatggcttttttccgttccccaaaaaatatgtacaatttttgcttcaaatcgatcattttcgttacaaacgatcaaaattcgttatcgattcactcgaaacggatcatcaagatccaaatatcaatatgtgaatttcgttagtccactgtgtttcacaatccaaccttcaaatggttttgtaaactctgattaggagtcaagttaaaatattcaagagaattctactcaattccaatttctagaatgtgtcattgtataggtcattttcttcctcatgtcatccatgttaacttattgtttgctatccaatgtttggcgtggatattttttttacacgtgcccaaataccatccctcaactctcatattgtggccttgctcaaggggtggatgactcaggtggcagaacccctactccaatctccagcagctgctgaactatgcaatttaattagcgaccaatctagatcgcggctgccttaggtggggtgactctagcttatttttgagtattggtcactcccgaacagcacgatccctgcacaagctccaccatagtgtacacattgtccttaagacatctatcgttgtgattctagtatttgaagatgcattttagtgggcaagatatgctttccggaatggcacgaaagagattgtgttggtaaaatatagtagaatttctcgtaactaaatttgatgtaacacagtccgtactaccaccaagtaaccttctcttcatgagcatttgcgtccattgaacccatacaggaactttgaatagttggatgcatgtgaattctgagcttgccaagcatttatctgggccatgggcatttgagaacagcgcttgcagttatgccccacacggatacggggctgcagttgcaagcaagaaatgaatacgcgctgaacttaatggtaaagataactcatgatgtacattcctgggctaagttggctgaaaagaagggcgatgccagatactattactgttgctatcgtaggcgtggaccatgcaaagattgaggtcatctaggccgtgctaatgatacataatcccattaattgcctacatgtctccattcaattcttgtacatagaacagctgagcgagaatggcttctgaaaccatgtggtagctagtaccgagagaaacaactagttcttgcattttagcggaggagaacacttgaatgcaattgcaggagaggactgcaggcagcacgttgcatggtcatctcaatctcgcacacagactgaacattgggcatggtttggaacatgggaattctctgataaattcctataaagatctcgtatgatattctctgataaattcatgcgttttacactaaacctttgccggagatagttcgagcaggactatccgaagagtcattttctgtttacacgtttctcaagttattaaattgtctattttttttaaaaaaaattccaatatataagtttctttaaaaagttaaataaatttatttttaaaatttttatagctaatacttaattaattactccctccgtactcgtaaaagaagtcgtttaggacagcgacacggtctccaaaatacaactttgacttcttgtttctataaaaatatttatttaaaaatgatatatgtatactattatgaaagtatttttcaatattcatataatttttaccttttcaaactcaataacttaagaattatttataatttatattttcaaggtttgacttaaatattatcctaaatgactttctttataaatatgaagagagtatgtgttaatgggtcacccgttttacgtgccgctatcatctcagttatagctgacaggttgtgaaaatacgaaaccagagatactactgtttagtgaaagtggctaaaacttagtcctgtgggtgtgtgctgtgtgtataaatggtcaaatacggtgggtgtacactaacacttagccaaacatggtggcatcgctgcagttaagagtgttgctcgatggaaggaaaaacaagcattctactggtccattgccgttgataagacgcataacggccttccattgccgttgataagacgcataacggcctgctatctctgtacaaaagaaaaagaatttaatcttacatatgaatctgtagaagtgattatccagatttatttttattttagacgaagggaatacgtgactcaactgtgtggttttcttctgataggagaggagagaaatgaaattggacaaaagggtgaaacacatttataacatcaacacagagaaggacaaagtgcatcttgtgtgaaatacactcgtctaacactaaaacgggatcggttatctctgatgggcttaaagccttatctctttcgggtagagccccgtcactaagcaaaggtcactgatatgagaaaatatcttaatcggacatccgcccgtctcggatgacacacatctcaaccgggccaacacaaaaacccgtcacggatgactctcagctcaatcggacctaaattttagggcatgccaaattatagcccatcacagagagtataataatttttttttttgctttttggctagactcagaccttgcacactttgtccttactcgtgtccactccccggtcggtcacccatcccgaaattgctccaagccaagtacgctaaaccttaaaattctatggagatcggcttccggaaaagaaattgtaagttgttggtattagtattctattaatcctattaagccctgggctaggatatcacaccccaacatcccccattcatatacattcattcacatacacaaccattaatatatttaacacaaccacattcacataacatccattttgatcacatattttacatatttcaccgcaaaaccgagttaaatggatcaaatatatatttagcaagtattaacaagaagaggaagcaaatcagatttctaggcaaaaatagatttcgaattaaattttatgatactaaatgaactcatatgaaaaaactgtcaaaaacaatcttctagaactcattgagatctaccaattttattttggtcatttttccatccatgtttgatcgaactatataaaatttgaattttaaaatataagaaattcaaataatttttcgggtagtaaatgatttcaaatggaaaaattgtcaacaacaaagttgtataactcatcaagatctataacttttatttttgtcatttttctatataatattttttgaatagtttgaatttgaattttgaaaatatgacaacttcaaacaatattttcaaataatagatgatttcaactaaaaaagtcatcaacaacaaagttgtataacttatcaagatctataacttttattttggatattttttctatataacat

SEQ ID NO: 57780 - DNA, 4775 bp, Oryza sativa
cccttcagatctcatgcacgttcagcgtgtactatctgggggtacacctctcgcatggcctgctgtctgtcttgtcagttatcagccacaagcatatattttaatattaaattttgattctagaattgattttatatttttttaactttactttttagcattttcttttaaaccacaactattatcccataaatatttgtacggtttattctcatagcagtttgtatgctgcacagttttatggataattggatatacagtaggactttcatcgtctcataataagtttatttttagttcttttcatttgttttaaaataagtttatttgagctattgaagtttgtgaacttatgatatataaatgtacttagagtagatgaaatttaggaaaacaggagtattatagtcttttttttattggtatgtgtggaattattttagaattgagaaagtacaatgcagtaccgcatcatctatagtacgagcaactaacaaatgaggccgggcacgtatatcaatccctatttcgatccatcagctcctacaagtgtagaggcaatattggaaagaaccatgcctatataaatctgtgttttttctttttgtcaccatgtaatgacgcatgcaacaagatcctgaggtattcttgtgttcatgagactatcaaggcgtcaatcgaagttgcctgtctccttttggtgaagaacattaaggctatgtttagattcaaactttgaattcaaacttcagtcctttttcatcacatcaacctatcatacacataacttttcagtcacatcatctccaacttcaactaaaatccaaactttgccatctaactaaacacagcctaattggaatcctcctccaaagtgatttggggtctggaccaatcaggtattcaggtggagtactacatattttcgctgcaaggttgttgagctttgtgcttagtgatgtgactgaccttggccggccggcggaagccggcttaagaatttcttctcgttttctttttagggcatgttgaggttccaaataaaatttttcacgctgtcacatcgaatatttagacacatatatagagtattaaatgtagacgaaaataaattacacggttcgctaggaaattacgagacgaatcttttaagcataattacgccatgatttaacaatataatgctacagtaaacatttgctaataacgaattaattaggcttaataaatttgtctcgcagttttccggtggattctgtaatttattttgttattagattacgtttaatactttaaatgtgtatcaatatatccgatgtgacatgtaggggaaaatttttttgccaattaaacaagcccttagaaagggaagactctattaccagaaatgattgtgacattacaagccaaaaaaatattaataagtatatcaaataacagactattctttctttagataagtataacagactattctgaagtctaccagggacggcaactggtagtctggacaaagcgataggaaacagaagccgaatctgaacgaaagcaagaaacgattccgctgttgctgcttcacacacaatcgaacgaatgggacgtgctatttcacgctgcaaatcggacgcgggcgggcgagaggacggggttcgaagctctggaaatcggaagtactctctccttcacgaaaaaggcaaaccctagatttccttactaacgtttgactgtccgtcttatatgaaatttttttataattagtatttttattattgttagatgataaaacatgattaatactttatgcgcgacttattttttaaattttttttataatttttttaaataagacggacggtcaaacattgaacacggaaaccagggtttgtctttttttgaacggagggagtagtaggtaactggagggaggtaccactcgtttgctttactatacgagtacctgagtttcgattgacgcgtgtacgtacggtaaaaataaatgaagtaccaggcaaacccccccccccccccccggccctctcctatgtagcttcgcccttggtaggcagatgacgtaccaaacgaaccgacggaaacatttcatatgcgcatgtactctcgaatgtgtctgtcgctttaccgtacgatacggccatcttatctagcaactgacttttagaaccggtggtggaattggctaatggccggagctgaatgggagttggtcttctagtttttggtgatgtttgtttgaagggtagggtgaatgaggcagctaaaaagatgaaatattctctcaatattcacgatagagggattaggcttattttaccggattaagacatccaccatgtggatggctaaatggactgtccagccggggcatgaccagacccgagcctgagatcagttgggtcagcacgacttgacctgcatgtcgggccgggccatgcccacccatgggctgcaccaacaacccaaacacagtccaataagattcgggtcgtgccgagctggctcgaaggtacgaaagcccaccgtgctcctccttggaataagtctattttatgtccctcatatctttgggccgtgtcttatatggctggaataagtctattttgcattctttatctctttgggctgtgccttatatggctaaaataagtctatttctctccctcatctattttgcctccctaatcattggaacatgtcgtatcgggatggtccaccatgctgaggcagaggcccaagcacagcccaaaggttgggccaggccatgccatgcctgggccaggttgtctagcctcaggccttttggcaatctataatccaccttgtctagaatactaattagtgtatgattactaagtaggttaaattatgattaatgatattaaacatgtttgatattgattagtaattagcacgataaaactagtgtaaacaagtgctaatttgtattattaattgtatgacttactattattatagcacttctatatctgtacctaactaaaatattcgtattttccctttagtcacacttttttcgtccgtccgattccctccatctcagcacgtgcatgcgcagatttgaagagaaacagactcgaactataaagctagggtttctcttccaacatctatacgacgtggttttgttttgattcttgggaaaacagaaaggggagaagataaggatcaaaacccctcactcaatttctaattatctccatggatgtggactgatttcacggaggaggcggattcaggcgtcatcgggcagatgcggcaatacggacggaggtaggagacgacccggtagcactggcccacatgacagtaaaagaaggagcgagggaggctgattagacttgtagtgctttgctgggccggatgcgtacttgcgggccgaggaagaggggaggagaagggagaaaagtgggccggctaggctgcaggccgaggaaggaaacgggatgaaattggcgtagagagaatggagagtttttatttagatttttttaaaataaattcttaaatgatgtttgtattattaaagttagcaattgagatctgaaaatttcaagaaaattccagagagtgtaattaatcatggagaacttcattaaaaattaaatttagctatatcattttatttccacacttactttacttttaaattaatttaaacacctacctacttaaaaaatcaagtattccaggaaatgtgtatttaatttaattacataatgtaaatctttctcaaattctcctcaattttctcatcttttcttcccgttgcaacacacgggcattttttcgaggaagatattataattaagtttattgctttcatccaatccatcctcatcctaccaatcaaataagcttatcccatcctaaaaaaaacttagcttcatcctctaaaatatagatggctatattacatccaaccataaccttgaaccaaacataccctatccgattgatgaaacactagtgaccaaaggccaactcaagagactagaccacttgcacgacaacctaggacccaggttggtcgggggctatcactaaccaacctggagaacattgtcacctgccctcacgtccaactcgcatacggccacaccttacctcatcatgagttcatgactaagattatttaagttgtggtcttatgatcttctcatcttctgatttttgcatcaatttagcctaaaacttaggctaggattttgtttcactcttatttaatttacttcacaattttagatgtttatcatgttagtaattgttggtatttctcaatgtcacagctagaatccgcaagcgcacggatatactgatgtagcacttcccctacggagtattccaaaggtatcaaatccaagagaacgtgtatgattatctcctcgttaggttcatccaaggacacaaagctaatgtgggcagagggtagagaggatttcctaatgagaaacagtgtttaaggaaagcttaactttaatcctaacgcaatacttcaggcactggcaacccgctgttaccagatgtcgctctactacgtaaccggacagggagtacttaagtgctcttgagggctgtcaccacctctacacctacctcaaacgtactatgggatacgcagcaacaactgcagattaattatctagacaccgcatctacgcaattaataactactctagtgccgatcaaacactaaagcaatcactataaataaatagactatagtaaacaatgatcccgta

SEQ ID NO: 57781 - DNA, 685 bp, Oryza sativa
aacttttggacctgtaagtatgcattttctaatttgcacccgtataaaaaactagggtatatatatttgctctcgagatgtacgcactggtgaagaacacctggcttctgtagcagtggttgatcgttaaaaagaagaatattgtgctgcttgcaactctagctaggacggacggggggcaaaaatgctgtggtgcaccgtggtacgcaacgtaccggaagactacctaggtaggttcaagtgagtcgcaccaatgcaatgcagtaccatagataggattcaaaacctctctctctctctgtagagcaaaaaagaaaaagctagcacagagctgctcacttctcagtatagaggcagaggcagagacgacagaggcagcgcgattctttctttttggcctcctctcctcttgtctcgctcttcttcttctccctcttcttcttctatgagacctcgctctactctctctggcggcgcggccacactgctcttcttcctctgatcgagacctctctcggcggcgcgcacactggtagcgtggtgagcggagcggtacactccctactccccagtgcttcttgttctgtatacgcatcatgttcttgcatctcacatcttgcaatgtttttcatgttctatccgcctccctcttctttacaatctgtttctcgatctattgtgtgct

SEQ ID NO: 57782 - DNA, 545 bp, Oryza sativa
gcctgcaggtcgactctagaggatccccctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagcaaaatacccgtgcattgcaacgggttaagaaagaaaaaagagaaaatttaccattgtcaagcactttgccatgcattttttctaatgaaaaaaaaatctagattacccctaaactatcatggtcagccccctgaacacgaataccagacatttttcaccctcaactatttaaaacggaca

SEQ ID NO: 57783 - DNA, 4586 bp, Oryza sativa
agggggagggcttggggaggaaggcgtcggtggcggcgagggagcggagggacatggcgatggaggaggccatggttgggaatggaatggaagagaatcgaaggaaggggataagaggcgacgattttggggggaggagaaggttggttgggttgggttcatgaatcatgatatttccttcttctcctttcgctttccttatcccaagtccatgggcccaaatcacggcccatataggagtacgtgcatagccatctgggccgtacatattttaaaataaatcgacaaaagtgaaattaagctttgtttatataataatgttgtgacttgcctgtaattagaatagggattaaattttatactcttaccactggatcactgattagcatgacagttcaaccatgccattgctccaaaaaaaaaaagaaaaagaaaataagagtctcacaagctattggcagtgaagtgatataatgaagtaaattatatttaaattaaaatagtattctgctaagtcatcagactaggcttgcattgcctacacaaccactttgtaaaataaaaaggtttacagtggcctgcccttcccctaagaggttaatagtatctcccggctctgaaactaatccaagggctagctttgcggtactgtacattcatctgtcatttcccctgcgggcaacacaattgtacaaagtttcctcagtcgagttcaattcccagaagttgagttgaatgaaaatcatcttggttcagaaagatacctgtcctgaaaattattaggtagaaataacaggccttggaggagggggaggaagaggcatccttgaaggcgcatctgcagccagatcactgaacaccacaacacaataggaaaatgaatcagaattcagaaccaaaagaacattcctagcaggtagcaacaggtgaaaccagctatttgtatcttcagttcctgtcagatatgctacaaacctgatcctcttgctgattatggctgcgtactggctcggtatcttcttcagcgcttctaaagcaaattgttcctccttctcggtttcaggcatttctcttgacattattattttggtgaaatcaacaaactgcgaagacaaaactagcttaattatgagcaaatcctcccatataaatcaatgttgtgatgcccaacaaacacctggaaattgtcaaacagctgtcgatcctcctgacagtgcatcagctgctcatcccatggaccatcgcccactccgacaagcacgatagaaagagggaaatgagtgcatagcataagtacacattttccttactcaaattcaagtatagctatatattttaaaagaatagtaagttgcaccttatgttttttttttcgccgggctggcggaagccagccgaagtttattaatatagggaaaaaagttgcaccttatgttcagtcagtacttttagatagaattcagaaacatctaatctaattagtgttgccactatgtacctcgcctgaacaagagcctgtagagtcctttcttccaggtagttctcatcccgattgttcgcagagttagcaccacaacatcttggaacctgaggtagcatgagcaaaatacatggattaaaaaaaaactagtggaacaggtaaggtgtcaataagattctggaagaacggcaacttcttttcagaagttcagagaaaaaggcacacctgcccatcagctattatcagtaggatgtgatactggtagccggagtcctgagttattctcattgcagtttctattattggagctaaagatgtcggacctaaaccacaactcaccagttatctttctgaagaagagagatgaattcatcgttcatccttcgcaagaatgaactcgtcggtcacaatatagatacctgacagccggacacgtggcgcaatttctctgtatccccttagaacttcagaaacaccattgcaatactgtcgcctgcccgagtagaagctgaagacattttggtcgtgcgtcgatgctgaaaatcacttcatttctgaacagagaaatgcagattgcagagagaaagaactagaagacgatggagaagcttttgcttactgtccccaaatccaaaacatgggatcctgttgtcttcgtcgaacgtcgataaggtcttgccgatgatactaatcgcttgctcgtacgggttgagggagtcctctgaaatgtgatgcaggcttctcccgttgaaacaatgtttccctgaaaatttccacccgctgattaaaccatgacgtgaggcaacactgcaacaatgagaaatctcgattcttggaagctaaaaatatatgcctgtccactcattgcttttggtgaaatccactccaatgataatattggacgactcgagaccgaccttttcaagagcttccttaacctgcatggatgaatcatgcaaagataactcaacaatacacttctgagtaactggatgataaattggcaaatcatgcaaaaagttcagttcaagaactactcatacaggctgcaactgacctgatccaaggtatcatatctctgcgaatcccaggagttgttgatcctcaggttgccgatctcatctctattcaggcgtacagtccaagaataaatggtccagaacagcagcaagaaagtagaaaagaacatgccgattctcgaagaaagaagaagactgtgaagaaagagctcagcacgaagatgaaggcgtttcacagtagcatggtgagcctatatacagtaacgaaggaagcgaatcagctgaagcgaaggcgagcgattggtcgtcaggaagcttcagagcaacaactctgttgatttaaaattttagataaaagaatatggcaagaacgcgcaagggttgtcgctgtgtacgctgaaacgagtagatggtggttgccgtgaaaatactaggctcaggctgttttacaatgcttgattgcttgatgcatttttcattctttcagtcttcagacaaagtgcagctgttttgctagcactgactaattgagtagtactactgtaatctcttgctctcgcaccacgtactaattaagtataaaaacggtagtggcaggcaagaagggcagcgaattcttggagttcttcttaattgactcgtgagttcatacctgaaagaaaagaaaagtggcatggctagtggaatatgctttggtgttgtggttggctggctagtgtagtggcatgggatttatctagcatagaattcagttaagagcaatactaaaatatggtatccatgtagtaacatatgattaaaatatcaccgagttgcatgatgccataagcgtagcatttgccttgacggggagaagaggaagaaaagaaaaaaagcaatccgcgttcagtgaaagtgagacggcctgcaggacgacgacttgacctgacgagccggatgctacagtcatgtggcgagcactagaccagcagctcagaatcttgttctattttcccgcaattacctgcccggaatgtaataactttcttaatttcgtaatcgaattcgctaaagagaaagcaatattctgatgagtgagtatgagaaaaccgtgtagtagtccccccaagatcaatgccactcaaatagttatgatttttttaaaaaaaattgataaaatatattaatacgtaatatatcactctacaaatttgcaacttaaaattcatagcaacttgtgagtatgacaaaaccgcgtaatattcttttcccctgaagatcgatgcagatatatttatatagaagaggatatttatatagatgtgtgtgtgtgaatgtaatcatatgaacttccaaatagaagagattgccaaatgaaggttggtattccagactctcctctcctccttcacatgaaaataaccatcagcatcgatcatccatttgcgttgcctcgatcagctcttaacaatttgcaagttcactgagcgcatgcagtgctagacacatacagatgatcccctttggtccttgtctgcaaattttactcgcaagggacgcccatccaaaatctgcaagaagttatcatcaattcatcattcacggaagattatacatcaatcccatgtggatttacgcagcgaattaactaattaagcacatacatcatactgacctgtccattgagcatggtgacaacgtcggccggttcagcatccgctgcgatcgccattgttgcgaatccaaaacctcgtgaaaaacgtcccctgctacttctctcgcacatcaccctcgcatccgtaaccactacgaatccgtcatgcccatgcccatgcttgctcttgatcttgctcatcaagaagcgtctcagcccatggctgtctaccttcctcggcagattgccaacgtggatcctcattagttgcacattaggctcaacaacctgcaggcctctctctttgatttcctgcatcgatcaagctaggctgggttaattaattaactcgcagattatatatatagtatcactgatcattatttctactagatggatcacttttgtgcgcgcggttgggttacctcgatggtggtgggagcaagagcaatgg

SEQ ID NO: 57784 - DNA, 807 bp, Oryza sativa
aaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcccgatcagatcgtgggttaggtggcgacaggcggtttgacgcacgcctcgccccatcccgtcaggatgagagcctccaagcactcgtccctagccggagccggcgtgttagctcctgaagatggcacgttggtcccggtcagatatatatacca

SEQ ID NO: 57785 - DNA, 1547 bp, Oryza sativa
aagtttttttaaaaagaactttcaaatataattacactatatttatactacaaatatatacatttgaaattaagctttaaaaaaaacttgtgacaattttttaaatgtttcacctctctaatagaacgtagggagacatatacagtagcaaaagcaagaatctcaaagagaaatcaagtaatactaggcatgccacaagcatccatgatgactgagaaacctaacaccgtcggttaacctacccaatttaggaactgctacgaagagtaaacatacgtgttacctattccaaggaggcaaaaaaataatcagaaaaaggagagaatccctacggtttcagctgttatcaactaatgatacgttacttcttcaaccatgaaggtgggatactgggattcatatttgcgatgatttacatacattttttaaaactctttttaaaagcttgctaaaattcaacaattaaaggagagatggagtggagcagtcaagttgagtcaggtcgtcataaattaaggtaaaaacgttgtctgtcatcactctcatgcatgctaataaacatgatggaaaaaagtacctcatttagttataaatatgagctactccctccattccaaattgatctacatatttcatagatacaccaaaactaagaaaagctaataactctctcatactatatttactctagcaacaaactcgatgcatgcaccatcacactatttccgagccaatagcaaatcaagatattgcatgtgggttataaatacttatatgcatgatgcatgcatcaatgtctatttactccaatgcacaaataacgaatagacttaataaatgaacacaaatatgtagatcatttaggaataacttaaaaaaactatatgtagattaatttgaaattgagggagtatgtacgttactaggagcgcgaaggtaaaaggatgactaatcagtgattgaattagatggataataagtatcttaattcttatctaatggttgctatctaattggtagtcctaattaatgtgatctaatgacaaaaattgttaatgatgtgtctttttctatatgtctttctttaaatgtcctttagtgaatactacttgtataaaaaatatatactccctacgtccctaaatatttgacgccgttgactttttttaaacatgtttgaccgttcgtgttattgaaaaacttttgtgaaatatataaaactatatgtatacataaaaatatatttaacaatgaattaaatgataggaacaaaattaataattactttttttaataagatgaacggtcaaacatgttaaaaaagtcaacgccatcaaatatttagggacggagggagtatatattagacctaatattttttagttttttaactatacagaggtacgcaggcgcgggattctaactagctagctagctagtattaacgtcatcgttgattcgcccccaaggttgaattaaactagtcgacgatggagctctataaatggcagtcccgcttccacgagctattcatgcactgctcgatc

SEQ ID NO: 57786 - DNA, 13117 bp, Oryza sativa
ttaatatttgaattcaaattcaaatttgaaacgggtatataaacttttgacttataaactttgggtctataaactttaggtgtataaactttagatgtatagaaatactatatacagaaaatatttgaattcaaattcaaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaacttgaggtgtataaactttaggtgcataaatttactaaaataagaaagtaatgcggtgtcaaaaaaggaaaccaggtggagggaaagagggggagggggggcgaattgatcgctacccccatcaccaggcgagcgatcgcccattagcatttccgcttgacaagcaccgtactggccttcgcgagctcgcactactgcagcaccctacctcctcacaattgtggaaccaactgctgctgcttggaggaggaagagaggggaggagggaagaaagaagaaatggctgacatgtgagccacattattttttcccttttttttaaaaaaaaaaaagattgtaatagtaatgccacgaagattgcgtgctgcgggaaagtcgtcatgggaggtcgattcggccgccgcgacggctgaacgagaaggccagtgaagatgcaccattttcgctagcggtggcaaaccatgagcgaagatacattttcactggcggataacataatggagccgccaacaaagatagttatcgttggcggttgccttataacagtcaccagtgaaaatgatcttcgctggcgcacttaagctacatggcccgccagcaaaaatgcactttaccagttgcttgctgacacgtgacccgcttatgaagatatttaattattttttaggaaaaaattgaaactatttttagtttgttcacgtacttaagaatcacacatagaggatatattcaatcgagcaatcgatgataaatgttttcttattgttgcttgcaacatctattgataattaatagggttaattggaaccatgtcattataaatttcattgtttggaaaaatgtcattaatgttcatctatttggtattatactatcgcaatttcacaggtataagagcatgctactacgtacccctcactgtatttctaacattttaggaccaaattacccctttatttttcttcttccttccctctcttctctctttcagccgacgaactgtaatgacctcatgctcgaggagatggattctaatcatttgggcaaatatccacccgtttattacatgccaattaaatggttattaaaaaaaaagacaagatggatcaatatgtaatatacatcatgtaaagccttatcttatgtcatacacttgtcatacataggtaatgacactaaaaaaatgagttcaataggagcacccaacaaaatataccattgaacaaaacttcagcacgacaaaaacaagaaggttaagatcacggtctgacagtgtatcagcactattaacgtatccacaatttatactcattatcatgcctcaaaactgaacggcaactatccaacactgatccttgggttctttcgttgttacagtatgaaaattgaacccatcatattcacccaacaaaaagaagcattcagcttcagtgcacaaatccaaggataaaagcttaagacaaaaaacgtacagcagctgccaacttctgttcacatctgttggaacagtctcaagcatcaccatgaacaaaaacacggtccttatcatcaagaactaggaagaaacagcttttctttcttcatcatcagtgatcggtagtttcgtaggcacgtcaaagcttgcctttagcgtgcgaagtctttactctgtgctgattaatgcctggagcaggggatgccctgattctgcaattgaggtgcccgcaccattagatcctggatgccctgatctacaacagcaatgcctgcagctgcaagaccaaccaactgttagcagccaattacacatggaaaatatgacgggatggatgatgtcaatgaccaaccaactgtcaatgatttctaaggcaattctgaaaatattataactagtttggtgtgtttacagtcctgggagccaatactggagctgctactagcatgagttcaggaacaaggtaacttgtgcaggctagaactatagtaattgacatcagcagcatggctccaatgtgcaccaattcggcgtcacattggtcaacccattttctgggggtgcctaacagggcgaaactaactagaatcaggctctaattcagtagtaatcccatagattggataaactactaagtaaaaactggcttgacctatgtatcttttggtctagtcttggtaaaattgaattggtttctgttgttgttgagtccatttggacccctggtacctgtgcacctatttcaggctggctggctggccatgtgtcacacaggtctttttggttaattcatttgaagattttgcctaagacttgctgcatactaagatacctgccgggcatttgaaatttggtaacccacttcattgtcctgtacatatacaaaggcttctgttcgctgctagtactaccttagctgaccagaagttaggaatcaacgatgcatttatatgtgtgtttagttcacgtcaaaattgtaagtttggtttaaattggaacgatgtgacgaaaaagttggaagtttatatgtgtaggaaagttttgatgtgatggaaaagttggaagtttgaaaaaaaaagtttggaagtaaactcggcctaacctgcatttgctgttttggttgaaataagattcagagaagattcgttggtaccattaaagagaggaccaattttccagttgctcactaggtgatttcaaccagaagctccggtcgaagccccatgttcataagaccatgctagcaaaaagataaaattagtaaaacaaagcagatgttcaaatatcgctgggataatataccactctcaaacgccaaatagaccgttcttagcaccagcagaggtggggaagcgcgcataataccaatgcctcactcaagatgtgacaggcaagccccactgctatatgaagagctaaggggctgtgtggttttcgagacttattttaaggtcctgtcacatcgaatgtttgaacactaatttagagtattaaatatacactaattataaaatccatttcataatattggactaattcgcgagacgaatcttttgagtctaattacgccataattttgacagtgtgatgctacagtaaacttttgataattatggattaattaggcttaaaaaattcgtctcgcggattagctctcatttatgaaattagttttcttattaatctatgtctaatactctaaattaacgttcaaacatccgatgtgacatgggctaaaaaatttttagcaccatctaaacacccccacacaagcataaacaggagaggggttccatgttccatcaacagtgaaggtaaagaatactggcttgccaatggtatacagaagggaacatctttgggatctggagaggtgggcatcactgccaatatttagaatcacaaatgtaagttacttctagattagacaaaaagaatgaaaaacttaacgtaagaatcagtaacagtatactatatgtaggtgcagcacgtgctcttattagggaacttgctgcctatggagtcccgaaagccagaacaacaacaacgaacacgaggaagagctcctcaagggggatcccatgggatcattttgtaacctagtttgtaaaaactctgggttttttttctctcttctcctaatatgaaataggcagagctcctgattttacccctaaaaaaacacgaggaagagcatcagatagaacgccttacggacaaaaacaacacaagggtcattcttgtgctgtcgacatacatagcatcctcttgcttattgtaatgaatcccatgtctttctagccaatccttctccatacctcagatgctatctgcatttaagtgatcaaattttcaatatggcaacatatttcaaagatatttggaacaacttaatagcacagatcgtatgcttcaatatgggtaaatggattggcataatataacttctttttaaactgaaactggcataatatgaccataatgatggaaaaaccatgtcaccgcctcaccggtcttgacttcctaggaagttgggacgcttgtgtcgggaggggtttgcatcgatacctcaaatcaaacgcatcactaggcggtcatgtcagcctgcaggggattccctggtcggattgaggcgtggcgaggacggcgctagaggtggctgccggcgaagcgctcctaattgaacctagagcagcactgctagctactaagcttcgtagcaagttggattataggcttaaacaaacaatcggcagcaaaaaaactccgatcgggtcaatcggcgccactgttaaaccctacctattgactattcccgccgaaggcaccggggtgggggggaggagcatgcgaaggccatgacgagatagatacttacaaagggacggtgcaccaggtcaccaaccaattctgtcgacggagtcgggggcgatcgccgcggcggcggcgagttggggaggagaggcggccatggagcttcgcgtggtgagttgggtgactggtggtaccaagaaaaaacgtgcaataaaaaccaccaattaattgaaaacccatgaaaactatatctaaatttctctaagttcatgaaaaaaaaatgcagagatggttatagttttgaaattattttacacaaaatcttaaatccgatctccaagaggaaaaaaagggacaaattccatgtgaatattaccctgatactattcatccttttttttacactcaaacgaagttaaatttagacttgatatttagacataatgtattttatgactatacctatatctaatatttttttaaaaaacttttatgtttgattttcataggttttatttgatggtttttacttaatatgactcaagtatgaattatttaccagtagaactacgtagattggggtaatatgttgtttttcaaggggcgaaaacgactcagaaatggatggaaaccacctttaccgctttcgttttcaaatctttttaagaatcacaataaaaaaaatcctgaattcaaaaatggaatcgaatattatcggatacggaaacagagctaatacaaaatgacgcggatatgggaacggaaatatatcggaatataaaaatccctctaagtgagcttccaagtgtttttttttctaaaacaatagataaaatccaaaattttagcaactaacatcccagatcacttcgtcacaaaaccgagtaaagtttgtacttactgccacaaagtgaggtgcatatcttgatctctcattgtggcaatcacaataggaagtgcagaataatgcatcacataacacaatcactcacagagtgaaagtcacatttaaattgtagtatgtcttctgctcaggtccaaatcccccaaaaccacgaattccgcgtggaccgcgtcgaggaaaaaaccgaactttcctagtgtcccctccacactctcatcgcgtgcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactacggtggaagaaaaatacacgcgagttctctgctcgatttgtacactgatgaagagaaggccacattttgtcctctctttttcctaaccgcagccgccgatcaccggagcaccacggcggcgacgaagctcagcacggccatggcgctggcggcggagcagcacaggtcgatgagcgcctcgcgtcgcgccttgctctccttcctccccttcctgctcttcacgaactcgtcatacctcctcttcgcctcgtcccgttctctccccccgcctatcctctgttcctccattgccgcagcgaggaggcggaggcttcgctcgccgctcgccgcggcgccgtcggcgtcctgcacggcgaggctgacctcgctgatgttgccggccccctcggagcaggtcacggtggtctcgaacttgcacccgcccagcaccaccgcgaacctcaccagcgtctcgccggtgtaccagtgccggtccaccgccacggcgcgccggctggacacgttcaccgctcggccgcgggcagggtcgacgaccacccagctcagctccagctccgccggagacagcgccgcctccgccgccggcttcttgcactccacggcctccacccggaacggcgagccgaggaaccacggcgacgacgcgggcgtctccacgacacgggagagcaggggcgcccccctgtagtagacgtccaccgccgagacgagctccgacgggaggggacctccgccgccgccgccgagctccccggcgtccgggcgcgggaacgggaacgcgtcggcgaagagccggcgcggcgggaccacggacagcagccgcgggtgccccgccatggacggccactccgcgaggcagagcgcgcgccacgtctccgggtccgcggcgagcgcccggagccccgccgtggcgcagctcgccgccgccagcgaccgcccgtccagccgccgcagcgcgcgcgccagcacgtcggcgtgcaggtcctctatcgtagtagtcgccaccattttctcttcttctctccctggcgccatcaccctctctctcctcttttgtacgatgaaccggtgataactactgcgcctccgccgtggtccggcttttatatagcactcctccttgtgtgccctactagtagtaagcgcggtgaactctggtcaaaaccacagccgtcctggctgcgacgtggtccagtacctgtacagtgcgttggtgtgtttcacaattttctttcgttttaacccgcatgccggtgtggccgtgtgggcgcggcttgcagtgcagggcgccggcgtggcagccgacgagaaggggtcggtggcgcgtgccagggccgcgctggcgcccgtggtacggcgcgacgcggctcgcctcggcgtatcatctcaggccgcgaacgcgtggcgcgccgtgtctcctccgtgccacgccgcggcgcgtctacctgactcttgagtcggtacgcgtcgtgcgatcggctggttggtcgggcgcaaccgcaaacgcaagcgagacgtgccgttcgttgcacttgacgtgacagagaaccaaaagaaaaacaggttttgtttccctgtgcctttcacggcgaccggtttttctggcttgatggcaaagcaaatctgttgtgcaccggtgtaccgtgtgtccgtgtatctgattcttaattgcgtttagaaggatatcgttttcctcgcgggggggagaaggccgtcgaacgatcggcacggcatctgcataccgctgagatgctgacgatgggggcggctcaccggcattaatgtcctgggagagtgagatcgagggctactggacgtgttacgtgtacgacggcttggcctgcgtacgtacagctaccgtgtgctgctgcgctgttgctcttgcagatttctcgtcaagaaaggcgcattgatacagggatatgtacgtccgtgtgtgtcgttcctatcctctcgcggtgacacgataagcctctcctaataattctttttagcacacgagctttctcctgatcttgcgattttctgcatgatctctcgttcggtgttcggtgaagcaatcaaaatgagaaacaaatgtggtaactttctgcttactactctatccatctcataatataagaaattttagagttatgcacagttattaagatggaggtagatggaaaaagtgaatgatggaggtttgtgattggttggaaagagaatgctggtgaagaagttgttatattttagaacaaattcaaagagaagttattgtattttgagacggaatgagtagtttagatgcacagcaatgctacgctgttgttctgtgattgtgcttcagctggggaaagcagagcaatagtattcagagtttagaactgtttatatgcataatgcaattttctcgcgctccatttttgaagttcctcagctttcaaagcctgggcgatcagtctgagcatgtcggtagagtcgcggtcatgattgccagagcaattaaactgaagattaaataaagtcatattggagtagattcagattggccccgcaataagataatcatatatatcctttgatttcttttctcataatggtttctgaagccttggctcggccggccgtcatgggttgcctgaactagcatcagggtttcggggcccaaatcctcatatggtcatatataactgcatgacgttgcaatatgtatggcaaggatctattttacatgggtaaatttgtttattaccgctgtaaaaatcacgagctaaaaaatacatgctactccctttatcccataatataagacgcggtcaaaattgacacggtctccaaaactaatctttaacctataattttccatgtactataaggttcctagccacaaaactataaccatatgaaagtaaatttaaatatcaatctgatataatttttaacaaataaaatttattttatactccattcgtccctaaatatttgatgtcgttgacttttttaaacatgtttgactgttcgtcttattcaaaaacttttctgaaatatgtaaaactatatgtatacataaaagtatatttaacaatgaatcaaatgataggaaaagaattaataattacttaaaatttttaaataagacgaatgaccaaccatgtttaaaaaaaccaatgacgtcaaacatttagagatgaagggagtattatactaagtgttagtgaaatattttaaatgctaaatctttaaatacgtgtgcgtcttatattataggatggagggagtacgtcattagtatgtagatccagagatccagcctttatatgtcattatcatgttacgatgttatgttacaactcgagtatctttaagatggtactaagttatccgattttacattagtataatgttttgagttaccatgtttttaagagaaaagatagttttaccaaagatttggatgctactatggtattacttccttcatctcagaataagtttgttttccatctatttgtcttacagagacgccatctttttcagcgatcattgcattagagtattgggagacaaacgtattgagatttgctaaagtggagaataattatattggagtttgctaaagtaagaacattctttttttttcctttgtattggcatgggtagaaatgggctaaaaatgaagtcttagtgatggagatagtacacgggaactgtctaaagatttcagattgcagatttcaggcttcaggcttcttttgtttgagaccaaaattaaccaatcaaaaaataaatgttgatattgccaaattatttggcttagggcttgttcactttatagtcacttttaaccttaccaaaatttggttatactaaattttaacacatttttacattaccaaatttttagtgctagatatgttttgtttgaagccttatcaagttttgatggaatttttacgagtggaaacttataaaactacgggcctgttaactttgggcctgttcactttggcattgccaaaattttggtaggatttcttatatagttaccaaaatttgacagtaaactaaatgtagccactttttttggcaactttaccaaaatttggtaaggttgaaaatggcatcaaagtgaatagaccctttgatgccgaaaaaaaaccttaccaaattttggcaatgttgtcaaaattttgacaacttgccaaaattttggtaggatttcttatatagttactaaaatttagcagcaaactaaatgtagccacttttttgttaactttaccaaaatttggtaaagttgaaaatagcatcaaagtgaacaggccctaccaaaggttggtagggtaacattaataagaatatgtataatttgttgccttacaaaaatttgataataccaaaattagtagggttaaaagtgacacaaaagtaaacaagcccttaccaatcaaaagcctagtcaattttccccaaaaaattagtaattaccattgtaaaaaagaaaaatggtaagatcacaaatggtaaagaaccatataagccctaattagagctaaagaatgcagctcaggaacatgtggcagtgatctcggcacaaggcatgtttcggagtaaaaacagattcttcaaaaaaataacttcatacagacagaaattcaacattttcagtctaaaaaataagaagatatttggagggagaaatgtcccttcaaacatttttttaagaaaaaattatgagcatgttaggatcaaacacaaaatcttggagttgaaattacataccccttaccgctccactgcactgtcaagtgcatctcagcattttagtctcacagagaaccttctgttgtgttctagactgagataattattttggttaatccaattaatcattatctcgagttacaacattttttctctctagagaaacatctccattttctcatcgtctcccggtttaactgcattattatatacttcctccgtttcttaatgtaaatcattctaccatttcacatttatattgatgttaatgaatctagacatatatatctatctagatttattaacatcaatataaatatgaaaaatgttaaaatgacttaccctataaaatggagggtgtaaaacggagagagaagctgttttctgcgcagcttgtttatgactcgcgcatattccttgtggacaattagtcattgaactaggacaagtctagaagtggaatcgtggaaagcttcgattaggtaaagaaaatgaatgtaggaacttcatctggaccaaatgccacatttgacatccaagttaagattccccatgttgtctcatgcgcgctcgcaagcctctcctttgcatgtcgccgtgtcttcagcggtcaagccgccttcatcgatcctctatttgcacgttgtgcagtactgaattatactataattctgattcagtacaggtgaagagtttttttaaaaaaaaactgaaaacagcactagagtgtcttttcattgaatagggcgtacaggtgaagagttagaagagtgctttggcagcacctccagc

SEQ ID NO: 57787 - DNA, 5752 bp, Oryza sativa
actctagaggatccccaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcgcgtcgattgcgtggcgtacgtccaagaattcctaatatggtaactcccaaaatatagagttctttttccacatcgccgcatgaccatcttcgctctctatatgctggcttccaggcccctttccgaacactactttaagatctttaaccatagcaaacactgttttcccgctgcgatgtttaggcttcgtacggtggtcggccttatgttcaaagtgcttgcctttcttccgtaccgggtggtttgctgcaaggaatcgacgatgacccatgtatacaaccttcctacagtgcttaagatacgtactttctgtttcatccatacagtgagtgcaaaccttgtaccccttgttggactgtccggataggttgctaagtgcaggccaatcgttgatggttacgaacatcagcgctcgtaggttaaactcctcctgtttgtcctcgtcccacatggggacaccttccttcttccacaactgtttaagatcttctaccagtggtcttaggtacacgtcaatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattataccaaataattcttaaaaactatttgtaaagttttaaactaattttaatgtgttttacttcttttaattttcattttagtttgttttctattatttaagattaactttcactagagtttttcttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttaaagaaattttgaagcttgctcgggcagctggaggaggaagaagacatatatataggggtgggactttagtcccggttggtagcaccaaccggggctaaagatcacctaccaacccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatatatatatttggcaatacaaatttgcattcaaagaatatatcatgcatcggtactcaaaacgatatatttttcttgaatggaggagggaggagggagcaatacagcctctactgggcttgaatcttgtacattacggcgctcatgacaaggaaggatgcatgcatgtgtgaccagaggaagtataaactacgtattccctctaataaaaaaaatttactggatatacctatatactccctccgtttcaaaatatttgacaccgttgactttttagcacatgtttgaccattcgtctcttattcaaaaacttttgtgaaatatgtaaaattatatgcctacataaaaatatatttaacaatgaattaaatgataggaaaagaattaataactacttaaatttttttgaataagacgaacggttaaacatgtgctaaaaagtcaacggcgtcaaacatttcaaaacggaggtagtagtagtatactgtaccaccaggacgaagtcagtactcgcgcagagattaatgtatcaattaattagaccttattatctcgtgcagattaagctgtgtgtacgcacgtattatgtgtagaaataaacatagacatgcaaattaatatatatgagttttatgagaatccaatcagtaaatatcttaaacggtatcaaaatttaaaattttcagttttaaaatttgacttaaaacttgtcaaaaacaatgtgttttgtaacagatagtgaaagcacgcacgcttctcgatcatcctatgaaagcaaattgaaatgttaatgcacgcattattggcatcgatctctttgactactgcaaattgaagaccaaataatgcgaactcaaaatatatatcaattcaatgcaactacacagatgagagcgattgtaacaatagtagatctaacatcattatcatatcgtccatcgattttaaaacctagctatctacgtacccagaaggtaaataaatgtacgtacgtttgagcatataattagataaatccatgccccggcacaaggatgaaaatgatcatgttggagttatctcactagcttgcttaatttaatgtcgttaattgttgcttaattgaatacatattgcgcgcacataaatcggttgatcaaaatgtggtcagatatgtttccagatatgggttatatattaataaatacaatcccatgcattagagcaagttcaatagtatagctaactactagctccaattcatctatagccaatctaatagctcattcatacaatagttacatactacactattaatatctggtcccacctgtcattcacacactgtgtgtgtcttggagtccgtgctacagctggctacaaatatgtagcccgtagcccttctctctcctcatttatcttcttaatatatgtttgcagctggcttatagcatgctattgtacctgctcttatagtggaatatctagttaaaaatggttactaaacacgtggcaaactaaacgtgctaagaatattggacaaattaagatttgctgggtgcgatatcgattaaggagaaagcaaggtggtagtccattttggcatagtgagctgtttccgtaggcttcataatctagctatggatgtttcagggacacattaattctatgggggtgtcaggtgtgtgtcgtgggtggtctggcttaatatgaaggcttctttaccgcaattaattatcatcttagcaagtgagtttttttgggatcttagtgagttttaactatacagaaagtaataaacctcttacaacatgggaggcctcttaaaaatatttacttgggatcaggtacctcagtacgagggttttttaggtaccttaaaaaattggaataattaactatttggatccaatagatctaattctattaattatactaaacctggtagtatgggtagtacaaattttatagggaaaattttgaactgaaatatataacagcatgataaatttatgtatatgcatgccatgttaatacatgaattgataagactaccagggtaaagtttcgaatgaaatattttaaacacttggattaaaattgtactatcctaccaccgcttgtagcagaaggtacctaaaaatgagtacggccaaaataaactgatccctacattttgaaaaattcaccttttgcatttgctcatggaattttctctgctttttaactaggataaaattggttattgggctattgtagttatgtttattctaatcgatcagtatatgttcagtcggacggtttaatttaaatctttcatctctcaaatagtacggcggtgtttgaatctcttaaagatgaaaattaaacatttcacgtaaaatggtggtaataacatgtgattaattgagttttaattattacaaacttaaaaaatgaactaatatgttattttagaacaactttcatataaaaagtattcgcacgaaacacaccgtttagtagtttgaaaaacgtaccacaaatatccaaaactttatcttctatttacagatgattagtagggagacgtatacagtatgtagctcctaacactttgttggagaactgagtttggagtggcttaatttataagctgcacacaaaatgatgaagattagcacatcatagtaattaagtattagctattgtaaattttaaaattgaattttatttatttatgaaaaaaatatataaagtttttgaaaatgacacatcgtctaacttttgggaattcgtgcttatcaaaacgagaaagtagatctccaaataaacccaaaaaaacgcagcctaagtcatc

SEQ ID NO: 57788 - DNA, 17861 bp, Oryza sativa
  unsure (1)..(17861): unsure at all n locations
tgccacctaacccgcgatctgaccggtcacacactgcgaccggtcacggaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccanccctcggggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcaccgacagtagcccccggcgttacgccagggcgattgcccccttcgagggaagcgctcgggcgtgacgccactccttaggcccggtgacaggtggggccggtccctacaggcgggcagaaacccagcggtcgcaaatcgcgcgcatcggcaagggaaaaccgactgacaataatgagtggcctcttcgagaccgctacattactcgagcagcgcgcgaatcgggacgagccggttcatttcgcctgtagacatgatgatggcgcttttctcggtcggcgagcgtatttaacgcgcgctcgatctgtcccatctcaaccgccacggccgcacatctgccgcgcgcgccgcaaacgggcaagtggggttagtggaggcgcgggcgcaagaaacgagggggcgaggtagtgggcgcgggaaacgaggagccgggaatagcgttggcaagggtataaagacgccgaggaagagattcgtttccttcctctcgccattcttccccttgccttcgccacttgagctctaactcttcgtttcctgcgccctacccttgccgcactcactcgctctcaagctcctcctccgccggcgtcatggcacggggctccgctccgctcgacggtagcgtgctgccgccttcccgcatcgtgagcgagaggcaggccgggctgccgcgccgattcatgccggaatctgccaccggcgggaggtggttgcgcggggcgagggacgcccggcgccacactacccggggcggtccgtcttcttcctttctttcgcaatggcagggctggtcccgccattctctaatttcttcatggatattctggagttttatgatctccagatggcgcacctcacgcccaacgcggtaatgacgttggccatcttcgcgcatctgtgcgagatgttcatcggggtgcgcccatctctccggctgttccgatggttgttcaccgtacagccggtatcgccgccgtcggtagtcggtggctgctacttccagccgcgggggcaggtgctgcaccgctacattccctgcgtcctccataagaagtgggacgactggaagagcgattggttctacacccccctcaccgacgaagcgagcctccgacttccgagccagcccccagcacaggcctccagctggcgggcgacggtagatctgggagacgactacgacgccgttcttgaccgcctggcgggtctgcgatcccagggactcacgggggccatggtgttcggcgactacgttcgtcgccggatcgcgccgctccaacggcgcgcccggggcgcctgggagtacaccgggcccgaggactccatgaggacccaccaggggtgcacatgggactgggaccctgaggacttcaggatggtggtccaacgggtgctgaatctcagctccgtggaggcatccctcatcccccaaggtgttctccccctctgcagcgatccagatcgcgccaacatcctgaccatcatgcaggcggtcggggcgtcgggggagcgggccctccgaggccacgatggcgcgggcgggagccgcagaggggaacaatctaccccgggagggggtcgtgcttctgggccctgcgacgggggcccggggggcagccgccctgccgacgcccgggggaagaggaagcaggagggtaccccttccccatctcctccccgagggggcggggcggtgcgtgccagcagcaggcgcccggagggtgccgtgccgacatcgcagcccgagggggagcggaagaagaaacggctccgcaagatgggggggaccgagccatgtcgggggaacctcatctcgcccccgaggtggtcgtttagccgacctcctcgcaggttcgtctccgcgcccatcgcggccgtattcattcccccatctcccaaggcgagttttcactcacccgtttctttttgtcttctggtttttcttctgcctcagcgagatcccgtcgcgccccctccgccattccaagtccggccggtccgaggccgaggagacagcgaccgcgaaggcccggagacgggaagctgaccggcgagaagccgcggaccgcctccgggaagccgaggaagccgcccaggaggccgtccgggttcgccaggctgaggaagccgctcgggaggaggccagactccgccgggccgaggagtccgtccgggaggcggaggcagggcacgcacgccaggcggcctgccaagcccccgacctgactccgcccgaggcgacgacgacttccgaggccacccacgacgaggccgcgggcgcaccgctcgggcccgaccccttgggtgacgctcaggacgagccagcttcgggggacgcccccgagtccggcacgtcgatcagcgggccgagccgcgcggcaccctcaccgaggcggctctctcctctgccttccgctgccccaccgagcgcggagcccctcttgcaggccttggccgccgcgaacaccacggtgttggacgggttaagcgcccagatggaggtcctgcaggcagagcgggcggagctcgacgcggcgtgggcgcgcgtcgaagaggggcggcgctcggtggaggccatggtggaggcgggccgcaaggcacaccgctggcacacctcagagctcgaggcccatcgtagggacctggcggagatcgccagggaggtggaggaggagcgggagactgccctcatcgccaccgccgtgttcaacgcggcgcgggacgacctccgcctccaatacgggagccgggcggcggagctagagaagaagctcgacgccgcccggggaatccttgatgctgccgctgcccgggaacggcgggcggcggagatcgaggcggcgtcccggcagcgtgaagaggcccttgaggctcgcgccacggtgctggaggagcgcgcccgcgcgaaggagagggacctggcggaccgcgaggccgccgtcgccgtccaggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgtgccgcaatctggaaggcgcccgcgccgagagggccgcactggatcagcgggccgctgagcttgaggcgcgggtgaaggagctggacgcgagagcgcatagcggcggggcggccgcgggcaacggcgacctagccgcccgtctcgcagccgccgaacacaccatcgccgagctgcagggcgcgctggactcgtccgccggggaggtcgaggccctccgcttggcgggcgaggtagggcccggcatgcttcgggacgccgtctcccgtctagaccgcgccgggcggtaggcgggcctctggggtgggcggaccgcgaagtacgccgccaaccaggggggcctcgcccagcgcctctcagagatggccgggaccctccagcggctccccgaggagctcgaggagacgatcaagtcatcctcgagggacctcgcccggggggcggtggagctcgtactggccagctacaaggccagggaccctgacttctctccgtgggcagcgctggacgagttccctcccggaaccgaggacggcgcgcgcgcgcaggttcgggacgccgccaaccacatcgtccacaacttcgagggtacagcccctcggctcgcgttcgccctcgactccgacgaggagggcggtgacggtggtgcggacgacagcgaggacgaggccggcgacccgggcgcgtcggagtgagcccccaggcccccgccaatcttaaatagcttttccttcttcttccgaggccttcgggcccccttcttgtatagactgatttaatctgtaatcaaataaaaaggaaatttctatgttaattctatttgttgtgtgtatgagacggggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtgggcctttgccgattcccccccggagttcaccacgccccggggcacggctcggttctgggccccttttgtcgattttagccggcccgggccaccgagggcaggatcgagcacgagcgtgctaattcaagccaagattcttcaaaaggaaacaatggcacagacacagtccttaggaaatcgaaaatgcttttattgaaatacgtaagataaaaaagataagtatatgcatgtggtagcccccggccaaccctgcacgcccggggggggggtgcggggttggcccgagcccgagacctgacacccgacccccattaggggtagaagcgacgaaggtgttcgatgttccacgggttaggcagctctgtgccgtcgcccgtggccagccgaacggagcccggccgggggacaccgatcactcgatacagaccctcccacattagtgagagcttgctcagtccagcacgtgtttggacacggcgtaggacgaggtcgtcgacgcagagtgatcgggcccggacgtggcgctgatggtagcgccacaggctctgctggtagcgtgcggctcggagggccgcgcgcctccttcgctcttccaagtagtcgaggtcatctctgcgaagctgatcttgatcagcctcgcagtacatggtggcccgaggggacctcagggtgagctcagatgggaggaccgcctccgcgccgtagacgaggaagaaaggcgtttccccgattgctcggcttggcgtggttcagttcgcccagagcaccgctggcagctcctcgatccacgagtcgccgtgcttcttgaggatgttgaaggtcttggttttaaggcccttgaggatttccgcgttggcgcgctccacttagccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaatggccacaaaagaggtatggtctgcagggcctgggccggctgatgggtttgcctggcgtggaactggcatgccctgcaccgccagaccaggtcgaccgcatcgttgagagccgtcggccaatagaaaccctggcgaaaggctttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcaaggtacgcctggatctcagcgatccaagcaatcaatctaagggagctgggaacgcttccctcgggtcccaaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagctgggagtcgcctaataccaggaggcggcggatccccagtccagctgccaccctgagtcccgcaaggagtccctcgtactccgccatattattggtcgcccgaaagtcgaggcgaaccaggtatctgaggacgtctccgctcggcgaggtcaacgtgacccccgcaccggcgccctgaagagacagggagccgtcgaactgcatcacccagtaggcggtgtgaggcagctccgaggggcccgagctggcctcggggacggagacgggctcgggagctggggtccactctgccacaaagtcggcgagggcctggctcttgatcgcgtggcgtggttcaaagtgcaaatcgaattcagagagttcgattgcccatttcaccacccgtccagtaccctctcggttatgcaagatttggccgagggggtaagacgtaaccaccgtgacccgatgcgcctggaaataatagcgcaatttcctcgaggccatcagaatagcgtaaagcatcttctgggcctgagggtatcgggtcttggcgtcccggagggcctcgctaacaaagtagacgggccgctgcacctttcggcggggccgatcctcttcgctaggggccgcatctccagggcgctcttcgtccgagaggccgcgcggggcgcactcggcttctatgccgacgacctcggggtcagagggcgacaggcgcggccttcccgcagtggccccgaggccatcctgggggtcgagggcgcctggcaccgtcggacaagcgggcggagggccagctccggccgtcgggggcctcgggccaccgttcggctcgggggcctcttctccctgctctctcccgggtcgagtcgacacagggtggggatgcgcggagtgagggctgtcctcgtcgcgctccacgaccaatgccgcgctgaccacctgcggggttgccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccagggcctgccgccgcactttctgccggactggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgacgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgtgactttgaggtcgccatggatggtgatggggccaccggggcccggcatcttcatctggagataggcgtagtggaccgccgccatgaacttcaccaacgcgggcctccccaggaccacgttgtagggcagactgaggtccgccacatcgaagttcacccgctccgtgcggaagttggcggaaccatcgaaggtgaccgggaggtcgatatgacctagtggccaagtgtgccccggcgtcacaccgatgatcggctgggacggccggagcaccatccccggggccttgatgtcgtcaaaggctgcgggggaaaggatgttgagggctgcacccccgtctatgaggacacgccccaacttcacattgcaaacggtgggggaaaccaccatcgcgatctgtcccccccgggcaacgcacggcgggtgatcggtctggtcgaaggtgagggcaacctccgaccaccgcgcccgccgcgtcgcctcatgggtaggggccgcggccaaaagctctcgcttcatggccttgaggctccagcgagaagcgtgagcgcacgctcccccatcgacggtggcgatggtggcctcaggctcctggaaccccaggccatcgtcgccatcgtcgatgtcctcggcgggggccttctgcttggcctcacttcgccggttgccggcgggagccgccggggccttgccctcacggcgctcctacctcctctcctcccacttccttgtccgctcagccaaacttttgaccgcgcggcagtccgcgaggtcgtggagggaggtgttgtgcacggaacaccacttgccagtcgggcgctccctgctgggagcgccggcctccttctttttgtcgctcgcaggcctcccctttcgggtggcccgcgaagcgccctcgaccgcgaggacatgaccctcgtcgtcggaatgggccgacctcttcttcctcctcctgtcccgccgccctgaccgagcggcggacccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaatgctcgacagccggcaccgccaaccggggacacggggggctggcccccgtgcccggaccaaagtggcgctccggacgaggaagcgccctctgttgcgtgggcagcacgacgaccattgcgccggcgctcgacattgaggcgggcatccggccccccacgcacgtcttcttgggttggaggcgttgacgagggaatggcggacgaacggcgggtaacggccgctgctcgccgcgctctccgcctcgacgatgcggagccggtggtagcagcgccagaggccttggtgacggaggaccgcctgccggcgcctaggcgctgctgtgctgtcatgaccaagtcggccacatcatccagccaacgtcgggctggagtctctggatcggggacgacgggcgggtgacgcaggaacgcgcccgcagcctggagcgcgccctggggcgtgctgccatcgccatagacgaggaggcgacgctccccgtctcgccgtccttctccatcgcccgcaagcggcgaagtcgcggatctttcgaccctctcgagcgcctcctcccgctcaagacttcggcgagagggggacggtggagtacgagcccgacggcgcgggttctgctccccgtcgtcaccgctagcactcggagagaggttatgcgccatcgcccgttcggccattgggctgagcgggtgaagcttggcgcacacgaaagaggacgagggcttagaaagacacacgcgccccctacctggcgcgccagatgatggagcgtggggctcctcaccgggaggccgcgcaggcccccctttgccggttcggccgggggcgctaggtgaggttctttaccctcgatctgtggaatgttcgcgagagagcaaatgcacaagacacgggcgatgtagacaggttcgggccgctgagaagcataataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcattaatgggtgaagatttgcaatggctgctgtccgaatgaccctccgatgggatgggtcatatctacctccactccgccggaagcagatgcaacgtgggagctcggttgtctgccgatgacgtgaccggcgtcagaccagtcacagaccggtcattcttgtccaccacgtgtcagtttagcacgccgcacgtctgcccttcttcatacaatgacttccttgcaatggttgcgatgaagcctggaatgtatctggccgggactgacgtgccaactccaggagttaacacgccggctccggctagggacgagagcatggaggctctcatcatttcgacgggacggggcgaggcgtgtgacaggccgcctgttgccacctaacccgcgatctgaccggtctgtgaccggtcacacactgcgaccggtcacgaaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccagccctcggggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcaccgacagctaccatcaagatggcaattatattgcacatgcagatatgtcatttgaattgcgcagacattataaaaactagttgagcggcccgcgcatttgcgtggctagcattaatttaaaattatctatttttaccacatgattttatttaaattatcattaccgtgattctaataattttatagtttttaaaagcaacgtcagtcgctacccttactcctttgtcacctttttatttgcttacttgatctaccattacttatatttattctctttagaaatttaaaaattagaccttatagtttttagatttcattgccttagtgggtttcgttttcataatttttagaagtattgtcaaacatgccaatttattattctacggcccatctgctgccacatctttttattgtcattgggattttaaaaatcgaacataattattgtttgtgttctttttttactttctataagtcttgtcaatcgttagtggcttcaccactatactcttctacagccagcccgctgcctccctccttggtgtcattggaattttaaaaatcaaacataattaccattggggtttatttttactctccataagtcccgcaaaccgttgtgactatgctgcttaacggtatggccatcgccactccttttaatcatcattgggattctattggggttttgtttatagttttcagatatcccatcaaccaccagcactctactcctttataggcctactgcttctcccctctttattatcatttgtcatcgctgtgttttagatggaattttttttttgaaaattgcatatttttcattccgataatttttattcataaattatattgagtaaattacacccatggtacaacaacttggcaggtgtgtgcgatatagtgaaaaacttgagaattgaacgtccgagtacaacaacttgacaagtaggtgcattctagtaaaaaaaacatgaaaaatactgataatttagtattttggtgcatcaacttggctaagcatatgctaggtgggttttgttcacgatgtcaatatgccattatagtattcctacggatattaccttatagtattgaatttaatctttaagaattatactacacttacaatttacatctaattacctttaatttttttttgttttcttcaccttctcaaatatcaaccgaaatataataatttctacatctagttttattgactttcagttattaattattaggatacaaatataaatatgcttatacaaatccacgctagtatattttcaaaataaatacttaaaaaatgaaattatataaaaaaaatgctccaaataattaagttgtcacataaatttttaatttagtgtatgaaaattgtgcctatcttgcaagttgttgtatttatacgatcactcttatactaaattacacattcttaccaagttgttctattataacgctcatttctgaagttattgtaccaaattgcactcacctaccaagttgttgcaccgtgggtgcaatttactcaattattatattcctacttgaactcttataattatttttatatttctaaaacttattttatgtgttatttaaaactttaattaatctcgttatgtgttctacattgtcccatatttcaatagtctttattttttattacacattttagttattaataaattttattctagttgagctgttatttgtatttgtctattttctgaatatattttattttttatttcgagttttaattagtctcgtattgtgttatatatcgactattttttaatatatttttttttcaaatttcaatttttcaaaattatactcctacttgaactacattttttattttttatgattttggattttatttgattttttgttttgaattttaattaatatcatactggtttcttatatggactcttctttcaatattgcttattttaaatttcgaattttagttattttcaaattgtattcctatgtgaacttttcttttatttctattctagttgtggattttattttatttttattctgaattttaattaatctcatattggcttcttatatgtactcttctatcaatatttcttgtttttaattccgaatttcagttacattcctataatagatagatagatttcattgtggtattgaaaatggtaaacgctaatttggttagttagtgtcacgccccgaactagtaccgaccggaactagcccgtgacgctccaaattaacctgttaatcgatactagtcccaggaaacagtgctggtatcacaggaagacagattatcacagcaacagaggtctctttattatagagtagaggtacagtcatattgggctacggacagaccccgagctcacaactgcattacaaaaggaaagcggaagccaggactaggaccaaacatcacaggcgcgacttgggaactaggccgaaaccctaaaactcatcgtaaccggcttgctcctggaagaactcctcatcagcgggatctgcttcgtcttcttcagcaactggggggggattatttatatagagcaagggtgagtacgggagtactcagcaagccatgggaaattaagtgtttaatgcaggcttcaaggagaggctgttgtttttgcagttgattttatttgaattcttttctaaaaacaactaagtgagtgcttctcaaacgacacggatgagacagtgcgtctcgtccggtcggagtatgtgcaatgtatcagtctttagaattgaatcaaggttggcacccggccaacagcttttcaaacggccacctgggccaacaactttcaaacggccacccgggcctagctgattccatcagctacatatttttcaaacatcgaacccctttccacaacagcaatttcataagcagtagtcaaacaaaactacgctaggaatcacctcacatccgcccatgactgtgggcacggctgttcgaacaatttgttaacctctgtagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccctgacaccaccccggcgaatccacatgtctctcggcatcaaggctcccctgataagctagttactcagccaggggtgttccattccacccatgtggtcgtacttgtcttatgtttggatgaaattccaaggaaacggtccttaagtgcaagagcgggaaaccgtacacccgatacgttccccggtccgctgttttggaaattcatttagttcgcaagcaccgacccaggtgtcgggttttccaagtctttcgtaaaacccaagttttacccaagaagttttttagattttaagtttgaaggcgtccgtcgatactcgcacagggtgcacgaatatcaagacgcaactagatggttacaaggggacacgatataacaattatcaaaggaaggatcaaatgcaacaaattaggtaggtccgccaatctgccttgcaggcgagacaacagattaagtgcgatcctatcaatgcataatatttttaaaaaaacataattaatttcaaatataggctcaagatgttcaaaggtggcttgccttgctcgagatctggagcttgatcctcgaaatcctcgcactgcgggtcttcgggctccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagggagggaaaatagacttttcctcgggcggctagtgcgcggcccgagagaaacggagcggttcggccggcccaaggcggcccaagcgcgcgcgcgggagggaggagagagagagccggtggaccgggctcaccacgcgtggtcccgggtgggacccgcttgtcggtgacacggttcaccgtgcggagcgagcacgcggcgcacgcgcgtgggcggggaagggatgcggtgcactcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggctgccacgcgggctggcgggaggaagacgaaggcgtcggccacgaatggacggcgggcggcggcggcttctccggggcgccttgcgacgatgaggggcgacggggcgtacaccgggatgacgagggagaatgagagggagcgagccaacggcttggattcgccggagggtgtccgtcggcggcggattgcggcggcagcacccggcggagagaaaagggggaaacggcgacgaggtcacgagggaccgattcccggcggcgagagcatctacgcggctacgggaatccgttgctagcgtcggattgggcggagctacgccgagcgaggctggcgacgagcgggtgctacggagctcgggcggcgacggcggcgagcacatggcgagcggcgacaacggtcggggcggcgccggctagctacggggaggctactcgtgctaccaccgaaaactaagggggggagatggagcgaggaggaagaacggagggaggcactaccgagatgaggtggggcgctgtgacgagaggccgacggcgcgggagtaatctctccggccttgggccggggaagaggaggaagacgagcgcccgtagtccccttccgcgtccacgaacgcaccggctctcccggcgcttggcgatgaacggcggaggcgagacagagctcggaaagcagcggcaacgatggagtggaggcgaatgggagaggaagggaaagggggaggcttgggttttaagggcggcaatgtcggtttggaaaccgactttgggcggtcaaggcgcgagctggcgctcggcgctcgcgtccaatcggcgacagggcggagggaggatgatgccggcgggaggaaaaagggaaaaggagggagagaaagggggctcgcccctttcttctttggaaaaaggaggaggggagcgggggcgtcgcggcagagggaggagggctctgcctccgtcccttggcgacttgagcgcggagtggcggggccgaggcgatgacgacggcgatgacggcggggcggtgtggagcggagcggcgacacgggcgacaggcgcgggcaggcgctgacgacggcggcgaccaggcggtcggccactcggcacgcgcgcgcggcttgcaacgggaggcgcggcagattgagtggcgcggctcgggcacgcgcgctggctgcggggccgagcggctgcaggcgcggcagagcagcggggccgggcggcgcagacgcgacgcgtgcgacgaccacgcgagcgcgcgcacgaacgacgcgcggggagcggcagcgagggagcgaagaggagggctcggctcggtgcgggcggctcatgcgcacgcacgcgcagcgcgcgggcggagcggaggggggagagggagagagagagcgcgccgggggaggggaggagaggggga

SEQ ID NO: 57789 - DNA, 38921 bp, Oryza sativa
atatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtcccctcttctaatattccttattttttaatttcgaatttcaactatttctaaattgtatttctatatgtactctgtttttctttttctccgattaatatgagaatttctaggccgtgagagcgaacgtggaggctcatttttctattcctttcataagttaatagatagattccacacaaaaataccatattcagccattgacagatattgagccatattctatgaatgttatcaaactttcttccaagttgttggattgacagtgagagcatctaatcgacagatattgattggaaccatattctacggatgttatcaaactttctgtaacacacagggagctataactcttacgcaacgtaccttgatcatggcttcgtccccaaattgcgcacatgtacttgcatttattctttggacatgttatgtgccataatgtggaacaatattctattgcatgaatatgatccgcgtcattatcacaagaattgcgcacatgcctttgacacctcagcgaaattgtcacgatctttggacaagcatatagcagagcagcagtctagcagacaaaataattgagcattagtttaatttgtcttgtcataaaaaactggagctattgtcgcatatacccgtctttgtctacgtgtggttcgcctttcatcggcactatatgatgatatgaatagggggtgttattagtggactaattgtttattgatatttcattaaattggtgggccagttcctacttaattaatcgattgtgctgttcagatgctgtagcctgtagccctgtagccaatatccagtccagtggccgtatatgtatccaggccaggacccaactagcctccaacgtaggatggaaatgattttgcagagatgagagggggcgagatggaggagtgcggggttaagcaacaaaaagctgtttcggataatatattaaatgaaaaaacttgaattatagctaagactattgtggccgtacaaattacctctctcaataaaaaaaccaaatatcctttaccctcaactttttatatcggacaaattaccacctgacaaactccggagcggttttaatcgtacgtgacgacacgtgctgtctaaccaacaacaaaaaaaaaaggtaggactcacatgtcgtgaccgagagaagtgatggaactgacaataggccctcactattttttttattttcttatgatgactgggctgctacgtatgcgccacgtatgaccaaaaccgctccggagtcggacatgggagtaattcatctggtataaaaagttgagggtgaaaaacgtctggttttttaattgacgagggtagttcgtattgccacaataggtggggggaggtaatttggactttttcctatattaaaaaatctattttcagcctaaattttttttcatgttttgatgaggacatcacttcgtcggatacacacataattcacacgttctaatgataattccaagtccaagtccagttcagccttaagagacatcactgacttcaaacggacctagcgtcttcatgccaactctgatttgggtgatcttggacttcatggaaagattatctcgccacctttcaaatacatttggtctcatatccaaattcattccgagtcaacaggaatcatcaaaacaagacagtgttgttcctgaaaccgaatttgggccttgggctttgtaatagactaggcctatctcggaaatgtctccctccacctccacgaattaacactaaaccctagatctattttcctctttaaatgtctatgtacaccctctagaacaattgggttttgtttagttgaattttgccaagtgtcattcaccttgtctctaatcctcgctcgattagtcggtgactatagattcagagcccccaatagatggtgtgttgatttgccaggttgattagatctaccacttcaatcggaactattcatttgtacttaattacctattcgcattatttagattgcatcttatcttgttcttgcagtgttctctcgtttgcattgcagggatcatcaaccgcatgtcacggttggtacgacatcatttgtgctgtagcgattacacgacgtcctgggcttgttccggtaggtagccacatcgtaaacgtcgcactctatctaagcgagagttatcatctcaccagaagatcgagccacaagagagagtgtcatcatgtttaggtcctctttgaaataaacaaaaacatagtaattccaaaggatctataccctatgggaaataatcctatgaagccctttgaaatgatggatgatttctattaatttttctgaaattcctatggaatagagtattctataggaattatagagaaaaaaataagcatgggtcttacctcatgttttcttcttctcgtgtttacgtagggatggcaatttcccacatggggccggggacccgcaggggacctgcccctacgggggcgggggcgggggcgggtgtggattttaacccgcggggagtcaggtccggggccccggtcatgagcgggggcggggacgggtgaggacatccacccgcgggtccccggaggatgtatattggactatgaaatagtagcatattacgagcccaaaagacccatcaagtctaaccctaattcctcatctattcccttccctaaccttatcctcatttcccttcccaccccacctagccgtcacgcggatagcggaagacggcagcggcaccagccacacgcgggcagcgagccggtgacggcggccccgcgcgggcggcgacggcggccacgcgtggacagcggaagcagcagccatgcgcgggcggcgtcggcggcctcttgcgggcggcggcgtcgacgaccaggggcgcagccatctgcgtcggcgtcagcgacgcatccgcgacggcgacggcaagggctagcatcgcatccacggcggcggcggcggctagggagggcacatccgtggtggcggcggccagggaggcgcatccgcggcggtggcggcagtgacgcccagtccctagccacctgtctgtagctgtccctcgtcggcgtcgccgctgctatgcggctcctctcttgtcagtactcaatcgtcagtcgttagccgggtggtgtgggccccgctcacccatgggtcccctgcgggggcggggacgggtgatggttttcacccgaccatctctgcggggccggggtgtcgaagcccgaaactaatcaatgaattaatgtatcaatccctggatcagtaaatattgatacatacaatatacctggtttttcattgcatatgttaaagttttacaatactaagggttttacaataataggtactcatctaattgagtaactagaattaatacacagcggaagtttctatacattctgactagggaggtataacctttagaggttttctaaattatgggggtcatcgtagtaatagttataagggtcctcctcttgaccgaaatctgaaaaggggttataagagcaaggatgagtatttacaatgctcagcaagttatcatggaaatatgttatgcattagcatataggagggttctttgcaaaaagcaataataaacaatctggaagaattatatcaagaattcataaatatatagactttaaatttctaaccagggtaccatatgagtcccggtactcaactccatgagtacggctattcgaatagtttcaaagatattttattgcagcagatgtacgctttacccgcagtccacgacttgctgataatcgtcggctttagtcatggcctagtattaagtcattaacaattgtggcacctgttccatgaacttatatccttatatgctctgaacgtattgttaacagcagcaagaggagttctggcgttcccgagatatttaaggggaactgatcgtatgacaccacgtcatctcgatcagggtttagaaatataccatatagtttatactcgagtatcacaaaccatttacctgtacatggtaatggttaaagttgcccttcgcggctatagttgcctcttgcgcgaggacttaaaaataagaaccactatacagaggtgccatattgctaattaacataataactaggtttgtccccattctagaaactgcggtcgtacctgttcgttcgacataagtacctggtaaaacttatatcgatcgagacagtactagccacccggaaatcatccaaatcttacgtactgtgccaatctaagtataaggtattttaaccagattgtaagcaaagtaggcaatactaaaattatctgggtttctatgattgatttatgcatataaaatagaatattgaatagaaggctataaataaataatttgtaaaatataggtctaaatgatcaaaagttatatggtaacttgccttgctcgatgtcctgagattcattgatattatctattgagtcagaagaatcctcaagacctagggttagacatataaaaattcaaatttaaaagaaattcaaataaaatccaaaaataagaaaaatggagaaaatgaaataaaatgcaaaaatagaaaaaaggggctcaaaagatagagaatgattttagaagaatattcgtccaaatttcactggaattggatctatattttaaaagatatgggcttctaaagttttgaaaatcaaataaatgtgaaatagcactgtgtgcggatcccacctgtcagtctctctctctctctcttctcttcttctacctccggccattccccaaatcgggcgatggagggggaaagtggttgcggccgaggaggggagggagctagggttctccggcgacggcgagcggcggcggaggggttaatttggtttgtggttgagctaacggctaggacggcagtggcatagttaagccgtgaaggtgatcggggtgatgtgagtgagacatggctaggggagggctcctagagcatctacgaggtacttagatggattccagcagcttgccgatctttggcaaggtacggagaatacttgctgacgagcgcctccattggcagcggtcgtgctcacgtcggcagcccagagggcgacatgatagtgcaaagtgatgctaaaatagaatctagggagtatgtagatggttaaaacggaagaactcaccgagatcggttgaaacggaggattgcggccggaaaaacttctcgggggcgaagaacagagcagtgcgagggcggcggtgcttggcttggcgcggcgaggtaaaactcgacgcagggcttgggttagggtctaatatactataacatagttgatataaggtgttctaaggggtatttagggcggaagatggatggagggatgtggagtcgatcgcgcacaaggtgttcgaccgacgggcgattggtgaatcaaagcttcggggttgtggggctatggttgttgatgatcgatgatggacaaggaagggattggggtcctatttatagggctaggaggaacggatgagctcggacaccgtcatcgccatggatgagctcaaggattggatatggctggggcggcagaggctgtgagaggacgggcaagatcaatttgagtggcgggaggccacgtttgaatacttaccagcgaaggattggcttgaccgcgtgcgaaatcggctggcgacgtgttggcgccaatccgggcgcgatgcgcagtggcggcgagggtgaaaacggccgactcgggggtgaatggtttgaattgtgagaggggataccaccgtctatcttcaatccaaccgtgcggcaagaattggcgtgattcaccatgggtagaatcaaaatcggactcggcggcggctttggacgggcgcgcatggcgtcgagcggcgatttcttgcggctgtcgtcgtcctggctttgtcgtcgtcaagatttgtgcggcggcggcggtctgagggcgtcggacgggcgacgacgcgccaaggcggtcgggcacgcgcaagcggccccgaggccgatgcgcggcgacacggcgcgcggctaagtcggatgcccgggcggcgcgccaaggggaggagaaggccaactaaaccacagtttttgagtgggatgtgggccccaaggattcaacatagactttgcaaaggattggacagggattgggctgagttagttgggctaggcattctgccgaacaccttgaaggcaatgaacagtgaaattcagtaaatttgagtatttttttctagaaaagattgaatttgaactatgaatttggaagagttttactagggtttggagtgtagtgaatcctcactaatgttaaggtaaacttaaggaaataatctaaagtttgaaatttgagagaatttgctcaaatttactaaggtttggaataaagggaatatttagggtaaattagtagggttataaggaagtaacacttgaaccaattaagaaatcaaataaatttttaaacacactaatttaatcaaaagtcagcatgatgcagtcaaattttagtttaaaatttgaggatgttacacggggccgggaggagaagtcggggagcgggggcgggggcgttctggcccaacccgtacctgacccgccccgttgccaaccctatgtctacgtgagtgttcagtgcttcctttacggcccaattatggataatgggatatggtccatcattaatcatgttaactagttgggccgagatggaaaatgtgtctttggtctttcgtgggggataagtccactaaccatctctcatctttacgttatgtttaaccgacatacttaattgtaaaactagaaaggttcgttcaatcttggcaaaacagtctaaattagatctcatggaaatataaatagttggttttcattgatgtggcatcctagtaaaaaaagatagataaacaaagcatgtggggccacatgtcagtgtacaattctttcttctatctttttccccaactacacacgcagttcaagggtggcagctatggacgcagagacggtcggtgagcctgtcctagaaaagaagggaggtgaggggccgacaagcttatactcctcctctgcagtgcgcatagcgcgcaagcctgaccttagtgaccttgggtgtcactgtggcaccaacacgggagggccatgtcctgtgacacgcacagccgagaggaggatgccgaaaagtacgccaaggccaacgcccacaaggcctcccgcatcagcgcccaaggtcaccaaagttgagctcgcatgccggctccctcgcctccctcttctccttcacagtcgcccttggccagcgaagataggggggtagccagcgagctcgtccgcgggaggtgacaactgtggtgggaggttggcgatatgggggcttcaatggtccgtgatggggggcctccctggcaacgatgaggtagcaacacgccacgtcatctggttggcaggacgatggcttggagggtgaaccagtggagcatgaagaagtcgtcgaggtggcgcttgtggaggaacgtggtgtggacagtggcacatgtgatggaggagggggtggcagttggagtggagcgcgtggtacatgaggtcagcctcccgtccttggagggggacatgaatgcaaggatgttgttgtggagcacagagcgcgagtgacgggaggggctccacaaggtacaccgtgctagggggcggcgacgatgtggggtgcactgcggcaccgcgcttggtgggaggctatcgccaaggcggcgtcggctgttgaatagtcccacattggtcgtggaagggcaaatgacctaacatataagtgagggagccccttacctcaatggctagcttttggggtggaaaagactctttacgatcctacaattttggcatcagagcctagctagtttaacatctttggtccgatagacatagtgtgtgcaggcctgatggaccgtgggtgcctgcggggcccgtatacctaagggaccgtggtgaaacggtgaaggggcggtgaagggttgagggacaccaatatgtgaagggggagattgttgaatagttccacattgatcgtggaagggtaaaggacctaacatataagtgggggagcccctcacctcaatggctagcttttggggtgggaaaagccctttacaatcctacatcggcatgcacgagcgggaggagtgctggcacaagatggcgtgctgagagtggcttggacaacggcatctctcgtggcatgagccacttaaatatgtgctcccacatagtacttttttattttctccttgatgactaggatgccacatcaatgaaaccagccatccatattatcataggacgtaatttttgcaagttaggggatcaagatttctggtattacagtctaggcaacgattttaaactcgatgaaaatgagggacataaagtggacttgttccttctgtgggtagatttcattgttcaatgagtaaatacttgggccaatcaaaagcccatatctccttgaatttttatttccaacatccatacaagtgaagaaagcatcatttcatagggcatttcataggtacaccgtacgcaagtcacaagaaacaataagtatgttacgtgaccgaatatcacgaccagattagatcatcctaagcttcatctgcgcgccgtgcatgggatgcaacgtcatgacggtgtgcggtgcgtgggtgtaggacgcagcgagctcgaactcgaagcgctggaggatcatgcacaaggccatcttagcctcgagcagcgcgaagttctggccgatgcagacccgcggcccccagccaaacgggaggaacgcgccgcggtcgttggacgccctggagatcccctcggcgaacctctccggcctgaactcgtgcacgtctctgccccagatttcgcggtcgtggtggataaacagcacaggcagttcgaggatcacgcctctggggtacacgacgcccccgatctccatctccttgtacgtcttccggctgaagacgatcgccggcgggtacaaccgaagaacctcgtataaaaccatggtgacctgaaagcataaatgcagagaccgataaatcgatgtctgaattaattgtcgacactgacaacatgaaaggaaatacgatattcagtgtagtgttattgtttctccgagtacttaccgtcttgagtcggctgaggccttcgtactcaggtttgtccctcccaaacagaccaagaacctcctcccttgcacggtcttgccattccgggtgcatgctcagaacaaccatggtccatgtgagcagcactgacgttgtctccattcctgcgaagtagaacagcttgcactcctcgataacatcttcagttgtcatccctgggctggatcgtccattctcgtctgcgtgcctcatattggactcgagcagcaggcccagcagatcatcgttggtgctttcgccttccgcgatggcctgcatcctttttccaattattcctcgcagaatggattcaacctcactgttgatcctccgcatccttctgttctttttggtaggcaagtacctgcagtatagaaaatcattcaacttgacattaacaagttcgatttaagaagggaatagtcagtgaccaaaatgtagcctgctgtaacagcagagttaaacagagtatgcccgaggggaccatggaatttgttgctcacatgtaacccggaatgacgaacttctgaatggctcctatgaagagctcagcttgctcagtctgcagctggaagatcctccttccttcactgtagctgctgccgaatgccgtgcgagagatgacatctccggtgagactctgcatctccggccaaacatccagctcgcacgaaccgtcgggaccaagggaatccatccatttcccgacaagctcttcacagcacgtagaaaacgccggcagcatgagctacaaatcaacccataccgcattactatacaatcctacgatcaacctagcgtacgtacgtctgtacgagtgagacgctttcacgtgatgtaccttgagcttctcgagatggaacgcagggttcatgatcctcctgtgcttgacccacttctcaccgtcgtggctggtgaggccgtcggcgagaagcttggtaagtgccgggagcttgggcttctcgaagtggccgagcttgttggacagcacgtccctgacctgggcggggtcggtgatggtgacgctggggatggggccgaaccaggagaagcagcacggcctgccgttatcccgcacgttgcggtgcacgaacggggtgacccggggcacgatgtcgtggcagcccagcggcagcggcgccgacgaccacgcctcctcgttgagccggccgaactccctgaggtcgccgaggaggaaccggtacgcggtgccgcggagcccctgcgcgcgcagcgcgcgctccagccgccgcggccgccaccacagccggtcgagcaggcggccggcctgccacagaagcaccggcccgacgaggccgtacgccaggaggctccatggtggtggcagtgaggctcggctgaacaactctccaaaaaccattgctgtggactctgaatagcaagaagctgatgcaactggactagtacttaatttgaccggagaagtggggatggatgaggtacggatttcgcgccatgttatatagagttgtcactgggttgcattagtctcctgtgctaatttgtttatggtttcttggagtgtaaacaagactaacgaacatttgggccagctatgcccaaatgaacttggtggagaagaaattccaacccagaaatgccacgatcgggacgaccatgaggtgctgtgagcctgtgactactaataaaataaaagaactcatttacacacctcagaaatgttgaaattcagaaaaaaaatatttatgagttgaaaagaagatttgtatcagaactaaagtccatagcaccacaagaatgaaatttgaaataaaaaataacagaaatggaaacttcaattaatgggaactcagtccaattacgacggtatatttatttataagaaaaaaaataaaatgatcgatggggaaattataattgaatcagaatatactatattttttgaaaactcttttttcacatacaagttggtaactattattccgtatgaataattacattttaaaaaatattaattatataatagaaaaattgatttggacaaaaaaaatgtatttctgcttatataaattaaaaaaataactcaaataaatacatgtgtaaaactatgtattttaaagtgaaaattatgaaagaaaaactattagaataatctgttttttaaagctaaaacgattttggccaatacacatttaaaaatataaaagaacaataatgaaattttacgtgcttcttttaagatataaaagaagttcttgagcttgaattagattttttttttgttggacttaataagccgatcgaattggcttcttagttaggcttaacaagctaagccatctttgttgtcaaaacctaagcatgtattaggttcgtatagtttccgacaaaaataaacaattaataacctaattcttatgtattctcgacaaaaaggcctatcctatacaaataggattgtacaatcttttaccaactttgtatacaccagaataatctagactaatataaaaagcaccagttttctttttagtacacccacctattcttaatcgttagatcctctcatccaacgatccacatcgtgagttggattaacacaggaattagaactcaaactagaattagattaacgctcccacgcctcttcccgtcgcaaaatccccgcccacgtcgtcaaatcccacgccgcgcccttccctctcgctccaaaccgccaccgggcggcacccaccctcccgagtggccgactcccgacgcacctcctcgccggcgccccaccctcccgacgcccctccccgccgccgccgccgccgccgccagcggcgcctcccgctcggccccggccggcgagtcgcgtaggagggaagcgccaccggcggcggccggggcgagatgagcggcaggggaggtggcggcggcggggagcaggggacaacgccatcctctgctccacgactgagcaggggacgccgatgcccaatgccctcgcacgtcgctgacgaacgcccaaacttttaatctcctgctttcaacaggtaaacctgctaattaacaatgtggttcattaatatatgcatgcttgctatgtctttgacggaatgcttgcctaccagtctaccactgccaactttgaggtcaatttatgagccttgccatatgtatgctgtgctatctagatatcgtacattgaggttcccacgtgcagtgccaaataataattgttcttctaattcattaataatggttcttctaattcagtgcttaataggattcttataataatgttgcaaatttggaaggcaagaaatgatcttaaatttcagggggaaaaaatggagcctcctcaagtctgcatggcagctgaagctatgatcaacacttaaaataaaattctcttcttataattcaatacaagagaatttgcaggaagaacaaagggggaggggacctggaagactgccagacggaaccagatgttacatagatgcagcatgggaaaatggaatcacaggaatggaaattttctttcatatgccatctactcataatgccatttttcttaaagcctcctccgaggttccttgctcttccttgcaggctgagttaatggcgcttcaacttgctttggaggtgactgtcttcttaacattgaaggagtgactctcctctctgataattctaccattgtggaaacccttagaaaaggaagatttcaaacggagccaggtcattggagcttaagacctatttggagtcagatcgttgccacaattcctgaatctcttttgcaggtcatgtggattcctaggggcataaacaagttagctgaccaactagcaaaagaaaccaaatccagtgttaatacagcccctgtctatgtttgtcaaaatatatcgcatttggcttatcctaccagaagatgtcatgctaatgacattagagacaatttcaattccaggaactttgtaatccggcatgttctatgcttctaaataaagtgtttaaggttttttaaaaaaaaggatagattaaatcactttccttcacctgatttgcttataccatggccaactgaaagcactgctatttttcacctgatttgtactgaggtcacagcaaactagcaggcagcaggcttgttttgttggtaacattttgcttctatgaattatcatgtatgcatgaagtatttagatctaattatatgtttttgcctactgttattaatttattatgcttctgctgatgcggtttctgaggaggttgctctggcatccttcatgaattctccctgttgaattgtctgtacaatgcacatatgtattccacttttactaccgtgtattcccacaatttgtagcaaccttacgaaaataaagggcaaaaaagattaaatatggatgcagattttataaaagctaaatcatatctaaatattaatggccagttcgccaggccagcaagccatacatgcacagcaaactaaagcttttttataaagcaccatcactaatctctctcaatgcacagccaaaatgaaatctactcccttacagctagaataaactaagcattaatattttgttcatgacttaagtgttattccattcgatatatgcatttcctgaaggttttcatacagtaacatcactaatctttctcaatgtacggtcttttatacggtaacatcactaatctttctcaatgcacagccaacataaaatctactccattacaactggaataaacaaagcaccaatattttgttcatgacttagtgtcactccattcgatatatgtcgacatgtcttgcacctgcacgctaactagtacaataaaacagaggactgttatacatctcttatctgttgtccagttgatgtttgtgttcattaatccaaagatcagcagcgcagccactcatagcacttctgacccccccccccttttttttttgaaagtaatccaatgtgttaaaattcttatgctcgacaagaaatcatttataatagatagcttctagttttatttcaaaggtacaaatatcacaactcatatacaatagttgtactataatgaatacatgctgaaacgatcatacaactaccagaaaaaaactatcatatagctctaagcttaatctgtgcaccatgcgtagggcgcaaagttattatactttgtggtgcatgagtgtatgacagagcgagctcaagctccaagtgttgaagaatcatacacaacgccatcttggtctcaagcaatgcgaagttttggccaatacagattctcgggccccaactaaatggtaggaacgcgcctggatccttggatgccttggaaatcccctcagcgaacctctctggattaaacttgtgcacatcacttccccatatgtctgggtcactgtggatgagcagcaaggggagctcgatgatcacgccagcggggtaagtgacgcctccaatctcaatctgcttatatgtttgccgagtcaaggtcacggccggtggatacagccgaagaacctcgtagaggatcattgtcacctgcaccatatacgtacagatcaacgagttttaatttgtagtagttttacacagctacgaaattgttgacgtcaacctcatggtattatcgaatcccacaagatactcatgattttgaggcggctcagaccttcgtattcaggtttgtttttcccaaatagtcctaggatttcttcccttgcatggtcttgccactctgggtgcatgcttagcagcagcatggtccatgtgagtagcactgatgttgtctccattcctgcgaagtagaacagcttgcattcctcgatgacctcctcgatcgtcaacccttggcttgactgaccatgctctgccgtgtgtctcatgtttgactcgagcaacaggcccagtagatcatccttggtgctttcaccttctctcatagcttgcattcttttcccaattagaccccgtagaatcgaatcaatctctttctttatttgatgcatcttccggttgtttttagtaggtaaggacctgaaatgaaaaatccattcacatttttacaatgcgaactgattaaacaaggaggtgatatttcttaatgtcatacagtcatagataaattaacagttattttcttgtttgcaaatgtcatttgtaagtagtaaactcacatgtaacccggaataataatcttctgaacgcatttcaagaggcgctcagcttgctctgcctgcagctggaagatccttctcccttcaaggtagctgcttccgaatgcggtgcgagaaatgacatctccggtcaggctctgcatctccggccagacatccacctcgtacgagccttcagaaccaagggactccatccacctgctgatcagctcttcgcagcacgtggaaaacgccggcagcatgcgctgcagagtctcgcacgttccaatattcagacacagaaaacagcagagagagagagagagagagagagagagagagagagagagagagagaagaagcaagagtttactagtgcagtgttgtgtggttctgtacttctgtgttgtgtggttcaccttgagcttctcgagatggaaagccgggttgaggatcctcctgtgcttaacccacttctcgccctcgtggctggcgacgccgtcggagagcagcttcgtcagaccctggaacttgtgcttctccaagtgaccgaatttgttggacagcacgtccttggccaggtccgggttggcgatggtcaccttggggatcgggccgaaccatgagaagcacgccttgccatgctccctgacgctgctgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagccgccgcggccgccaccacagccggtgcagcagccggccgccctgccacaggagcaccaggcccaggagaccgtacgccagcgagctccatggcacggaggctggacacctcaacccggctccaagaaccattgctggggtcagtccacgagtgcaagtgtgcagatgagtggtgtgaaaagaagcttttgactactggagatggatatggtacggtgttgggcgaggttaacaaaaattttgacaatttggtcctttacaaaaactatttttataaataaaccaccgccaaaatttattttaaaaatgacccttctatttagtgtcacatcgtgtggcgctgaacttagacacctcagcgccaaatagcgtggcgctgaatgtgcgttgccacgctgacttagcctcccatttgcggtggcacggcattcagcgccaattgacgtggcgctgaggtgtctaaggtcagcgctagatgatttggcgtggaaaaaaaattatttttaaagtaagttttagcggcggttcatttataaaattagtttttccaaagggttaaattgtcaaaatttgtgttaaatagaggtgctacttggttgcattagtcacttgtgttgatctgttcaagccgatccgagttgctagcattggtaggtagtactccctccctctttatagggacattttaattgcactatttgaccatttatcttattaaaaaattttaaaattattatttattttatttgcaacttacttattttaaacgtaacttttccttttattatatttatataaatattttaaataaaatgagtggtaaaacattataagaaagtgaatatctcgggagacgaaggtaaggaacttcgtagagaagaaattccagcgggaactgatattctgattagtcaaagtgctcgcggatggtgatgagtgacgccccgatgctactccctcaggttgataacgtcgttttggataagggcacggtctccaaaaaaaataactttgactattattttctattataattcgtataaaagtgttaacaaatatatgatcttattaaagtattttttaagactaatctagataaatattttaaaaatgatttataatcaaagattctcaagtttaacctcacccttatcaaaacgacaagtattattagaccggagggagtatcattttaggattgtttcgcggctgcttcgttttgcacttttgcttgcttggttactattgtgaagaatatcagatgaattgggctgcatgaaaatgggccacgggccatgggccacatgcccatacaggtagtctaagcagaattttggagtccttgtcatactggctatattggagtattttgtaactgaactaattactcaccgagaaaattctcacaaaataaaaacaatactaccaatttttttaatcataacaaagagactatacacgcgtcgtctcacatagcattaagtgtcatattagaaaacgagcgtgcctgttagcacaccaacaaatttatagccctgtgtgtattactatgtgttttgctgttaaattattgatttctacctagcaattggttttggttttctagaatataagatatgaacatggtaatagtatttgtcttaactgtatttatctcaatattttcttaatattgtaggaaaattcttggggttacttgcataagtacttgtaattacgcttgattagtcttaattttcaattaagtctgtagtagattgtatttgttcaaatgataaatctgtaaggctgtaactcctttggtttcactatttaatttatgttttattttctattcatataggatgttactatcatggagttacttgcctgaattttgatttaacatgtattaattgcttttaaagaaaaaaaatcatgggttagaaatcctaatatttctcccgtttctctcctttttttaaacaaaaaatatgcagttttctcgatctctctagatgcaagcgagcactttcgcatgttattttgcatggagaccaattccatgaataaggacatgccacatggcttatctctccggcgcttaatttgcacatatttcatgttataagataagctaactccaaattttgcatgaaaggaatacaatgtgtcaaaaaaaagggaaaacgaggagaaattacaatggcgtcctgacccacctcagcaaaagcagcactactgtgactcgctgatttggaatttttagggcctgaaacatgttatagccaattgtttttgctgttctaatttcggatatatcacggctgacagataactacaccaaagagcgagtgcagtgatgtatctttgcgctacggttcccatcataccaccatgccggaggctcacacgggtcatgagaaatttgagcaaacgatggaagaaatcagtgaaaactgaaaactggaaggaagggggtaagttggaagagaaattgagtggtggttttttttttacctattgagttgtagaggggagagtgaaaatacatgtgacttgtagagggttatttggacttttcccataaaaattaagcttaagaaattttattatagttaactccaaatttggttgtaaattacaaatatgccctcgtaaccaattgttgtactaaaacacatgaatctgaaataatcatatagctctaagcttaatctgcgcaccatgcatcgggcgtaaagttaccatactatatggtgcatgagtatacgacggcatgagctcaagcttgaagcactgtaagatcatacacaatgccatcttggcctcaagcaatgcgaagttttgacctatgcaaatacgtggcccccaaccgaatgggaggaacgcgcccggattcttggatgccttggagatcccctcaacgaacctatctggcttaaactcgtgggcatcactcccccagatgtttgggtcatggtgtatgagtaacaccgggagctcgacaatcacaccagccgggtaagtgacacctccgatctccatttgcttgtatgtctttcgagtgaaggttacggctggtgggtacaaccgaagaacctcatagaggatcattgtcacctacacaatgcacatataagtgagttttagtactacttctagctgcaaattgtttaagtcatctcatgagaacgaagtggtattgtcgaattctacaatatactcacgattttcaggcggctcaggccttcgtattcaggtttgtttttcccgaatagtccaaggatctcttcccttgcacggtcttgccactctgggtgcatgcttaggagcaggatagtccaggtgagtagcactgacgttgtctccattcccgcgaagtagaacaacttgcactcctcgatgacctcctcgattgtcaatccatggtttgattggccatcctcttccgtgtgtctcatgtttgactcaagcaacaaacccagtagatcatctttggtgcattcaccttctttcatagcttgcattcttttgtcaactagaccccgtaaaatcgaatcggtctctttctttatttgatgcatcttccggttgtttttagtaggcaaggacctgagatgaagaatatatcccaacacaatcataaacagggagaatcatcaaaaagaagatgaccaaactaaccctcaactcatactaaattattcggtatattaagtgctgaattctcacatgtaaccaggaatgacaatcttctgcatgcatttcaggagacgctcagtttgctcggcctgcagctggaagatccttcttccttcaagatagctacttccgaatgcagtgcgagaaatgacatctccggtgaggatctgcatctccggccagacatccacttcgtacgagccgtcagaaccaagggactccatccacttactgaccagctcctcacagcatgcagaaaatgccggaagcatgagctgcagagtatcattcgtacattatattccaatgcagagaggtgcagaaaaacagaaaaaataaatctatctaatactactagtaaaaatagtctgggtaggtaccttgagtttctcgagatggaaagccgggttaaggatcctcctgtgcttgacccacttctcgccttcgtggttggcgaggctatccgaaaacagcttcgtcagagtcgggaacttgggcttctcaaagtggccgaacttgttggacaggacgcccttggccaggtcggggtcggtgattgtcaccttcggcgtcgggccgaaccaggtgaagcacgcgctgccgtgctccctgacggcgttgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagacgccgcggccgccaccacaggctgtgcagcaggcggccggcctgccacaggagcaccaggcccaggacaccgtacgccaggaggctccatggcacggaggctggactcatcaaccaggctccaagaaccattgctggagtcagtctatgagtgcaagtgagtggagtgaaaaggagttgatgcaagtgtgctttgactactggaggtggatatggtatgtacggtgctgggggtgaggttaaatagaggtgtcacttgcttgacggggccaatcagcattgctagcatagcatcgatcctaggaggtaccttgctggtaaggaacttggttgagaagaaattccagggggaactgatactctgattggtcaaagtcctctcggatgggcgacgcactggacggctacccgccatgtgaggagtgcttcgcggctgcttcgttttgcttgatttttatttttcgagtggtcgttttgcttgattagtggttactgctacgcattggagaaaaacgaatatgcggtgaacagtgataattcgaatagggatattttctcccaaatacgaatacgaatatgatatcagggtttccgacgggtacggatatccggtgaacagtgctatttagatatccgctaaagccataagatataccacatttctttataactctatgtctttcaatgtacatttttagaatttagtagtaacatatctcttaacactagtcaacactattaatattatttaaacttttaaatatgtttataaattatactatattttatataaaacgagctaattatatatgatgatattcgtttctattagaagttgaggtggttttcgtgttttgataaaaaaatattgccatattcatatctgattatattcgatccttattcgtatttgagataatttgtatttgtttctgtatccaagccattcgtattcgtttttacacccggcaaaaaatatgaaagcgaatatggtatgataattgttcgtccatatctgctctgtttttatccctggttactattgtgaactgagtctaatatgacttgggccgcttgaaaatgggccacaggccatatgcaggtagtccaaccagaattttggagtccttggctactacctccatcgcataatggattaggttgttttagagaaagaaaaaaaaaggaaaagactattatgtccataattaaatgaggagtatttgaaaagtgggaggtaggttggggtaaagtgtggagaaatttgaatgagagttgttggagggaaaagtaatactacttagggaaaacatttggtaaagttgacaagtgttaagctatgggggttgttcactttgatgcttaaatcaatatttactaagtttttgtgaaaggaagattctagaattatcaaagtttaatagtggaggcaagtttttggtaatgtttggattgttaacttgtaaaattttggtaaagccaaaacttggtaaggtttattttggcaataaactaaacatcccctatgttttgtttcttttgtcatgtttttgaggaagattatagaattaccaaactttggtagtggaggtaagttttggcaatgtttggattgttaccttcctaaattttgagaaagctaaaacttggtatggttaattttggctataaagtgaacatacccttaatctcttacattttgtgacaaaaatttgaatttgaataccccaattctttatattatattatgaacggaggtagtatagtggagtaatgtgtatacctggactaattgctcgctgaggaaatgctcacataatcacattaggggaaaaaaacatacccgtccatctagcatatactccatctgtctcatacaataggacattttgacttttttaagtcgattttttaaaatttgatcaagtttaaggaaaaatataataacattctcaacatcaaacaaacatataatatcaaaatatatgttagattcaatgaaactaattaaatattgtagatgttgttaaacttttctataaacttaattagtcaaactaaaagaagtttgacaaggaaaaaatccaagtgtaaaacggagaggtatataccaagtcataatgaacggcagagatataaaatgtgagttccttgtaaactatcaagtagaataaaaattacaaattcacaacaggaacaaatagtagtaacttgccacctactttttcaaactccaatacaataattactctaaagttgaagtctttataagaaaaacgaattggataaagataaaattattttgagacaatggagtaccgaccaacttcagtaaatacaacaaaagttggaaggaaacatagaagattaaaacaatattttttgtgcaaattctaactacatatcgagtacaataggttgaatcattgaatgacaccacattaccacatcgatgatacttcacctaaattatctctaaatttgggtttagaataaaaggagaattgtttagaagttgtcaatcgaaaatcagttaggccataattgagaggttatgaaacaaacccttttttagattaatgttttatatgtcctgtcctggaatagatactaggaggtgtcacaaatgagtttgaaaaaagtttaagattgaaatatgtgatacaatctcagggattgcaaaataacccgagtgattaagtgtacgattgcataataaaacaaaagaaccaaaatttgcaaaaataaaataaaattttgttgtatatcctcaacaaacgtaaaaataagtggagtgattaagtgtacaatcgcaaacatatattcaattggctttctctagctctataaattttcacctcaccatattcaattatttgtttgctttatttttcacgctcatcagcacgtacaagttcccctgacatccacacatactataccgtgtcaacatacgtgcacctagttacatactaatgtatgtgattattgtgaaccatttttctgtgtcgatccatatattagcctatggaaaatcgaaaatgacatatatatatataagcggattcacgggtggccgctgctaccaaaaccagatgatcatagtcttgtgagtataatttgtgcaccatgctgcggatgtagcgtgacactggcgtaaggagcatgggtgtacgagggcgacaactgaaactcaaagttctgaagtatcacgcataacgccatcttggcctcaagcatcgcgaagttctggccaatgcagatcctcgggccccaaccgaacgggaagaacgcctgctgattggtcttggtcgccttggagatcccatccgcgaacctctctggcttaaactcatgggcatccttcccccacacatcggtgttgtggtgaatcaggattatgggcagctcaaggcccacaccagccgggtacgtgatgcccccaatctgaatctccttgaatgttcttcggctcaacgtgaccgccggcgggtacagcctgagcacctcatgcagtatcatcgtcacctgcaaaagataaacagagtatctaggcatcgtgagcaagttaacatgtgtactaccacttgtgatcaaatatggatgaagaaatatgttcaggttttgacaagcacttgccgttttcagtcggctcaagccgtcgaagttgggtttgtcgcggccgaacgcgctcaagacctcttccctggcgcggtgctgccattcggggtgcatggatagcacgacgagcgtccaggtgagcagcaccgacgtggtctccatgccggcgaagtagaacagcttgcactcctcgatcacgtcctccgtgctcatcctcaggttggacggctcaccgctgtccatgttggacttgagcatcagcccgagcaggtcgtcgccgctgagctcgccgttctcgacggcgcggctcctcttctcgatgatgcccctcaggagcccttctatctctcggctgttctccttcatcctcctgttgttttcagttggaaagtacctgcatgacacaggaacaggatagcaacaactaatgtcagagatacagacatacgtatactgtacgatgacaagtgacacacaggggacgggagcattggttaattaagctggttctcacaagtagcctgggatgtagatatactggatggtcttgatgattcgatcagcttgctcttcctgcagctggaagatccttcgcccttccatgaagctgctgccgaacgccgtccgggagatcacgtctccggtgaggttctgaaactcctgccagatgtctagctcgaacggtccatcagagccagctagtttactgtcccaacggtcgatcatctcgctgcagcacgtcgagaaagccggcaacatgtgctgaaaacatcaaattcagttcagtaagcatacacgcacacacacaggtattgaggtataaatcactccctgctagcttgtaacaactaacatatacagtatgtaccttgagcttttcgagatggaaagcagggttcaggatcctcctgtgcctcgcccatttctcgccttcgtagctcgcgagcccgagggcgatcaatttcccgagacttttgagggtgaatttctcgaagtggccaaacttgttggataggatgtccttcactagctctggctcagcgatgaccactctcggcgttgtgccgaaccaggtgatgcacacgttgcctacattcagttcagtgttctgtgccgtcagatagagctcgatgaacagcgtaaactgaacataacagcacgcgcatactttctgaagtatatatgaacttgtgttcactattcacgaaactggaaaagtcatagcaatagaggcatgcatggaggcatgtcaagatggattctaatagctcgagtggacgtccacccgtttattgcatgtcaactagatggctacgaaaagttttcaaaacaattgagaagatagatcaatatgtaatatatcaatccacaaacatgcaagttcaaatttaacttctacaaattataacaaaaataacaaaatgtagaagttgaattttaacttgcatgtttgtgaattgatatattacacattgatatatcttatttatatttttttaatttttttataactatttagatgatatgcaataaacgggtggacgtccactcgatctgttaaaacagtttcccttatgcatggagcttaccgtactccttgacgatgtcctgaaggagcggggccacccgggggacaatgtcgtggcacggcggcatgggcttagcccgcgcctccttgctgcgccgggcgttctccggtaggtcgccggcggggaaccggtacgcggtgccgcggagcccctgcccctggagcgcgccggcgacccgccgcggccccagccagcacctctccgccgcccggtagagcgcgcctagcacgagcagggccgggacgccgtagtagagcatgccccacggcgccgccgccggcttacctgcttccagtgagactcccacctccattcccgtggcctcctccattattaccggttccctagctagttggctgacttgttgagactgcgaccacagctgccaagagcgcgcagtgagtggtttctgttggtacgagtggcagacgcgcgagcgttttataggcatacgctttgcttggcgtcacatgtttttctccgtctttgtgaggtttcttggcggccacggtcatacatacgtgcctggattttttttcagctagcgcgattgcatcgacaaagtgtggcagatagccagtgtgtgatttgctagttagttgtttgctaacttgctgcagaagctgctagcattttggatttttggtgctgtaaagttagtaaataaatgtggatttgttgctttcgttcctctggagtaaataaaacggccggagagctcaaagatgttctgactctagctagagtgtacgacatcctgacgtgcgcagaaacgtaggcagtgccgggtaacggaccggggcccaacgtcccagtccattacttttttggcccatccggagtcctgtcctcctgcccctttaggcactggaataagttcatttgaggtcccttaatttgataacgagtttgattttcatccgtcaaccataataccagatacaacgggtccctcaagtgtcaaaaaggatacaaacaaggtctctcaatagtttggatagcggttttggctgccgtggcacctacgtggctggtttcacttagtcctcgtcctacgtggtggtaatgtggcattggaagcaaaatataaaaattaaaacaagaaatgtggggcatatatgtaagttagacaaaagataaaaaatagtgggacctctctctctccacggacgagcatgcacagaggcccagagagggtgaagggtggcggtcgatgtgccgaagccagccgagcgcgtggatagggaggaggcagggaggccaagcgagtgggcaggggagggaggaggttggcgaggggggggaggctgagagaggtaggagtaaccgccaccgcccttctcaacctggcgccgctttcttgagtggcacttgcaacccaatggcagcctcttcctcgagaggtttaacgcgatgccagagtcattggagtcatccttgatgctcccaccaatggcctgatgatgacccatgtgccccaccgcctgctcaccgagattgatggctggaggctgcggtcgtggaggagtccgacctcgctggccttcttcctcccctgccctctcgccgacctcccctcctcctccctctccacacacttggctagcttcggcttgccagcggagagagaaggacggcggtcggcggaggggcggcggccagcccttctcgctgttgaggtcgccccaagtgaaggggagcgggaagggcaagcacgcggcgaggtgtggaagggggcttaggtttcagtcctccggcggctagcgtcgccctcgtagcgaggtatgtcgcgacgcacgatggccgccacccccaccctctccggctctctgcgcgcgctcgcctgtggaggtagagaggagggtggaaccataggtaccactatttttttatattttgtttgactgacatgtgggcccctttgtttttaatttttatattttgcttctagtgctacatcatcgccacgtaggacgaggaccaactcaaaccagccacatagatgtcacgtcagctaaaatcgccatccacactaccgagggaccttgtctgcattggttttgacaattgaggggcccgttgtatttggtatttgcggtgcagtaacgaaaatcaaactcgttatcaagttaagggacctcagatgaacttatttctatgttgaacctttccgctggcccgtgaactgggaagtagataggcctactagactgtttcaccttaggtatgtattttagcccgacccatctctctgtttcacttactaattccagttcactgaggcattgcgtttgcatagcatagcatcagggagaacctgtatagtagaaaaaaaattgtcactgtagtatagattcacggcgatttgcaatttgatttgcattttatataaacataactgtgtttttatgcttacagttattatagtatgcttgttggggtatattggtaaataatcgcataaaaaactaaacttttaattctaagtcataagatccattgttttacccacgcatgaaataaacaaacaagtatatctttttttctctaatggagggacgaacagtatgtactagttacacatgttaatatagtggttacaaaaatgtttgacagataaaaataatcactcattcataaggcacgtacgtagatggtccgaagtcccaacttaacctctaattgtttttttcccagaggaaaacctttcctaattctattaccagaaatgacgtttataacaaagtcaacatatcccaacttacctttcaaaaaaaaaaatttatcccaactcatgatagttacatttaaagtgggcgagccccagacatattctgagctcacacaaacaataattcaacaccacatggtgggtgccccttccttgattttcttctccaccaagttccttctgatcaaggtttagaccgcccaaggctttgaccaataatacactatcagaggcaaccaagaaagctagcaagcaacttccttgattaacatcgataaccttaaacaaatgagcacacgaagaccaactgtcccagcgacactcctatataatcggattcgaatgcgctgaattcacatgtacacaacaccgtatactgtcccttccggtcaaagtacactgcccgctgacagtgaccagagattctactccagcttgctactcattttcgagggtgttgatcatggatccgacctcggtgccatggagctccatggtgtacggtctcctggggctcgcgcttctgtggcaggtccaccggctgctggtgcggctgtggtggcagccgcggcggctggagcgggcgctgcgggcgcagggcgtccgtggcacgtcctaccgcttcctcaccggcgacctcaaggactacggccggctgagcaaggaggcatgggcgaggccgctgccgctgcggtgccacgacatcgcgccgcgcgtggcgccgttcgtgcaccggaccatcgcggagcacggcaaggcgtgcctctcctggttcggccccatccccaaggtgaccatcgccgacgccgagatagccaaggacgtgctgtccaacaagatgggccacttcgagaagctcaagttccccgtgctgtcgaagctgctcgccgacggcgtggccaactacgagggcgagaagtgggccaagcaccggcggatcctcaaccctgccttccatctcgagaagctcaaggtacacgaattaaattacagtacagttttgtgatatctatatattacagcacaagtatttaccgtgatagactgtgtgactgtttccttgagtaatgtatcatgtatgcttctgcagctcatgctgccggcgttttctgcgtgctgcgaagaactggtcggcagatgggcggcgtctcttggttctgacggttcgaatgagatcgatgtttggccggagatgcagagcctcaccggagatgtcatttctcgcaccgcattcggcagcagctaccttgaaggaagaaggattttccagttgcaggctgagcaacaggagcttttcatgggtgccattcagaagatctccattccaggctacatgtgagtttgtttttctctgttcatcaacactgatttagtggtttatgctccacgcctctattgtaacactaaccagaccttacagttatacataatttctatcgaaattaaatgtttgttattcagtactcgtagttcctctctgtactgaaaatctgaagcggtgtgccctttcaggtccttgcctaccaaaaacaaccgaaggatgtatcaaattaagaacgaggttgaatcaattatacgagatctggtccagaaaaggatgcatgctatgaaagatggcgagagaaccaaagatgatttgctcgggatattactagagtcaagcacgaggcatgcagacgagaatggacattcaggcccggggatgaccatcgaagaagtgatggaagagtgcaaagtgttctattttgcagggatggagacgacagcgatactcctcacatggaccatggttgtgctaagcatgcacccagaatggcagcaccgtgcaagggaggaggtcctaagcctatttcagaaaaacaaacttgattatgaaggcctgagcaaactcaaaacgtgagtaataaatgttgaaattaagtaacttttttaggaaatccatgtttaagttatcttttagatgtagagatgatattgaaattactaaatcacatggcaactagaggtaattaacctttggtacatacaggtgacgatgatactttacgaggttctccgcttgtacccgccgggaattgggtttgtccggcaaacatacaaggagatggagatcggtggcgtcaagtaccctgcaggcgtgatgatcgagctaccgttgttgttcatccaccatgacccagacatctgggggagcgatgtgaacgagttcaaaccggagaggttcgccgaggggatctccagggcgtccaacgatcatggcgcgttcttcccgtttggctggggcccgaggatctgcatgggccagaacttcgcgctgctcgaggccaagatggcgctgtgtatgattctccagcgcttcgagttcgagctagcgccgtcttacactcacgctccccatattgtgttgatgctgcgtccgatgcatggggcaccaattaagcttagggcaatctgatcgtcgatcttgtgatgttcatatcatgcattgtaggctttttttttaaaaaaaatggcatgtttggtttataccaatcaaccatgccaccaaaaaataatttagccatatcaataaattaattctccatttagtttgtaaagaaaaggtattgtcaaatatttggtttgattgaatcgacactttaaaaatatagcaaaacgaatattttgcaacttcatcaaaattgtactacctccattccaggttataagactttctagcatatgtgaatgtgggcaataccagaaagtcttataatattaaacagatgaagtataaattttatagtaaactaataatagcgtgaccaatcttaataaaattccgaaaacaatcccaaataggggcggacccagagaggttcccggtatgcaccggcatacccaaaaatcgcaaaaaaaaaaaaatcagcaggtagtatatgcatcagtgggctgaaacttgcctccatgaaccaaggcccaagatgcccacttttactgaacttgcacagcccatcaaaagtgccagtgcgcgtgatgcgttgatggggaactctagtctaaatctaatcgattatctcttcaggatagaaatttctagtaaggtgagccatggttgatgacttggcttatcggttccgatttgtattgtcttgtattgacacctcaataggcttatgatggcttgccttggttaccctccctcctaggaagtgttgattctagggttgtcttgtccaaaaagaattagaggcccatttaggatattgtcttgagtagtcctaagctggcttttgagttagttgtgtatatccacttatggatatagatgctaaatttctatccactatcttaaaaaagtcggcttcgggttggaagtcttcttttcttgttggaaactccttcattatctgcttaagactatatccctattttggggctttttccatatagaacctagtatgcaatagtccaaatgagatattttcacacctttgaggtactcaatatttcgtacattaataggaacaatcatcacaatacatgaacaaagtcattaacatcccaactactcaaggaatagaatgaattcaactctaattccctatccattcctaactatatcaagttgagtctatgagaactatcatggtaaacaattgcgaggcacgagacaccctcacctatgttgagcggtgtcgcccttagctccacgttgcttgcacccgagcgtcacctccttcgcctccctaccacaccgacactggtacccaacgccttcctcgaccacctcaggtcccctcgttgtctgaacccctacgagtctctgatcgggttttagggacccagcggggccaaggcctatttttgccctttctcatttcagttctaggcggcagctccgttcttatccaactgtcatcggctccacctgttgccaatcccagttagcacagataaaaactaaataaacacattatcttctttcgtattccctccatctcaaaataaaacaacataagataatatgggacataatctagtataatgaatttaaacatatgcatatgtatgtctaaatttgttgtggtaggttatgtcctgttctattctagattattttattttaggatggagatagtataaggcccaaagatatcaatatcttgtattgcagaccatttagcccacggcttggacagcccattacctggcattgcttctagaacgtctaattacgcctagcttctagaatgtataattgcattattgtggggtaatccaaatcaatgcggttctccgatggagcagagccatacagtagttagcacgaatggcgtctcatgaatacgctccctaaaatgtaccagggtggcagggtgcccatccatgcgtcactccattgctgcacaagcgccgattccccgctgtccggcggctgcatgtctgcatgtgcgtagggatgaaaatggtttagaaagttttaacattccggacatattttcgaaaatggaaggtattggtcaaattttttcgaaaactttcagaaacaaaaacgaatttaaattttttttctcagaaacaaaaacgaatatgataaactactatcttcggaatctggaatccgttggaaatattctgaaaacgaattcggatcttttcggagtagtaaatgacagttgtttggcttcagccttctctgctctagtgtttacatttacatttatatatattgtgtattgaggtgtttagttaaatggagatatttttttagtccaatgctttagaatttttttgcctaatgaatatttttattaggtcatgacatactacttataattacaattatagataaatatatttctttttctccaaaaaattttctaagaaagtaaagtgtacaactaattgtattgctattaattgataaaaattagcaatattgatttattgttttagaaaaaaaaaaagagttgcatttcttcgttgatttgagaagttctgtttaaaggatttttatattttgttaccgtattcactcgttttcgtatttgatgatacagtatttgattatgttttcaaacttttggtttccaattctaatttcaattccaaaaaaagaatgtgaaaaagggaaacgatggagatgattttcgttcatttttgagccgttttcatcctagatgtgagcacgtgacaatgtacacggaaggagcctcttacgcaagcgcttgggtcatcctctcagcattgtggaacgcagacttggagccttccctacctgacgtaatgcatgacacaaaccgcccattaaagcggagtagtatatatgatgcaggcgagcgattcacttgttgacagggagtgattgtgtgaggctttcaacttgtgagattactgggtaattgaagctggcattattatatactccctccatttcaaaatgtttgacacagttgattttttaagcacatgtttgactgttcaccttattaaaaaaattgtgaaatatataaaactatatgtgtacatgaaagtatatttaacaataaatcaaatgatatgaaaagaataaataactacttaaatttttttttgaataagatgaatggtcaaagacgtactaaaaatcaacggtgtcaaacattttaaaacggagagactatttccttgattctttgcttgggcgaaaagaacacgagcatgccatcttctcttgaataaaacgggagaggacaagcacgactagcacacgtaccagctgcgacgctttcatttaatttaaagccctgacgatgtcatcgtccgttgatagttccatttagcaaatcagagatccacgttttcgaggggaaactggtagtagcctaggagaaatcttcgtgtggttggctcattggggtgcatcgctatcaggcatagcgcctggtgccctcgatcttgtagtagtatttttctccgatccacatctttacatgtctccgcgcgacttgcacgattgcgtccgattgagtctggaagaagcggccgcctgtatagtatacttagaaaatcagcgtgccagatggcacatcaacctatttatagccccatgtgtattacacttaaattaattatttctatccatttatttaattttctagaaacacatatgatatcaacatggtaattaataaaatatttgttttgattgcatatctagatatttaaacctccaagcaatgttcttgctactacttacttctgtattatttttcataaaaaaacgttatgcttgaaaaatactatcatgatgttacaaatttaaattgatgatgaaaattcgaaattctttctgtggtatatgacgtacccactgacagcaagttgactttattttttgtttgacattacaagttgacttcattaatcttcaaatatatcagctcatcgttttagaggtgctcataggaaggaataaagtgtatatatacgtgtgaccttaattagtaggggttagtgtggtgagtgcttgtgtgttgtaatgtgttttctaaagaaaaaattcaaaaagttttacaacaacttaatttaaatgtttgatatgtcattttttacatgtaggatgcacgcattctacagacacatcattgtgcgcgtgcatattttttttacacacggcaagaaagagatcagatataaccaagcttgtaattggacatgcacgcattagtcatgtacttccgtgctaatgtagggcatgttcattttgatgccaaaataaattttatcaaattttggcaatatttaagtacatttgctagatttttgtgagtgaaagattttagaattgtcgaactttaataggggagctaagttttgtcagattgttatcttgctaaattttagtcaagccaaaacatggttaggttaatttggtaatgaagtgaaaaaccctgtagaattagcgtttggtggaaactcttgtgcgcagcgagtatgatgttgcagctccatcacccgaaccagtgctcagtcacttaattagggtgtgttctatgctccatctccctatcttctcatcttatttttcatgtgcacgtttcccaaactcatctcatactctcttatttttcacatgcacgtttcccgaactgttaaaccgtgcatttttttaaaaaaaagttctacagaaaagtagttgtaaaaagtattaatccattttaaagctttttagctaatgattaattaatcatatgctaataagttattccgtttctcgtgtatgtgtcactaacttgtggggtttatatcagtattaatatattttgtttacaatgacataatcaaattaaatttacaatgacataatcaaatgacaaaaagtttatactgtaatgtatttctaggagactgattcaatctatgaaaatctataaaattttagtcgacgagattcttggaaggaaatctaagcaattcaaaattcataattaatacaatgaagtgattaaaagagaacattttcctctattttagtttttctaaagaatctagaaacggctatattttgaaaaaaaaaggaccgtctctgttttttttaagtatataacatgattaactatttttatcaaacctcgactaacaacatttattaattacttatagttaaataaacataaaaacaccactagatttatcgtcaaaataatttaagcataactagtagcatgtttgtctatttcttgaagagatgaataaaaaaatcaactgcgtttctaataaacgcaatagtagtacagtagtagtagcagctctttttttcaccctgagaggaaaaaaggtttgtaagtacatacagcccggataagttttcaattatttttttacttttttaccttttattttaaaagcaaaacttctaaaatttattttcaaagtctgaaccttttggtggcgttagctagcttgacgtggtaaaataacactattacgtaaacatagcaacaactattatgtaaacatagcaacagttttatcctcccacaccagctaggatagcatggcaagacaacactaccatgccagcaagatcggctaataaaataacattatcacaccattctgacatacatgacaatgttgttttgtaaggcaacctagctagtgtgaccaaaaggttcagattttaaaaataagtctttaaaaagtttgttttaaaataaaaaaagacttaaaaaaagaaaaaaaaagttctgtggaccattagtttggctctccgtaaagctacggattataagttttaacaattttggatttttagttttgattttaaagagtaacttatcttttttactctctttgtctaaaagaataattttttaagcttatctaggtacatagttaaaaagtattatgtttaggtttagttaaagatactcttttaaacagcaaaagcaagataatgttggatgaaaagtggagtagataagaaaattacataatgaaggattgtaataggtaggaaagagtatattggtggagctgtttatattttaggacaaatcttaaaggtaaaaaatgttatattttgataataacttatactgatattgattactccctccatccctaaatataaaggattttaattagatgtgacacatcctagtacaacgtcatatctaacctaaatcttttatatttagagacggagggagtacaaaaatggtgttaatccttttctatgcacgaatgctttacttagagcctaagcatcttgatttcggctctatgcttgatactactacggagaaaacaacgcatgtttaaactagggtttgcaaaactgtaggattatcatgcggttatcaccgttattatatgtagtaaccttatcaacttctgaaaccatagtaaatctggcggtaaccgtgtagtctaaaacagtaaaacctggtgtagactctagtaccagatgtcgtgggagattttttttttcttgtgtaatcttggaacgtgtcatcccacctatcctacatatttaaaggccacacatcaccgtcgagatcatcaacaatatcggctatacggtttcgcggatcacctgtggtcctgtgcagccgtaccgtacgcctctgctttcctctcaccccaccgcgccaccggcgagcggcccgcgagggaggaggcgctgccgccgcctctgctgatgctgatgatgctaggggcggcctcccagtggatcctggccgccgccgcggcggcggccgtggcggcgctgctgtggctggccgtgtcgacgctggagtgggcctggtggacgccgcggcggctggagcgcgccctccgggcgcagggcatccggggcaaccggtaccgcctcttcaccggcgacgtgccggagaacgtccggctcaaccgggaggcccggaagaagccgctgccgctcggctgccacgacatcatcccgcgcgtgctgccgatgttcagcaaagccgttgaggagcacggtatagtcctctccctccagcgaatttccagttttaatacgaaacagtactgagctaacatctgatggtacataaaaggctaatcggagttgagatcgtgcttgcagattagcttcggattttacccttttaggaaacagtaaagttcttctaattttcaaaaagagatcttaccgcttcttgttccaatatactcccttcgtttcgaaatgtttgacac

SEQ ID NO: 57790 - DNA, 7067 bp, Oryza sativa
tcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgagggtgaaacctgaggtgtggtgtgcttggctagagggggttatgcgaagggtcctgtcacggcctctttccggtatgtcgtggtggcatgtcggcgtacggaaacgtgtcgtggggctgtgtctcgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccacaaacccctccttgtatccccttgcacatctgcatcgttggagtaagagtaagagtccggtcaaaaaaaaaaagtaagaaagcgaggcaagcaatattttcatggatcctgcaccgcctacttatgtggttctcattcttcgccaccatcttcagcaagctcttcgtctacgtatgtaaaatgaagtagtgacttagattttatgtgttaataatattggtggtttgtgatattatatgtgtgaaagattagtttcttgttatgagatttcggagtataatagatgattggttttgtgaaataacggttgttgtttaccggccgggtgtggctggttagactgtgggttatgtggcagtcagaccggccagcgatgtaggatctcttattatgatcgagttttttgttgcaagatttaatttcatcctcatgtgaattcacgcgtgttttatggttttggtgcagcgaatctgatcattcatgtacttcacacgattctctagctagatatttgcattcactgaattagttgtatgtgcagaggaattcatggcaaccttatcttctgctgcttgcaaattaatccatgaacacttctaacgccaaaccgttgagaattctttagaattgtgcgctgggttagttcatcgatttcgctatgatgaagtggacgaatagggaaataggcacgatcagaaagtttgattttctgtttcatgttattctgacgaaatgtttttgaatctagctaaatgtttgcttagctttattgagcacaatgcattggattaacggggacgctactgagccttgattaagaatagtctgagttttggatcacgttaggagtttatttaggatcatcaatttttgacagtatagcttctgtaaccacaccttagaacataccgtatgagtatgtgatttgaaaccaattgtttcagcacataaacttgtagtatccattagaattatgacatgttgtcatgctgatcaacttgtttgatcatcaaaatagttctttttttttgttcatatctgtactgattatgctgtagctcacaatctttagtacttttccaagactgatcgttcgcacgtgcaatataagttcgtgtaccaaaacgagcattttacatgttcatgtactagattacattcacctaacaagttcgtgtaccaccgatgcaatttactctattatatacttaagcttaacagttccgacaaaagaaaactgtgaccaataattcatcatagtaatccattccggtggatgtaaaaataaattcatatcattccctgaactctgaatttctccgagatgtttcttttgtgcgcttgattgctttcatcttgttaaaccgcactgaaattcatgcacagtaacaatggtgttcaatgttcattgacaggctgatcccgtgcaacgtgtccgcggtgtacgaggaggacgagatctacaacgtcgaggaccagccgccggctatgaacgagtcgagcgtgcatgagtgggggaggagagccgcgacgccgaggcgacccgcatggccgagccgagcagttggagaagcaggtgctgaccttcaacaccgccgcccgcgcggaggggagcgcctcgtgctcgcgcacggcttgcggctgcggtccgacctcaccctcgccccacgcgcggcgcgcctcgatctgccgcgtccctttcgacctcgccgacttccgcaaccgctcgtcgtcgccggccaggacaagacgtcgggatcggattctccgccttcgtgcgcgcctactcgcacttcctgggcatccgcttcctcttcgccgcacaggacatggaggccgtcgcgatctagcaatggcagcggcggaggtcacgaaccgagcaaggagcaacgacatcgacaggacttcgccacgacgcgtagacacggagggcgcggggttctccagtatcttcagcgatgggtgaatccgtggatcccaggtagatgacgatgagcagcgcatccagggccaaatcgttcagcggccaaactcggcgcgcgacgcgagtcctaaacagaaccgaaccgaacctaagctacttccgatgctgactcccgtttcttcgattaatctactataagtatcgcacctgagaaccacctcctgcaatcagcaaccagtgaaaaatatcatacaatcgcttatttgtttatttttttgaaaagaatacaatcgtttataattattcgcttatccctttcacagcattgagagatttcaggaaaaataactcatggagcactccaagcaatccatccatgagctccaggaggacggtggtgcagattccggctccggctccaaggctgaagcgaagacagatttggtggcaggcgggaataagattcaagaagaaaacaatgatagcactgcgttttgccgggggtgtcgtcgccgcctcatccggttcgccatcttgaccatccggttcgttctcctagcggggttgcaccgcgaatatttagggatggtggccaagtatcgtggaactggttttggcctgtttttcacatgtcatgagtatgctctcattgctttcattattgtagttagctatatgggttactagtcgtcttgatccaattatgccgtttgtgtaagttctactttttttaacacagctcccttgtctctagaatcaaatatttacttcaataaatatccgtcgtatatattgttctatctgctaaaactgtcgatgtacttcctccgtcccaaaataagtgcagtcatagttttccgcgcccaactttgaccgttcgtcttatttgaaaattttttgaaaaaatttaaaaacataagtcacaagtaaagtactattcatgttttatcatctcataacaacaaaaatgctgattataaaaaaaatttaaataagacggacgatcaaagttagacgcggaaactcatggctacacttattatgggacggagatagtacaatcgtattgtttttcaagtagtatttctttcaactttttttcattggaaggtctatttataattacgttatattgtacgcggttgtcttttccaattatgataatcatggaagaattgcagagttgcacatgttgttccgttattggtgggtaggaacaattgcttaggaatttctcaaattgcgtgtatgcacttctatttccaaaataaaatttctaaggaaacaatttctcacaacatgttgagtcatcatgatacggagaaaagctcattcgaatccaaatactccatggaatccgaatccaaatgtgatactcgttgtcattgtttctattagcagcactcgtccatgatcgacctttgagaccgcacatcgatccggagctgactagggcaatcatctagtccctgatcactatacactgaatctcgggcctaccttctcctcttcatcatcggtgggagtgccgttgtgtctatcatcgtgctatcttgtccaattcaaccacattttagtgtgtatctctgtaaatagcaacttacacatgtattatgacgtcgcataatcgcattgtcacttttcatatgagaaatgttgctcttgttacacgttatgacattacattgtcacttttcatatgagaaatgttgctcttgtcacacgtgcattataacgttacattgtcgcttacaaatgcatctcctcctccatgtgtggattgggtattttggtctataccaaaatatggtagaaaaaaagattcaaagtatatctgtggcatataaaatgacatgatccatacggttacaaatagataaatagtaataatattttttcgatacaaaaagacatgatcaaacgatgtctggctttggttctagtgattgtgtttttatcagtttcagtgtttcaaccaccatttcctcgatattgcattctaattcagaaactgttgttttcttcttgatgggattactcgttggctgaaatgttggatctttcttgcaagaaagatgtgtgctgccaagaggctgccgattttgcaaagtgtgtcagaaaattttgtctgaatttattgtggtgtttgtttgtagcaacggtaatggtaaaagaaatgtacttgtattttatagtgtaaccggtgtgaattcattcggttcagattcagtagtgttgattggcactgctgcgttcaatttatttatttatttatttatttatttatttattttttggaaaagcgctgctgcgttcaaattcaggctcaggctcgaggaatgtgttcactgtatagaatacaaatggaaaatgctaaaaatggcaaatggttttgtgattcagtagatcaagcaaaactatttatatcggtattacatcacgcacaacattgagagaacttatgaaccactatattgagaaatcttatgaggcattcagaaacacgagcattatattgagaaacttgaattgagaagttttaatagatgatctcatgacttagaattacttcgttcaaatgaaatctcatggatggcttgacaaaaatacctacaaaacttctgctgtcaagtgcaaataaatttggttattagaattacgccactctccgtgcgtaaaactacaaatatactgttaagtgcaaataaatctggttattagaattacgccactctccgtgcgtacaactttgagatacacttaatagtgcaatgacaatgggtgtgtggttttattctgtattcaatctccaacatgttcataatttatttttaaaaaatgtttgaagtgacatctctccctctaaatctacaaaacccagtgttaattaactataaatactttcagttatgacgtccggctgtttagagggacatctctccctccaaatcttgtgttatttagctataataaatactttcagttatggcatctagctgagaccggagcctgcaggtaatactggcatactgctagaactcatgcgttaatccctcaacgtccacaacttccttcgcaacctttggttgcattatacaatgtttggtaatactggcatactgccagaactcatgcttgaatccctcgacgtcaacaacttccttcgcaacctttggttgcattatactccctccgttccataataggtgacgtttttgattttttatttgcaacgtttacccattcgttttatttgaaa

SEQ ID NO: 57791 - DNA, 527 bp, Oryza sativa
cttcccagttcataaacaatatgtgggccattgatttacgcacagtccaattcagtatccagacaagctcagcttgaacttcaattccttatggacaccttagctgatcaccaacttcaacatgagagaccagatgagagggccttcatccttacctccgcaggaaccacaacagccgcggcttataatctgcacacatatcagtatcacggcacactatagaaactggcagtctttatctttctttttttttatcaagggctgcatggcccccatttccattaccagaaatgacaatcagagttcttacaaataaaaggaagaagaggttaaaaaaaaaaagagacagcaagagagagggctaggcatagagggtctgggacagacagagtgaacaggcaattactgaaacagaccacaccctcaaaatctattctatgaaccctgagccagccataacaaaactacccaagttgacagattacatttttgtgcccagattgaaacaaaagcaaccagcgtctggt

SEQ ID NO: 57792 - DNA, 2934 bp, Oryza sativa
tatgtattttcaaaaagagaacgacttttaaacccgactcatatacggatgacgtacctgtcatagttacgaataaggcatacttactatcctatgacatatgaaatatacagatccgacataccttcgtatgtacgatatacttccatatacaccaaggaaaatgacaagagactatgaaaattatcctcatggacaagtgaatagtagagccctaccttgaggattgggtttatattatatcgtgcagggtccgtagtctccgagttctacttggagactaaggtgattcacggtataaaagatacatcccctgagggatccagatcatcgaatcatagcgccaataccaccaccatagcctacaatccggaggacgtgaagcctactcaccgggagatctcgtcgaaatcatctcgacgaggggtctcgccgccaatcttgggattgattgttctctattctaatatgtagttttccatatcaatctcatataaactggactagagctattaccttatgaggggcctgagccagtataatacttgtcttcttgttttcttgatgtcgtatcgtgtaaattctcataccaacttaccacaataccctattcatccggtttatgagatttctcgttgacagtgctaaagtactggcaaaaagatattcaatttttataatagtagagataagttctttctctaattttcgccttttttaaaaaaaaatcgttgtgtacctccttttaggtccttgatattttttttgtacgttgccaatccctttactttaggttaggatcaagaagacattattttaggttaagaatcaagaagacataagcttcgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacacctaacggaggaggaggaggaaggggaggatgaagagcggcagaagcaagatgaggtggtagagctgtacaacctccgccatggctggtgggttagcttggatcaaatcaaagcataaaggaatttgtatctaagcaatggagtttaaatgcttgcattttgcttgctgtttttgctcaataggtggctgattgttgggccttgtttaggggagccgcagatttgatattcttctgcttggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttggtattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaa

SEQ ID NO: 57793 - DNA, 3962 bp, Oryza sativa
attagctgacgaccaaataatgcgaactgcaatatattaaatgcaagtacaaacaagtacatgtgacaatagtttagagatctacatgaccatatcgatcgtaatacgtccatcgattttgaaacctacagtatatatatatctgcaactaacacaaatcgatagatctgatccttaattacccagttaaattaacctgcagttacgtgtgcacgttttaggctgttcccggccaagagtttttatttcatgcatgatgctggtagtgaactgccaaaactgatcgtcaattccgtgcatgattccatcatccatgctagtagtagatgactatgtataaataggcatggattcacacgtacgaatgcggagaaacgcatctatatatccatctctggaatgcttgcttacgtggaaaattaattttaattattaattcccggaactcgatcggccattagatttcgggtgaaacatgaggaacatgatcatcatgcatgcatgtacttatctacagcgtatttatcagagatctgaggtgtgcaccggtgacaaggaatatctctctagtcaagcataaaattaagatggtaagaaaatttcaaaggggagggggccgggtagatcgttgccggtttttcttttccattatgcgcccgcacatgctgctacccgttaattatgatcaatgatttgtgctttgttcatttcccttaatgttactcctatttaatttagttttttgtcggctggcacgtcctatacatacgtctatgatgcatgatataacgaattaaagattggttagttaactagcacggtgatctctacagattgtgccgctagcattgttacaaaattttatcagataatagcatatatactttcacgcttggttctgaaaggaaaattatgattttgaattagggttaaacttgatcaaaagtatatcgtatgatattccaactaattaatataataatttctatgtctagcatagccaatatgataaatcctttagcatctatctatctattatctactaaaagtccattaaactccctagaaacgctcctaagctgtcacgtggcgttcctacaaacgctcctaaatcgccacattattttcagttaaactggtaggcccattattttagaccgttagattggatctattttaaaatccctggttcatcttaatgtccgggtaggcccattatctaatcacagctgcttcttaatgtccgatatatagaagagaaattttcacgagaaaagttaacgtacactataattggatattacccatatgtattgttcacttcaaaaaaccaaacaaacatacgtatctacagctataaagccagaaaaaaaacatactatgctgtatgctaatagaacagcggttttaaagtagaattttctatattataaaataaaatttattactccgcatatatccatgtatatgcacagtttaaacaagattaatataaagtatcaaatcaactgtctttaaatgttcatcttttaaattatttatgaaatatatatatatatatatatatatatatatatatatatatatatatatatatatatatatatatatgtaacttataatctattatattccttcaattaaataaaatattgatcacatataatagttatattgtagtgctaaatacatggtgccgtcatataatacttaatgtcataattatttttaaataatttagccaacatataataattaatgtcataatgccatgataattttttaaataatttcacatgataaaatggatcaacttggtgtcaaatatcgctcgataaatatatcgcagtggagaaataaagcctcggcgactacggtcggctttattacctgttaaagggggcattcatatttgattttaacagtgttatcttattaaccattaggaacaataattatagaatatttattcatagatttagaaacaagggttgacataaacatttatgtttgtagtagatataaatgttttatgtattaataatatattgggcttattttagtggtatagatgcagatccatttatttaaaatgcatcccgctttaaggataataaaaacaagtaagaatgataatagctgagttgacatgtaacgtggacaaaataaaaccctacctatggactaactattagtttctcaagacatatttatgaccattagatccatcgttttcttttaaaaaatagaacccatataccaacctccaccatggccccgtacatgggcgcttactcattcatccaccccactgcccacaccctcaaacacaccatacctctcttttcctcctattctcatgctacattacttagaaatcataatttattattaaaaaaatagagaacagtatcatccaaagcatatagtgaatttttgatcgacttatttttgttatattatttataactaaagttaaagacacatattcacaatattcaaacttttgaaataaatatgtttgattttggtttatattcttacacttttgcgtacattcaaacaattataaaaaaattatgaaaaacatttaaatgttcatattttaaattatttatgaaatatatatctaacttataatctattgtattcctttatttaaataaaatattaatcacatataaaagttatattgtagtgctaaatacatggtgccgacatatgacacttaatgccatcatataataattgatgacatgaaatttttttaaataatttcacatgataaaaaggatcaacttggtgtcaaatatcgcttgacaaatatattacactaattcaaatctagatgcagggagaatcatatgatcatcggttttacttaaattatttaggaaaaagcaggaaaataaagtctccaattcctcaccgtccccataacatgcacacaacaccaaacgcccccttcccctttagcttaggctcttcgcactccactcctccctattcctactttttagctatcaaatttaaagacaaactatgaataatattgaaaaacccatattttaagctatacatctaatttctaatctaattgtttctctattaaataattaaacaacaattcatgatccattatgcattttgaacataaaataagagttgtataaagtaaattagaaaaatagaaaaattccaatagggattgaattaaattaattgggcagaatataataaatttgtaaaaaatagttattacttttcacaaattggaacaaccattatatgttccatcgccataaccatgtttaagtacttagatgttaatgaccatccatctatcttatatcatgtcattatgagtttttcaacgaattattacatatataaaacatatagttggttaaaaagttatctatatgctactattaactttaagtttaggactcatgttgactaggtatgtttttagaaaaaacactaaagatcacatatattatagggaagcgtgctgtacaatatgtatatctcctatgtatttattgatgctttttttctagaaaatgaagaattactgataattgcagcttatagtagtgaattaaatattatatagtttaaaccttacagatatcttgtaaaaaaatatctgagcaatgtagatgaagaaaatttataagaaattgtactttttcaagagtggtgtgtcacccggtcgatattacaccttacaaaagcgtatcttatatgcccgcgcgaatgcgcgggctacctttctagttatattaataatgaaagagatgaaacatataaagacgttatagtatatttgtttctcttctttcctccatctttatcttttacattttctcgctatctctagtgacatttttctaccctactattaagcatttgagaaaaatgattgttggtcggaatatctctactattataaaaat

SEQ ID NO: 57794 - DNA, 20006 bp, Oryza sativa
  unsure (1)..(20006): unsure at all n locations
attcctgcagcccaataataattctaaaaaattttgaataagacgaatgatcaaatattgacaaacataaactcgttttatttgaaaaattagtgcaaatataaaaaaaaataagtcatatgtaaagtaattttgataataaagcaaatgacaaacaaaataaataataattccaaaaaaaattgaataagacgaatgattaaacattgacaaacaaaaactcattttatttgaaaaattagtgtaaatataaaaaaagataagtcatatgtaaagtacttttgataataaagcaaatgacaaacaaaataaataataattccaaaaaaatttgaataagacgaatgatcaaacattgacaaacaaaaacttaaaaaactcaaaaaagcaagtaatataggacggaggtagtacaatgttttagggttttccgtgtagacatctgtggacaagtgccgacagccatgaaaacgccaggccacatatggaagaagtgaattttattttgttatcactccatacagtggaaagtatattgacatttcagctcatttaatccacgagtcttgccatccctctcctgtggcttatgcataactatttttatttcgattcgtcatagccggtgaaaggtacacagatcactcagcagcttttcctttcctgcgattgctaccacctgcagaggctccggtgcctcccatctccacaaggtagtagatcattgagtcgacgtcctcgccaaatatgctataggcttccatgacctggatgtagttgaagcccattgccaggaggagctgcatgctgcgggttagcacggtgtccgggagaacgaagcactcctcgccaactctatcggcagtcccagctgaccgagaagacccactaactgcagaataggaaatcatgatggtttcagcaaacctatcaaagtttctgtatgtggtctaccaggtagtccaatgccaagaatggtgggcttactcgcagcagaagaagatggctctgcccctgatgttgatgactctctgaagttaagttgttgttgctgctgctttagatactctgctcgtgaggcctccatcaccatccgctctatttccttctctgtcaactccaaatcagagtatagtcgtccttcagccagaagtgcctgatgttgccggcaagaaaagaattaagtatatttcggtttatactctaacaattcaaggtaaacctgattaatttgtgcagatgttgagatggcaagtaccccttgaaaacaattaccagtacttacattctcaatctgctgatcttgctgtgcttttattgcaaccttcacctgatccctgtcaacgttatttgtctgtacagaaaggaaatgaagttcatttattaacaaagaataccagttggcaaacactcaactgtagaataggctataagggcaatgataaccatggaccaagacatacccctctaagggaactaaatcccaggcctgcccctactgtcagcccacgaggatcaaccaccgaattgtaatgattaccatgatggtaacttagcctaattggagggacatctgtattgtagcttccttgaaaaatgttaatgggctctgcagtaagagcaaacaatatgagactatgaaagagtttatgcaactacagagaagggttaaaatcctatagcaacatatgtgttacagttacctgtactataggaatatatgtgaatcggacgattgtacatctcagcaaatgcctggatctccatattgttcccatataccttgagaatcaagcatgtcaacataaattatttgcagtggaagaaggtaaggttctaaatttttccttgtcctaagtcctaattttattttgaagttgaaaaacaagcgctcagtatctacatgatagcattatttttaataaaaaaaagaaattctgaaagtcagggaaaatgcacagctgttgtgtggaagcataaatggttaaaaaaattaaatgcagacgttcattaagatctgcaaaacaagattcaaacagctgaaaaacatgctttccaggggcgcacatgctctatagtagattaaaataaaagacaagtcagctgactgaaaaacattagtttcataacattttcaaaaaaaaaatacgaggatgttcacaagcacagcacaacggttcgaagacactcagtgtaaggaaaagcagcaagcagttggaatatatcctaaacagccaggatctattgaatagcataccttatctcttctttttctcctacaatatgatgtaaaaccttccgtcatgaactgcgagaaatgatcacgttccctttcctggaagaattgataacaataatgagcatatcagccacttggtcaaaggggaagtcactgttacctcatagtctaaaatagatcaggtattcaggtttcaggaaactggggattacttcgggctttcgaggcaatatattccagaatacagaatgcccctttcaggaacagtgatttattgtggatgagatgtgtatacaatcaaaatcacatcagaaatttgaattatactccttgttctatgcacatggtgctaatgtgtcaagtaactcagacgacagggagtaattacgatttcaatgcatgcctaataccatgctgcaaactcaaattggtatgttcttccaaatgctttcaacttcttaaagaaaactcccaaatgcgtgaaatatacagaaaaagacactagaaaagcaatgtcctggtgattgcatagtagacaggagatgcattaaaaaaaatacagaaaccaaaacagaacactaggaaagaaaaaggtcctgctggcataaagacaggagcatccctcaaaacttctctctttttttccatgtgaaactgtgaaagtagatgactgggcaaaagacggtgaagaaaatcatgctgcaaacaaatagatccttgccaagaagtttatcagttcaacgataaacgatacagttgagtctggacttgaacttgaatcaaatgcttcattaacaatgaactaggcatggcttcacatttgttgcacacgatataattgtttaatatgtcatttcacaaaatatgtaagtcaaaaggtagaacagacagcacttttcccttggtaagttcattattaaattttaattcctgtataactagctgagtgctacctctaaggaaacagaacagcagaaaccaatatctaccctgaccagcaaaggagaagcaagttgcaactatgtttcaaccctaactaacagtagacgaaactgcaggctgtctcaaactagtaatgttccaccatctacccatattgcttccccaaacttatccaagatcttacagagccaataacttagtataaaatagtgagataaattatgcgacagggtagagaatgagaaatattaaccaaatattaatgttggcttatgaattgaacctagggacggaatacatataatatacggtgttactactcagatgcaacgacacaacataccatataatcaacacgcatctgcctagccctgccaatagtgaacaaataaggggcaaggttgaatgcaacagattaacatgttagaacactgcctccaagcttgtgaatctagtttatggattaatggcaaaggatatagatgtaacaataaacataccatgtaatcaacacacatctgcctagccatgtcataagcttctggatcaccataaacttgatctgcaactgctctaaacagacaattcccatcttcagccatcttattgatttcaaatcctctcactcgtcttaggtcatgttcaaacatgcgctccctttcctgaggaaatataaactacattagttgttgtcaaaaacaaaaaggtgcctgtttgcgaatgtgacaaacctaccattaacgataaaaggaataatgttattgtatcatgcaactacaaaggatccaaacttccaaaggatctatgacattatctccacatcctagacatcatcttcatgccatgcaatcattgacaaatggcaaagctgatataggaaatacgatattaaagttttcatataaaatagaagcagacaagagatcataccgaatcataataattagaggcgtaacaggggccctgctcatctgcactattatacccttcactatcagcaagtgatctaggtgaagaaggtcgggaacccgaagcagatgaccgaactgccactggtggccaagcaactggccttcttgaagatccaatccgtgcattgtttgagcttccagaccccattctccttaacccattattaccagacgatggtttcggtggtggggctggtggagctggtggaggtggtgggtgtgatgctgcaccagcaatctgtgatggaccaatacctgactgcactagattttcctgctcaaactgatcagaaaactggaggcctgttaattcctccaccaagaaagcaggatcgatcacactggagtcgtctttgggaggtttctccataacagccctctcctctgcagagcttgaactctctgatgtgggatcatctagccccaatggcttattactattactgctgttatcagcatcctccactagatggtcagttatattgtctgaagccgtgagctccgatggatgctgatgaggctgcggcggcagctcctcctcccgggcaaccgctgatgtcgcctgcagttgctgctgctgctgcagtgtctgtgaccccgagcggctggagctggacgaggagccggcagccccgcgctgcacgaagatcctcgtcatctcccactctcctcagagaaggctccacgtctacgcaccagcaaccctcctcgaatcagagggccacgagcgcgcccttatcgcgcgtgcggaccttgggggcggtgaatctggcgcctcctccgccgccgctgccaagggagctgctcctctcgtcgtcgccggcagccaatctgagcattccactgccaattctcatcagaaccagggcgacaccagtccctcctcgcactcggatcacaaaaccctagctccccgcgagatcgagacgcgcaggctagtccccttcggagagggcggcgagccacccttcccaaaaccctaaatcgcccgccaacccgatcgattcagcagaaaacaacaccgatttctctcccaggctctctctctctcgagggggtcgagcggattacctcgtcttgggggaatcgactggtaggcgcccttcgattcagcgagcgatgggggggcgcacgggttcggggccgacgcggcgatggggagattggagctagggtttatgtccaaatcgaaatcaacaaaaaattttggcttcgccgcgtgaattttttttctctcgctgttgttttggggattctgcttcgggtggatggagagagagagagaaagcagctgtatggtgaggtgaggtatcggaagaggacgaagacgatggagatggaagaaggggcgaagagaggttgggtgtgcaaaactttttatacgtggagggggagcgctaccaggcgatgacaagtggggcccacatggcagcgtccgttgggatggacggtacgtcgcgatgctgttggttttgcgtcgatggaaatccagtggcccgcgtttgtggcatttgcacgggatggttcgtcagctattgtctcgcagtttcatggcagtgattaattccagagaataatcggcgaagcttctttaatatttcttataaacacgaaacaaatgcagacgttcataatatgcgtacactcatagttataaaaacacaaacacatcttacccctatagaaacctctagaatattagactatcatatcttgattaattggcatgtgggataattgatttttttttgcaccggtcagaccggggggaccagggcatgtataccagtcagataggagtgatgatgaataatgttatcaagtgatgaacatggacatgtctgatggttgcggttagaccggctagggtaggccgatcagaccggagtatggcgagcggttgtaggataaggaggctgactagaggggggtgaataggcggtttttcaaacttttggctaaaaccgagtttcgtatgtggaagcgtaaatcaaaatggttttgcacaattcaaaacctaaatcaactagtctcaagtaaatgcacaaagaaactagcctatgttgaggtttgcaagcttagggtgataatagcacaaataaactctagtatgtaaacttgctcaaagtaaatttgcacaaaataaaggagacaagagacaaggaattttcaccgaggttcggaaacttgccggtttcctaatccccgttgaggcgagcccaactccaccgctcaaccacgaagccatcgcacgcccccttcgtcaaagggggcaaggcgggagccggcccacggagaggactaccaaagcctcgatcactagggtagttcttccttcactccgaaggtggtgaactccaaaccactcacaactggcgccaggcctcctccacaatctcctcggagaggtcaccgggcaacacctccacaagccgtctaggaggcggcaacctccaagagtaacaagtctaggatgcttgccgcggatgatcaagtaccacactagctataacaatgaaacaatgcacttggattggcttaactcactctctaacacctcactagataaactaagtgcccaagggtgtgagagctcttgcaagggttcaagataatgtaatggagtgccaaaacctcgcccttgctgctggggagtgggtatatatacccccaaccaccaaaactagccgttggaaccgaaatccccaactctgtgctccgccgatcagaccgctgttgtgaggccggtcagaccggactactttgtaacggctagaaaactagccgttacagggcaatcattgagcccactcaacttggtcggtctgaccgcagtgtagaggccggtcagaccgtccacggctcggtcagaccgtcatcggctcggactgaccggttgcggctctggtggctctgtatcgccaccataaaccagaccagtgcaacagaccattgaagccggtcagaccggccttatcacgccggtcagaccggctaacaggcctggtcaaaccgtcctaaggcccacggtcagaccgcaggtcacttttcagcacaaccaaccgttagtaaaacggcgatatttcttgacacgggtctcggaatttggcgttcttggactctatggaaagcttattcaaagggctatccaacccatgaacaatccatccaagaaacacaacttttctcagggaaaaagggctcacactccaaaggatactccaccggacataaccacatgaggctacccaaacctataggatttgcccacatctctctttgtttaggacttgagaatactcaccacacttggctagacaagcccaccaaatgcacctacatgcatatgaactaatatggcgcaagatcatccacattctcgcttcatagacccctcttgatagtacggcgtctatctagcaaatccggtctacaccaaacaccaagaccgggaaaagactaagaaaacattcttagctccattatacctttgccttgcgccatccaacttggggttaatgcttgagccaagatcaacacttgtgaccatccagttgaaccatatttatgccgaggtctttaccatcctttgtcaagactttattctcatcacaagtttgacttcattcttgccaacatgacgatgtccttggcttggtgaccattaacccatggtgtcattcattagcctcattgtagtgggacctattccttttcacatctcaaaggagaacattagtctcaacaaatcggttgtcatccttcacttgatgaccaaccggttgcatatgaaagatatagatatgttcgttgagttttcattaacatcacaagtgtcatatactcgtatgcaagctcaagtgcaaagatccgatataaataataggtgaacaacatggatctagaacatgcacaataaatgtataggatttgctccccctaaatatatgcatacaaataaatacaagagatgcaagtgtatgcataattagagaatgaccaattggggtttatcctatacacataaagagaaggcatatgtagtaataatgtagaccaacataaaacatataccttcatgatctccatgttctcaatgtaaatgagactaaataagataagactcaagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaatgacctagtagacaacttatgcaaaagagaggttaatcccataaacatcggtttatcatctatcaccaacgtaacaattatacgaattgtttaatccaagatcattcaatcttttctctctttggtgatggataataacccgatataaacaaatagagagatgagatgaaagatgttttcaaatcaagatagaaatcttataataaacaaaatatagaataagctccccctcaagtgtacatacatatggatataaaggaacacatacgcacataatcaatcaggatcaatgagagagctcacactatattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacagcggtcagaccggccagtctgcggtggcgcggtctgaccggccgacgttttgtcggtttcagtttcgggttatttatttgggtatttgtggataattattgtttatgaattctagatggatattatgtgtgtgctaccatgagtcaagttggtgagaacttgtgatcgaatatggtttcttagttgatgcatgtgtaggtgaatcttgatgcctcgggagggtagtgtcgatgatggatccaaagtcaactcaggagaagatgacgtcaggaagatcaggatatcatgcgggatgcttagactaaagatcaatgcacgtggttggtgaagattttatatggtatatgatagagatattgtgtgcgtaatggatgcagggtcgaaattggagggagtctatatttggtacagttggagtttgtaaggttcgtttttttgtatgggaaggttttctaggggattaggacttcttgtacaacgttgattcgtggttttaggttgcttacctcggatataaatagagagggtaggtgtagccttccgatatcgattttgagagagttgagtttagagaaaagttagggtttcgagtttagtcgagattttcgtaagaagtgttgttattgttgtactttgtaaacacagagaagtaataaagcttcaatctacattgagagatcttcgatttatgtttggtcgggttcgacagtccaaccgacgagtcatcggcggatagactgatggcatcagcgcggtcagaatggcaaatacgcgacggtcagaccggcggcggcgacaggctacagcggcgcatagggcggtcagaccgaagcgactacacctgccatactggaggtcatcgagcggtcagaccagcgcatctactccgatcagacagatcaccatcaaatttgagcataacttttaattccactaaaagttcacccttttaattggcttagttcttgttgttcgatcctacgctgataaacaagagaaatagatcaatatattgagtgaaaacaaataaaatagtttattggaacaaataaaattaaagaggataaaggatcaaaatacctcttattaatagcacattagtattggtggattggtaggtaaggggcattaaagaaataaaaattttcgatttgttaaccaagggtggataagaagataaaaattaatttatttagagtaaattacactttggactaccttttctaaccaatgtttcagtttggactagggataagatgatattttcactttaggctagataagtttgcaaaaggtttcaccttcaacccccttcttacctctccaaactccaggctctagctcgctctcttgtcgaccttatgtgactgtgagcatggacatgttgaggtcaagcttgaactttccgaagggcggtatcaatacggcaacccgaaagctcgttatcaaagtggtctcttccgctgtcagatcaaaacgggtagggatcggcccagcctagaacaactcgcttctcataaaaacgaatccctttgtgcctggaagaatgttgaagtctagagagcggaagatatttaagtaaggatgttatgccaggtagcattcggtacaagagtgagacggaggtagctcgagcctagcggattctccccgttacctggacctgcctcccccgcggtcaaaactctcctctccagcccctctggctgggccagaagcctcgtctcctttaactgaggactgactgcgcggagacgattgagcgtgggtccctaacgattttattttaggagtgaagccttggcaagccccaacgcttgaactttaagcaattcagcaagccccaatgcccgtggagatcatcaaccttgagcttggccgtggcccctgtacagtcgtcgtgatgatggtcaagctcaccaagctagagcttgggacaaaacgggacgaatcaaagctctcgaatggcagataaaggatgaaaacaatgagcagcgctcaagggccacgggccacggcagcgaagcagctcctggcccccatgttggaactgctcgaggactgtggcagccagtggcactccattgccatagcagcgagagttgcacgatgatggttgcgcaggagctgctcgaggatagtggctgcattccaaggcaacggtaggcggcacttcagaaggctatgcttgagtttggctagttcatcaacttgagaagaaagaggagagaagatagaaaagaagatccaaattgaaataatttgcaaagttatctagtccaatgtgaaaatgatgtcttgtccctagcccaaattgcatctttggtaaaaagaggtggcccaaagtacagtttactcatttatttaagaacaaagtttaaatttcaaaaattaatttattttaggagggatgggagtacccgcgttggcttcacaaatagccataccccgacgattctgggcatgtcgctttgcttcgtccgcagcgggggcagaacggtcacttccgcctggacaccctttcccaagggaatctgcacacgattgcacgaggcccctgcagccggtctgcgcatggaatgaccacccaacacaaaagtcgtccgattgcacgttctctcgctcttgtcctgttgcacaactgttgagatttttcacagtttcactttcacaggtcacaccgtcacagctactgtaactgcttacgcatcgctcggaccagcagcacaaaaaagttaaaacaatggagcgagcgagagaggtgatttcaaaatggggtaccgtccaggagggaagtaaaagctttttgataaagcaagaattcacatatgctgcaacctaacgtggcgtccacagtgtgcagtgctacaaaattgagcgaatatgcatgtctccgtaggctttatggaagaaaaaagaccaatagcagtgccagttggtgataacacagtcacagcccacaatgtctgatgtcagacgactccgtccaatgatctccgctttgcaaaaatgcaaatttcaactcgctgttttcaacacaacaacaagggtgtgctcggcaccctttttcccaactcatctctctcgtttttcatgcacacgctttttaaactattaaacggtgtatttttttaaaaaaaattctatatacaagttgcttaaaaatcatattaatccattttttaaaaaaataataaatatttaattaatcgtgtgctaatgaactgctctgtttttcgtgttactgttccggatttggaacaagcatatgcgaacacaccctaagtgcaccaatgagcttgtcaagactaaaacaacctgttccagtaaaaaaaacagactaaaacacctgttgattttctttttgaaagggtaaaacctcttcctgcagtctgtggctgctcaaaaattcctgtggtacgacacaaaaaggttgtatttcatagatataatgcaaataagcggtgacgtactgacgtcctaccacgaaaacaatatgcaactggacaaaactgtatggtcttgggcaaaactgtaccgaaatggcattcttcttcctctacgttggttgccattaccccactgtccatccacgctctgcaagcacttcacgaacccgtgccgccacatcaatggcatcgttcaggggagggtagctccagttgtctgacatctatggagaaaaaagaagggtgataattcgtccctaagataattatatcttcatattgagtattttcaaaactttcatcacggtgaaacagatggataattatcttaattacattgaatgacctcctttggtcattccggcgaaaaaagaaacagatggataacagaaacgattgcatcagaaaagactcaacatcgcctactcgggaaaatgaagcacgtgtgggagggggcaattgaaataaccaggactgtataaaacctcaattgatccactatacgtgaatatttagcgaacttacatcttctagtccagtgaaagggcggacagcacctctttcatgcagcctgttgtgaaaatccgagaatttccacctgcagtgctcagttccaacaacataaacaggtttcctgtaaatagaaatgttaggaaggtcggttatacaaataaaaaaaatagtgaaaagatacagatgaataatataagctcacccagtgctacatgcctcacttagcatactaattgagtctgctgttatgacaaaagcatcagcccatgcaagatgcccaaggtgtgggttgggtcctgcatcaagaaaactggctgagaaaactttcgtagagcacataaagatgagtacatcagacatgtctcattttaggcttttgacaactaccttcaccattccaaatataaaccttagggtgtgtactgaactctttcaatataagatcagacacctgccaacaaatgatttagaaatttaagtactggcacctactaagaaaaaatggacaattcaaggtcctaccttatgtggtgttcttctggaaaatgaaaccctgacacttccacaggtcttcagaacattgtgtagtgagcttatcaacttcttggcaaggcctacatcgtaattacagtttcctggccattgaaaatatcacatgtgttaaatctatataaccatgaaagcagaaaaggctcagcatatgagttcaaagttcaaaaaaagtctcaaaaaactaaaatatgtgaaggaataacctttttttctgaacatcaagttgaaaattctgaacaagacaaaaaaaacttgaataaacaaaaaagcatatgaaatgcaagggtttgcatggatgagaacacagaaggtgtgagactgatttctttcttctgctcccaagcattcaatcaatatatgcaagctaaaatgtatataacagcaatatctcatgctacgtcaaaattttgaaagagggattagaagaaaggtttgtgagaaaactgcagcttctccattttagtttggaagctttagctccataacacaaactaaaagaaaataaacattttttagcttgacatgttcatgtaaatgtttgtatttgacaccttttgcattagcaatgctacaagtcaatagagaaagagatatcaaaattccttgttacaactaacagacacaagcagatccatttgacgctgccattgttctcatgtccaatgaacagtaagaactaacttatgtaaaattgcatatatcaggaagctcatatcacataggtaggctgcaggcaagcagacaggaagggagggagagaggatggatttacttgttggtcctccaatgttcactacaaccaatggctttggtgagttagcaagttcatcatgccaatcagaagcagcagtgcgtaatgcagcagaatctgcttggtgaagtgcgccaacagtaaggacctggctttccaattttcagggttcagaattgagacagttgctacgctatgaacacatacaagagattgttgcttgcagaaaagaaaacacatatcacatttggcccaggtggttctcgtgcagtaatccatctccagagaaggtgagggaattcccgttgtcctcttgtagtcaaagcatagtaatcatgacgaggagttaccaccaaatcaaacctatcaaggcgatacctgggatgttgtatctgaaatgcaacaaatacgatgtaaagctaatatccacatgacaaagtggataatgattcataacccaagttgaataacaagtaaccaaacaagtaagtgatgcattccttacagaattctacctgtatgacaaagacattatctggagccaaacaccttattgaacttgcatatgatatggtatctcgtccacaagcgacaactagtgccaggccttctctgaagaaacacaaaatttgaggaagcagtgcagggtaaatagtatgtcaagaaatttcgataacttagaaatcatagacaatgtttaggctgctctacaattgcatagcaatattcattggatagaagtccagagctatgttctaagaagatgcctatttcacatccaagaaaaacacttatttcccatgttcttactagaattatgtcatcaacattcaaggataccacatctacaatccatggtaatgatatcaacagaacatattcttaaaatctttcaggggcaacatgtgctcagaatgaaaatgttcagttctgttttattccagagctgccaagctaccaagcatataacagggattatggcgactaaactatgggcaagctatataaaagagatcatcatcacagaagttgtggaatggacttcaagcttaatatgaaatagtgcacaaacagcacagcaccaatataagcgatgggatcttacttctcaaaggtatcattgaccatggtaactatccttttggtatctgcttctaggacagaagataatccaagggactggccattacagacagtatattgagccatttttgccccttgaaatagtgttgcaaatttgttactagaaaacatctgtctgagtacttggtccactaacttatgcaaggagatcgggaggaagtgcagccacttgttgattcctcctgttggccttatagcacgctgcaagaccagaaacaagttcacaaagtaaagctaaggttccgtaagaactaaaaaactgccttacgaacagaggttagcggcatagttatctgaatttataaataaataatgtctaccctccatttgaacaggttatgaataaaaggatttatatggtttctaccacaacaatgtactacttgctagttgctgcaacctccacaaatgcagtgaatgcaaataacaaattacaggacaacaattaattggtagtctggtactgcatctagcaatcataaaagttgataagccatttcagagtaaacttgagattggagtttaaattgcacacgcccctcatctgcagcacatggcaaagcaaaaccactttagcatattgaattattgaagcaattcataaagataacaccaatacataccgaataggcgaatacatgccaacagaaattataggattgatttcccattctctgccactatcaaatgcagagttgtagacttgacccatggtaattaggcacagatcatggtaagtggtactaacaattaacaaacagccccaaatcctagaggcacatctcttactttacttactgggtaaaaagcaaatccaatgttgcatcagaaatataaaggacaatcactagttaatcattaagtcctacgcaaactgccacctgacatcagtaacacaggatccactaatgcagttgcggactaaacacaaacaatcaaattcgcagctccagtgaccaacgattttatgaccctgtcaccaaaagttggcgggaaaaatgatcaggggaggcagggtttacgtaaagcgtgaggcggtcggctaggccgagggcacggagaaggccgaggcactggttctcggcgcccgcgcagccgttcccgatgacgacggcgcgccgcacggagccgcgggcccctgtgccgcccgcgaagatntcnggngcgncngccggnccgcccccgcccccgcccagcggctccatcggccgcgtcgcccaaaatgggaggaggtggaggagaggaggcagctatggcgccgcgcttgcttgggttttgggaactctgcaggcgggaggcggacggatcagcgaggaggagcggggcgcgcagccatgtgaatcggcgcgagccagtcttgcgaaacaagtttgcttttgcattactttttttttctctctctctttttcccacctcctcgatcttctcactccactcgacgactctcgagcgttgcccggcgggagggcggagcggaggagacggggagtcgggggagcggaggcggccgccgccgccgtggggagtgaggtgggctcggtggtgggccgatcttgtgttagatttcctaaccaggccggcccattatgaggtgcaaagccactgatttgagccttggattcagttagctctgaatcgagagcttttggtgatgttaatttcacgcttcaattgcgcttgtggctaaatgagatgtgatcaaatgtcgaccgatgtttagacttgaagcactaggaaaatgattagttgaagaggagaggtcgatgcatcgccttctgacgtgactagcaggagccgagatggaaatcgagtcacatcgataggtagccatgcatctggcagttcttcagtactagtaggcattagctctgggcaaggttgcattatttatcctagaaagcagcttagcaacaaagaggtgtaatatgaaactatgaactgccattgcttcaggtagatatcgatagaattcttgtggtgagcggcgaaagaaaatgtgtgatgcagtgcagttagttctcattgaatggagcaaccagacagtaaattcatgcccagcagcagcccggcacagccccacagacagaatggcacgcagcaaggcgttgcaaattcaattggttcaattgggttttatccatttgatccttgaattggcacgctgaatagagtccagctattgactaaagcaccgcacccacaaatcagcaattgacaaggggaaaagaagggcgcaaaggaataaagcaaaatctagccagaaaagagcaacagaaccaactttccccaacggaggagcactgaaagtggatgaagtgattcacagtcgaaacctaaccaaattgcctgaaaactatatctgataaagacataaagcatcaggcctagcacccatatcctttcttttgctttactgttgaacgtcaacaagcaaaaacaaggattgctcaacagaattcatgactgtcgggtacaagataatcactgcacaacatattatttcagtataacgatcagtcagattcacatttgctcaaatatcattgtctgtcaataaactattatggattttgcaaaacaatagaaaatctgagatgcaatgcatgtactccatgatccgaggaacagaaaatctgaaattcaatgtactccatgtagtccatggtcggagggacttcgtagtagcttcattctactgtagcattatcaacagcagccataggccttaatctgccactaaaagagactagagtagaggacactaaaaacgctaaggtaagtaggactataactaatacacattaggcgttgaagaagacacaaggaaaacaacattaaatgatccaatcgagttgttagtatttatcccttttgttcaataagacaaagtggttgccatcatagcaccaaaattactaaaaactaaatataactaccactaccagtcaatgcttcattaaagaaatctaccagtcatggtgaacacccaaattctagtatgcctaccgaggatgttacaacattcaagcatagaggagtactaagataagttcagaaaacagattcaagcaccaacaaacaacagaaattcttacatggaacaacagaaacaataatgctttggaatgaaggatgaagttgaatggccggatgaacatgctgcactgctattcagatggcatcatcgaaagccacatataattatattggacatatgaatcgtattggtggggtatcatacattgaccaagagaaatatgcaactatccaggaaacagtggtaaaaaataatgaatgagtgaatcatgcatatcataatgcacatcagacgcaagccaaaaataaaatacacttgtgcatcagaaattgtataattgggatatgaagtcatgaagacatcaataaaaaagaacaaaattttctaagagataacaaccataggtctcagacaattatcaagatagatacacctaacaggttaacaaccttaaacaaaattgctcctcctgaattacagagagctcccaaacgcaggacaccagttctcattactgttgaaactcacagtaatatcacactcacatacacacgcacgcacacacctccaagggcaccaaaattgcaagcagttgcattaaaaaaaaaccaactcaatttgttgccttaccatctggttttacttctcgatctacaccaataacccactagaattataccctaaaatgtaaccgatctacgacactgagcatgcggacctgaacaaaaagccagagccacatcacctttgcggaattcagtcgaggaaaccggtttgccggagcacggcgtcgcgcacccgccgcaggtcacggcctttgagcgtgcgaccggcgccctcgagcatggagaacggggcggccgggccggccccgccggcggacgcgcgcgcgaccatctcgtgcgggggcagcatggcggcgtcgccgttccggaggaagtcgtcgtcgtcgagctcgtcccacttgaacatctcctgcctccggggcgggcggacgggcaccttcaccggagccgactggtggtacggcgccgctggcccggcgctcttcggcctcggggtcatcgggatggcccgggcggcagaggtcggggactgggttggcgacaacgagccgccgccgccggacgccgaggcggcggcggccgcgatggtcgccttgcgacggagcagcgtccccgcggaagccgcggcggcagcggccgcgccccctcctcccccaccgccacggcggagcaggagcctcttgtccccctcgtgcaacgcggcgaggagcccgacctgcccctgcggcacccggctcgggctcccgggcccctcccccggccgcgcgctcgagggcggcgcggcgggggaggacgagaacaggaagtcgtcctcatggagctcatcccctgccacgaacgacggctccgtcggggacgacgacggcgacgcgaacatcccgatgaaccgctcgctcgccggcgaccgtcgcggcctgtactcgtccatggtcagtcacaacggcggcgcatgcagccaggggccaggcgtagcctctcctccctcgtccgcgcagcaggagcgcgcgacgtggtgtgggggggaaggaggcgagatgaaagagaaggaggggc

SEQ ID NO: 57795 - DNA, 1067 bp, Oryza sativa
atcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaactgaagttgctgtaaagttttcgtacgaaacacaccgtttaccagtaatatagacaaaataatgtagatgaacttgcataataattcaaatatccagtaattaaacatccagtgatcgcatagtgctaaactgaagttactatcctgaaaaaacacaaactatatactttatactagatacatatgagcagaataaatagcaccccaagtatttttctttgcacaaacatgatattataaatgaatattaaaaagcttagaccaggtggacgtgcagtatccagccggctatacagtaccaaagaacaacactgaacgg

SEQ ID NO: 57796 - DNA, 1980 bp, Oryza sativa
ctccttgcggggtggccgggcccacgaaaccaccgtgatcgcagatacctcgcaccgcacgcggactaaccccctggtcgaatctccactctcggggagggatctccactccccactgtctgagggaccgccccctcgacaacaataactgaaggatacttcgtacttggttttattattgagggaggaaaaatcggagcgtgccaatccatagttaagggaggtagtatatatataggcattttccttaggaatatgtgaattgacaatgtgcctatttttttttaagaaatcgtgcgttctacttatcgtagagagtcaaaatacatattgcacgagtgatatatttgtagcttcagagctacgacaaggctattgagaacagcatgatttgcggatggtcccgtcaaagaagtctaaattacatctagatccaacaaataagaaaataaggactccgaaagaaaataaaaaagcaatccagtccttgagctcgctgcttcttcttcttccagagttccagtgtgttcaactcgatgcatatggcaatggatacagtagcgaggctagctacaggagaagatgacaagccacaaacccgataggggcctcccaaagttggatgttaaagcaagcaaggcaagaaaaagaaaactcagctaaaccttagaacttaacttcgttgctgcagacaaaggccctattcatttctccaacaaatgttagataaatttttcgatactcgtggcatactttttaaacggctaaacggtgtgtttcgtgggaaaactttatatatgaaacttgttctaaaatatcagattaatctatttttcaagttgtaataattaaaacttaattaatcacacgttattatcgtctcgttttgtatgaatcacttaatatttatctttatcttcatcttaagagatacaaacaccaccaaagaaacactagaggaatagcaggaacctcatcgaagaaagtttgattggccagtgcaacctcttcgaatcctactttcgcagcagatatgttgcttgcccttcaacaattgtaggtgtgagagcttaaccctacaaccgttggccagacaacgaagctagtgcaaacaccagctatttcgtcgatgagccatggttgccacgatgaggaagacagacacccgcatcttcaaactatgcaagagggagagggaaggaacaacaacaacaacaacggaacgagccgaactatgagataaacccaactgctcaccggccagactccccccaccccggccaccaacctgatagccaacggccaccagagacgtagatggaggggaaagggagtctcatgggaggaaaagctggtcgcgtttgggatcgcctctcaatctctcatgttagaataggtgtcgaatatactagtcctatatatgatcatagttggacttggagttgtaataggtggtaggggtggagataaagttggactctgtaacccggcaactctcttaaatagagagggggcaccacaatatagcgtagatacgcagggagatgatggcagcgtagccatggacttatagcggctaggagctatgttggttgaggagaagcgtccataatcagagccccggagatgtagccttcggctgaatttcgttaacaaatatagcatatctcgtatgatcaatgattgaatcgatcgagaaggttagtcgtcgttacgctatatcgactaacttttataacatctcatagccttaggatggatcgagagaggagcttagtttgtttttcttgtgtgacatatggtgacataggctgttacttcacagttatttttgttgggtgggaacgtggggtggggttcatggagtggttgaacattagcaaacatcttctgaaaacgttcgagatcgaacatgtgattaaaaaaggtgattccggtcatactcaaatgccggccgccagttctaaagtaatgtcgtcg

SEQ ID NO: 57797 - DNA, 2423 bp, Oryza sativa
cctgccaaacgacacaaatgtattatgggtctgtctagtttttcaagcatatgaaaatgggactatctattgagctttcgacagaattgtagtttagaatcttgtaaaattttcaaccaatgcatatagcccgttttaaatgaaataactaatagacaaacatgtcaaaaactgtaaatctagaggaaaaaattgttataaaatcaactttggtgcactgtaactgagtgtatgaaactataagttgaacatacaagaacatgaatcttgatgcaagatcatatggatgaaaaaagtgaaatataggagccttatcgcaagtaaaattacaaaaccgtatgaaaacaccataaatttatggttacatttttagacaactaggattgcgtcgaaattcatatgtaaacagtagagatatcatttccactccccaagcccctctccaccctgacccctacccaaaacctccaaactctaaccttcctaccgccacatagttgccgaagaagagctcgccatctagtcaccaccgcatgaaagtagttgtcatcggtgagtcaccccctcctatttctcccaaatccaaagctaggttaaaggtaactaaaattcaaagcaattttagtgacctaaacaagttaagaatttgcacgtttgttattagaaagatgggtactccctccgtttaatatagtaaattattttagctttatcttaagttaaacttatctaacgtttaccgggtttatggaaaatatacccaacacctataacaatatatatcattaacaaaatatctttgatgggtaatttaataataaaattattctgatcttgtagatgttggtgcatgctgtcataaactcgatcggtcaatgtttaacaaaattgacttagaaaaaatgatttcttttctaaaaataattaagaacacggccctctcctattcaaaccagatgtacacagccatttggacaaaaacaaaactaaggccctgtttagttcgtgaaaagaaaatttttgggtgtcacatcgcatggtttaccggatgtcggaagacattttcggacacgaatgaaaaaaaactaatttcatagctcgcctataaaccacgagacgaatttattaagcctaattaatttatcattagcacatgtggggttactgtagtacttatggctaatcatggactaattaggctcaaaagattcgttatgcgatttccatacaaactgtgcaattagtttttctttttatctatgtttagtacttcgcgcatgtgtccaaagattcgatgtgacgtttttgggaaaaaaaatttgggaactaaacaagtcctaaggggtgtttagatctaggggtgtaaagttgtggcgtgtcacatcggatattatatatggtgtcgcatgggatgttcggacactaataaaaaaaaactaattacagaatccgtcagtaaaaccgtgagatgaatttattaagcctaattaatctgtcattggcaaatgtttactgtaacatgacattgtaaacacgacattgttaaatcatggagcatttaggcttaaaagattcgtctggcaaattagtcgcaatctgcgtaattagtttttttttagcctatatttaatattttatacaggtgttcaaacgttcgatgtgacatgttaaaaaattttagggtgggattgcggaagggaggaaggaaatagttaggagtataagttacttgggttggagttggggctacgctggaatactggggcaggaaccacagtgttctcttgatcatgaaggtccattcgaatggcagctctgccattggcgtcgccgcatcgtcgtggaaggagtacttgtacacgtggcacacatccggcattgtccaaatgacaaagtaggcgcatccgccgctcacctcgccgccggcgccgaacctggcggcgtcgacggcgaagctggtcgggcaccccaggaacagcgcgtgctcacccagcagcctcccgccgtccgccgccctcacccacagatgcgccagctcgtcgccgtcgccggccgccgccgccgtccccagcgtgtacagggacaccgacagcgcggcggcgtcgatctggtaggcgctgctctgccatggaatctcgacgcaggcggacatcagcttgccccgaaactcgaaggtgtacgtcgatagcagccgcttgtacaggaagccataatcaggcggccatcttcttgtcctggattccactactcggccgccgccgccggcgtcgtcgacgagcaccctggcgacgaacgtctggtacaggtcggcgaacacgacgccgccttggtgatacgtggtgcagcagccgtaccccaaggcggagtaattcatccccttcgactctaccgtcgtccatgccgtgtcgccggggcggaggatg

SEQ ID NO: 57798 - DNA, 2334 bp, Oryza sativa
atgagaatttacacgatacgacatcaagaaaacaagaagacaagtattatactggctcaggcccctcataaggtaatagctctagtccaggttatatgagattgatatggaaaactacatattagaatagagaacaatcaatcccaagattggcggcgagacccctcgtcgagatgatttcgacgagatctcccggtgagtaggcttcacgtcctccggattgtaggctatggtggtggtattggcgctatgattcgatgatctggatccctcaggggatgtatcttttataccgtgaatcaccttagtctccaagtagaactcggagactacggaccctgcacgatataatataaacccaatcctcaaggtagggctctactattcacttgtccatgaggataattttcatagtctcttgtcattttccttgttgtatatggaagtatatcgtacatacgaaggtatgtcgtatctgtatatttcatatgtcataggatagtaagtatgccttattcgtaactatgacaggtacgtcatccgtatatgagtcgggtttaagttcgttctcttttgaaaatacatatccgtatttgagtcagtttttaaagttcgtttattttttaaaatatagaaggagtcgtataagaaatctatttaaaaaaattacatgctagcttgagacgatcggattcctaattgcagctcatgattttctaaaaaaaatatgtccaatcgaattcctatggcgaatttcaccttaactaaaccgtataataatattattattaaaataatcttcacccgttgcaacgcacaaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcggaggatgcgagaatattagcagcgtacttcttatattaactatggaggcttagatgcttagtgatcacgatgttctatgcacaaagactagctacagtcttagttaattgaggcttagaattgtgatgcagattggatggagtattcaaaaaataatccattagttgatgcagatcgatctgaccaataatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatattcgatgtaatatttctggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagagtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctttgatttgatccaagct

SEQ ID NO: 57799 - DNA, 8081 bp, Oryza sativa
gggggggcggttgaatcggtcaggtggacgccccactggatactgttcattctgggtggggttggatcaggttttccgctgcgtgtgtgtatcgtgtaattcgaattcggcgtgctcgtgctggacctggacgtgaggggtcgggtcagttcggatgggtttgagcggcgaaggcgcggcagcgccggtgcgtacgagttgagccgagttcaactctggtggttgtttatagcatgttatccgtcccacaaaaaaccaatttagataaatataagatactaagagagtactccagactctagtacactagtacgagcggaggtataggataagtgattgctaaatttagagatatggataatgcatgtacaccagagccgatggatggaagatgcaagggaccgggttaattgccacagtgttaagataaggattatccagttagaatgtatctctgtgaatgccatgacttataattttaagtctagatcaagcataccatcacggtcatatttcaagtgtatatcatctagcccacacacataacaactactactcctacatgatatccgatttgatctaatacatgggggatgattggaagacaagatccgttgctttgatattggtagttttatttttcttttttatttttataaacttattctaaaatttagaaagtgtgatgttactgttggaccatattatcgcactatagcaagaatgacgtgataggagtgaccatgcagttggatagagttggtggagcggccctctagcctaatgataacccaatgatagaattaaagatatagataacaacatgagtcatgcaaccgaagactagccgttttggagtttatagatagatgagaacaatccaatgcaacttgctataaagttaggagtaatgtcataatggtatacgtccactcacaataattttttcgcataaaaataaaaggagaacaatgagataatcaacttaaaatggctttagagtaagggttccaaaatgctaaaataatcgctaggttatcagcctttatccaaacgaacatgtttagaaaacatactggccaagttctaaaacacaaactaaattttaatttttggtataatttaatcatttttacccctttttttggtaaccactcgattattgtagttttctagtgttgattgtattttgaaactgaacactgctatacgtattaaaattttcttacaaaactcttactaacaaatttttcaactgtttgatttaactagatgaaagtttaaaaaaaatctagatttacttatagcttgccacattagactttgtaaacattttgtaagaaaatttagtacgtatagacttttcctttgaaacctgctcctgtgtatcaactatcaaaccccaaattacaacctagagaattctaagatgctccatttgaagtggttaatcgtattgtgcatttcgtggtagcgtactagcatttgatttcaaaataggaatccaccctcaaacacattacagatctttgctcccttcgtcattcacattttggaatccaagcgtgttgtcaagcttcgttgttagtggctcatgacggctcttcgccggaatgcagcctcaaatcaagcaagagagcgggttgagcagggctagaccttattcgttagatctccaagtccatttggtgcctgcctcttgtttttttagtgcgatggcgttgttgtgagcgatcctggcgccagtgctcgatgatcatcaggagattaaagcaagggcatgttaatgtgatgaagtgatatttctgactttctgtggtggttaataattccccccattctgactccaagcgaagacacgtacccgaacagaaactgatcagactcggcttggatcaaagttccagtttttaacatactccaattaattttagaaagtgtgatatcgatgttgctgttggaccatattatctcactatagcaagaatgacgtgataggagtgatagaagtagccggttaccatgcagttggatagagttggtggagcggccctcaagcctaatgataacccagtgatagaatgagagatatagataacaacatgagtcatgcaactgaagactagccgttttggagtttatagatagatgatatgagaacaatccaatgcaacttgctataaagttagaagtagcatcataatggtatacgtccactcacattaattttttgcgtaaaaataaaatgagaacaacaagataatcaacttaaaatggttttagagtaagggttccaaaatgctaaataatcgctaggttatcaacctttatccaaacgaacatgtttagaaaccataccggcccatactggctaagttctaaaacacggtctgaaatttaaattttggtataatttattttttttacccgttttgttggtaaccactcgattattatagttttctagtgttgattaattgtattttgaaaccgagcactgttatatgtattaaaattttcttacaaaactcttactaacaaatttctctaccgtttgatttaactagatggaagttaaaaaaaaatctagatttacttatatcttgccacattagagtttgtaaatattttgtaagaaaatttagtatgtatagacttttcctttgaaacctactcttctgtatcaactatcaaaaaccccaaattacaacctagagaattataatatgctccatttggagtggttaattgtattgggaatttcgtggtagcgtactagcatttgacttcaaaataggaatccaccctcaaacacattacagatctttgctcccttcgtcaatcacatcttggaatccaagcgtgttgtcaagcttcgtcgtcgttagtggctcatgacagctcttcgtcggaatgcaacctcaaatcaagcaagagagtgggttgagcagggtgcgctagaccttattcgttagatctccaggtccatttggtgcctgcctcttgttttttttagtgcgatggcgttgttgtgagtgatcctggcgccggtgctcgatgatcatcaggagattaaagcaagggcatgttaatgtgacgaagtgagaggcctgttcagattgtaagcaaaataaaccttatgaagttttgacaagatagaaatattattaaaattttgataggattttttttatgtatttaccaaatttggcaacaaactaaatgtagacaatttttttagcaacttagcttaagaaaaaggtatggttaaaaatggtattaaaatgaacagacccgatacttctgactttgtgtggtgcttaataatttccccttttctgactccaagcgaagaaacgtacccgaacagaaactgatcaaactcagagtggcttggatcaaagttccagtttttaacatacactccaattaaacggatcaaactcaaaccaaacgtacgatcagcctagagataaaccggttgtgggacaatcatttcgactgggtggacatggcagattggcagtatggcactagctccgaggataacacattcatcagattcagaggaagcagaatctaatcctctcctccaagcctcgttcccttgtccggttgtcccccgcactcactccaccccccaccgccgcgcgctacgtcacgcttcgctgtctcgcgcggtccacccttttcccgacggcgacgtctcggtctctcagggccccggccggccgtcctctcctccgccgttggatcgggctccgacggcccccggcccccgcaccggcgccagcgccgcaagatgacggcgttttgcaggccgcatatgcaggcatgcagccgctgctgcgcagccacacgtggggtgttgttgttttagctgcggctgcggctgggcgcgacgaggttaatttgctgggtgtgcgtcctttttttgtactgacgtcttacctgacagcctccacgccctccattcgttgcgtaccgtagcgtagagacgtagtactagagtagcacagcagaaaaaaaaaaaacaaaacagcaacactcgctagtactacgtaggagtagtataacgtgcgctaaaaatgacacagtgaccttagtcgtaggcgtaaattaaacagcaccagtatagttacctattactacctccctacctcccttttatgttataaaactttctaacattgtctatattcatatagatgttaatgaatttagacacatacatatatctacattgattaattaacatatatatatatatatatatatgtatatatatgtatgtatacatatatgtgtgtgaatgtgagcaatactaaaaagttttataatatgaaacggaggaagtaccattcattacgtaggcttaaatttattttcttcagtggaagaaagaaaacgtgtattttccttagggaaatgtcaagaaatgttgctctgcctgtatatggtgagtgtacactatatgcattatttattctttatgattattcttgcacgtgatttttgtatgctcgaacgtactcaattcgtttcattaaaaaaactaatctagtatgggatgtgacacatcctactataaatctagatatatcattgtactaggatgtatcacattcaatactaattttgtttttttttaacagagcgagtatgtatttcaaatcaaatgtcagacgtgtgttattttgcaaggtactcctacgtgattggcaacagcgacatacgattattctgtccaagcatgatttgtcaggtactagtattaattatacaagctaagccatgcctttgttgagttgcatcatgacaggtttgccaggtgtgggatcagaaagctggatgacaaaaaggcctttctcggctctcgcattcgcgttgtattcatgggccggtagataagccgtgaaagaaattgcgctgaaagatgcagagatacgcctcgcaccatttcctagctacaaaaatacgttctcagtacactgtttgttgctttttcttaacacataatctttctttaggattcgtctatctggtcgttagcagacatcggatgaattaggggataagtttatggatttatattttgcttgtgttgacagactgtatttagcatatttatatatgcgccaaaaatcctaggaggaactaggtatttttgtctggtcggaaaggtactcgagctaaattagatattggtttagggtttaattctgttatgtgctggaaatgtacacaggaggtgtgtccgtgtgtgtgataaagttatggttgcaagtcaccgtgtccaaacataagatacggagtatatagtgatacacaattttattgttgtgtttacgttgtgttctttgtgcgtgtggtaaaagcactactcgttgatgcgtgagtgtggtgtgtgtacgcgtcttttaattaagctagaaaagagattagtgcctcctgcgtttctagagtatataagttaacccctacaaaaatcatacgaggtcctataaaattcgtgtcctttttcagtaagctggaccgaatctgcccaaataaacatctgcatacatatacaggataacaatgtcgctgcagacgtagcaactcaaattgatatcttgagcttgatacgtccgtgaacgacaatcaccgaacacagaatctcaatgattgcaagtaggtaatcgaagctagctaatgcaccatacacggtctggattaaattgtgtaagctttccccgctaatctctgtttattttaacctgtcccaatcgtgtggagtatgtgctccatgtgctacctagactaaagaacgttggttttggattgattggagggaccattttaatttttgagccccagattaatgcggagaccagttgcaaagctgcggctgagtgcaaccgactgtagagacatcggtatcaaatggtaataacacaatgtcagttgttcagttggcatccataccccgctgcccattttattgcaaaaggggtagcttttcaccaagctaagaaataacgtaaagtactccgcatgagtgcatcgaatgaaaataccatttggtgtcacctgtggcaaattatgagtggtgcattagagtattatacacgaaaagtgaaaagataatgcagctgcgacagtttggccgagtggtctaaggcgccagatttaggctctggtccgtaagggcgtgggttcaaatcccacagctgtcaaattttttgttttactttctcttgtttttaaaggtgttgatttttttattctcactttatctcccattattttattttatactttctcttattgtttgtcaacgagtgttttttttcgcacttttttttatctcccgttgtgatcacacatttacacaattttgagccttaatattgctacgaaaggaaccttttgttttgtatatactgccttgttgatacactagttacttataggattaagatgcaccccttgtaatagtagtattgtctatatcataaataaattataccgacagaccttaaacttgtaagtaagtttcacctatatccacgaatttgcaaattacgtattgagatccctaaacttgatttattcttatatcatcctagtttaaatcctcttctgacctagtcttgctcacgtgagtgacatgccacttggaagataacatggcaaaatttttcccttttccttcccctttttcccccttcccttcttcttttctcttcttcccctccaccgctggatgcactagtggcaacggcagacgagagaaagatggtgccgaccaccggaaaaagagccgccgacgacagagttggctcgacgatggagcagaggttcaaggtcagaggtgacaacggtcaccgtgagctccccactctctcccttctctccacctcgagctccacttgatggcgattaagagctcctcctctgtcatgctcatggtgttgtccgtgattgatggaaggaagggggaagaggggaggaaggaaaatgtgctgacgagtggacctttagcaacttcttttttttactataatgcccgtaagcaccatatcgaataaatcccatgttaacgtgccacaaaaagtgtcatgtataattcaaaaaaaggcaatccaaaccatcaatgatgataacctggttggttttatatattagttgtggtagcctccattttgaattttgtgattttgtggttgacagatgcgaacaagacttggccatagggaggcaaattagactactatttgctttcttagttttagttaaaagccccttcctcccaatatgcggcccgcatgggaaatcctcacactcggcccaatagaacggccattatggccagtgcagcccacccgagggtttatatgcgtgcacgcactcggccattcacacctcctgccggtctcctccgaaccctagcctgcttctcctcctcctccccgccgccgccgccgcgagcacagacgacgcagccatggtaatgcatcccatttctgatctacgcttctccggcgtattgcctattcgaaggtctcgtttgctcaccgggaatgcgtgccgccgccgccgctgtttgtgcttggtgcagtccgggaggaagaagacgcgagagcccaaggaggagaacgtgacgctcggccccacggtccgcgagggcgagtacgtcttcggcgtcgcgcacatcttcgcgtcgttcaacgacaccttcatcgtgagatcccgagacctttgtttctgtttttgcgcctaatttatgttaaggcgtggtgtgttgtgctcgttgctatggcggtctcatacttgggtttcgtccttgcagcacgtgacggatctgtccggcagggagacgctcgtccgcatcaccggtaatttccctacttgagaacaatgcttattattgttaaagtttagtgtatttttgggccaatcgcattgtgaagtttattaatctactactatcgaatgagtgaattggaatggtgctgttgttgcatctaacagcggtaatataatacattgtagtagtcaatagaaatgtgtggctgttatgtatcgcggctgctggg

SEQ ID NO: 57800 - DNA, 14854 bp, Oryza sativa
tgttggagtaagcctcaggaagccttatttatactaagtcctaattgcccaattcaatttcgcatggattgggggggtcagcatcccagctgacatcgggttcaccaaggatcttcagtgctctcacagttttcagcaaagttggctgcaacctccatgtagactgtctagccacatctgttctttaatctgtttggttgttgactttattattttatttgttagcatggcccttaagatcgcctcccttttgttctgtgggagcgtgtcgagtcatagccatgcaagattaacaatgatggacctgagagtttttctctggaacttcttctcttcccgcttgttcgtcaggtgtttccattgtggcattgggtttcctgtggtgtttggttagtatggagcctctgctttctgcattgctcctgctgagtccttcattcttgcaactctttgccacttaaaaatggaggtttctacatgttggaagggaacatgtcatattattttacaactgcttctctttttgtttgaagattttttgtgtattagctgtgcaattttccataccttttagttgctatgaatttataattatggagttatgaatttataattatggagttatctgaagtttctcactggatgcagctcactgcccatttgttttagggtgttaatattttttaatcttcgttgggttttggcatgagaattcattggtcacaagtttttttttatcttagaaccacttgttatatcttgctaggattcataatgtaattagtttctttcagtaattgaggacggtgcatcaatattgaaccagttgtatatataacgtaatcgcgtttatgtttatagatgcctataaaattgtgattttatgcatttttatgatccatggttgtcttgccattttgtatgctctgagatcagtaagatgttgatgttctatataattcatggttcatcagaccatttgaaatcttattcaaactacgtgcaaatgctttgatccagttttttttaaaaggaatatcttgtagatctctgctgttatagttacaaaattgtattttgcaggtggcatgaaggtgaaagctgaccgtgatgagtcatccccttatgctgccatgcttgcatcccaggatgttgcacagagatgcaaggtacaaaaatacctactgaaacattaattgtctgctgtcagttgatacttactgttttgttgccctgtacaggagcttggaattactgctctgcacattaagctccgtgctactggtggaaacaagacaaaaactcctggtcctggtgctcaatctgcgcttagagctcttgcacgttctggcatgaagattggacgcattggtaatcttatagtccccattaatttccttgcaccattggcaccttggtggttatctagcatttgttattattaattgtgtttgactatttttgtggaaatttatcctagagttgctaacggactgcgcattgtaatgcatgggtttttttggttatactactgtttataattcaatttcttatactattgtttgacatacatagtatctagaatagaatggctgtacatttaatttagccttgtaactagtatggttgatgctgaacctgtgctagctttttgttgttgaaaagatggctttgtttaccttttatctactcgttatgctcagtgcttagctactcagtgttaatcagcctcctaagttatttttacaattattgtcaggttgaacttacaaccatttccctcacgatttctgtgaagaattaatcttatttctgttcttaatttgtgaaacagaggatgttactccagtcccaactgacagtacccgcagaaagggtggcagaagaggaaggaggctgtaattccgtgtagtgcctgttatggggggaaagcaaagctatctatccttgtccttgcaacttgttctgtactctattatgatcttagcatcggatgtggatttataaattttgagctatgttatgttctttagaagatgaatgacctccccctataaagccgattatctaaattttggttgctgttatcacaactaatgtttatcagattgtgttttgtgttgctgttgccgtgatatgacctgctgtccgtgttcccgtcgttaagtctatttttgtatatcttgaatccgttcttagctcaatttggttcaatcactaatcactaagttgctttgcagtcaccttcagaatattatcttctaatctgttttcgtagtcgacctgcatattttgatcaggagaatcggctgaatggttttgtatcgcctcaatttgtacgccatgttggctgaggcacagggttgaacagcagaatctgaagaactgtactacctccattttacaatttaagttattctagtatttcccacatttatacttgatgatgttaacatcaatatgaatatgggaaatgcaagattcattaacatcaatatgaatgtgataaatgcaagaatgacttacattgtgaaacggaggaagtatcttttttggaagcttcttttttttttctttttgttgctacgcgtccaatacgggtgtgtgtttggttgcttgcatccttctaacctggcccatctttctcatccaggatgtgtttgtccagctcaagaggatacacgtgtggggcccatctctcatccaggatgtgtttgtccatctcaagaggatacacatgtgggtgtttggttgttcgtattggatcagcctggttagcaggagattttggatgtgtttgtccatctcaagaggatacacatgtgggtgtttggttgttcgtattggatcagcctggttagcaggagattttgtttggttggttgcacaggagatacagtatgatagagattttatttggttggatgcatgaaggctaagtttggttacctcctattttttgggtgagattaccctaatgcaatttatgaaataaatatctaaccgtttaatatataagaaaatttgttctatttgtatctgttgaatacgcaaataaggaaaagaatcggtgaatatgcaaataaggaaaatgaattggtgaattgatcctcacactattgctgaccaattaagtgaaggagaaaaatatcccctattgctgaccaattaagtgagaaaagaaacaaggaaaggagaaaagtatcccgtagatctcatcgccagccaactactcagtgtggtccgctctgtaattcccctccaccgccgcaccgctcagtgctcgcgtccctagccacgccaagatctgatcatccgatgctacgcaggttgctgcccctctcctcgaatcgacactcaccctaccagatccagtcatccggtgctccggcaagccggattaggaaggacagacgcaaggaagatggcgaggataggagaaatatgaagccggcgatgacaacaacgctgctcgagcgtccagatccggctaacacaaccaactactggatctggcggcggagtttggggccgacatgatgacgccaagcagtggtgagaggctccaccaggcaagcagctccctgaggtggtgatggcgatgacgatggagatgatggtgaacccagtggcctcgaggactaaatgtgagtaggaggtgagtgaatgcttcaacccccctgcctcggatcaggatcctctgcagtcaaagtcacgtgactttgacattgacatgtgggtccaataatctctaagtccacatgtaagtgacaaaggcattatgcattcaactgtaaagaatctcaatacccctacctcatgcatccgcgcggaccgcgcatccccgcctgcacccgcgcgtgcccgcatctgcacgcattcagccaggatggcgagcgaagcttaaatcgagcgtttcccttgggcctagctgggaagggagatttgcacgagtggaaccaggcctaggaggccgtgcgggataccaaacacgtgctccttgcaccagcgggtgcgagcaaacccatgtgcaggcaaccaaacacgtcctacgtgtatatgacaatacatactctcatgacagaccaccggatattgtcaaactctgaaattatagttgtatattacacgacgaaaggaagaaggaatggagggagatagccgttgcccatggcatcaccacgagcatgcggttccagcgaggcattgcacgcatcgtgccaaccctttgcggatttgcctccctttgaaccaggcagttgcaaagcagaagggcagcaccacgcacccacagcaccgatgaccaatcaccatcgccggccactacctcgccgtgctgaaagcctgaaacggctaccgaatcattcgaatcatcgcctccacatttgtttcaccaccacctacctatctacagtgtcacctttgagctggaagccacacgatctctttgcaaaccggcaagccgtccctcctttcacttccctgcgattctgcgaatgcccgctacttgaaacgatgcaaaggtggaaaaaattacgtagtacaaaccatacaatagtatgtgaaaatctaaaaactatgaaaaatgaatttctgactaaagttatatttgtgaacgtggataaatctcaagcgtccatttttacattctacggtagtttctagttacagcaagataaaaaataaacgcctgataaaattttactcgtgatgaggtgaacaaatatcatgtattcatttttatattttagggtagtttctagatttgcattgtaatacatgatttttctattgcataatttctcctaaatttgcgatgcatcgtcgcaccaatcgcactaggcgtctgcatatttcctcggccgacgactcatcattgcacttgcgcgatctccgtcgcccgccggagcctgctgcctgcagcgacgcaagtggccgtctgctcctgctgctgccgctgcgtagaccatgactcatcaacgaatcagctaccgagtggtacatttgcttgatccggtgtgtgtcccctcggcctgcaaccctccactgcccggggttcccacctctcccggccggcaatctgatcgaccaaaaatggtcaatggatagtgtgcactcaggctctcagcttgcatcaccgcgtgctagtggcctgtactgtggccacacacaggaccagactatggtgaacttgtctcactctcttgcatatacgctgaacacgagcagatcgatcgcatcagcctaccgaattatttctgcgggtgtgtatgtgcatgcactctagtgggcctcggatgtgatatggctctgtcagatgctatgatcgatctgtgccggtcatgagatgagatcggtcgagcatgcatgtgcagtttccgtcaattatacctcaagttgttgtatattgtactacagtggatggagaaaggaagttcagtgatgtccagctacgtactaacacacagattgtgtgttcatgcatgttgcttccaacattgtatacttgcttaatttttgcccagtatgcatgtatgtgccgaacaatgacaacaatactgcagctcctcccaagtctcggtatagtgatacagattagttgtgtaaaaactagcactgcatgtacacttaattaaaatcttgcacataaggcaaatgtaatgaatgaactgcacgtaaccggacacttgcacgacgatgtgtgtacttctttttttttgacagagtggtcagttagggacagccatatataacaggtgatgaaactagagtatatgcatggaccgagcttgtggaattaatatagatcgagcaagaccgtaaaggcctctatttttagataaataatatatcttggtcgtactcagtgttcatggaagacagatccacaacccaccattggactgtttattgcgatgttctctttttaaagttttgtggcctcgctagtaatccacttcgagagaagctgacttgtaggcaatactgattactccctccataaaaagaatgcatataagttttcttacatggtcttcaagacttcaacatggagctttgatcattaattaatttcacagtatattatgaataacatgtccattataaataactatataagccatatgaatgggactaaatgtatcagttaaaagttagaagaccttttcaaatatatttgtgcctatatttttggatggaaagaatatatagtatgatggctggttaccagttagtgttgattataaactactccatccatttcatattataaataagacgcttttgactttttctaagcttataaaaaatagtaccattcttaacacgaaacaaacactataaaaatgtattcaatatttatttagttaattgaactaatttggtgttatagggatcagttgctacatgacttttaaaacttgattagaccaatagaaaaaaaatcaaagcaacttataatattaaacagagaaaatactgaattaatatgtgcgtcccaatgtacttttttcaaaagaaaagtaatccactccgagattagttcagccctcacaaccacgaactgtatgttgccatttgtattgcacttcacgcgctggccattttttttaaaaaaaaccgttggctttcacaagatagatgtctgatcaaatgacatctttttttccttattgaaagaacgttatctaatctcatatcttaccttgccctgatcttttggtatggttgttaactttcagtcgcacaatagcccatatacctaactatgttgcagtcaggtgatctcatgttcaccttttgagaaaaagaactagagtcctttgatggaacttgccagtgatcgatgataaatttatctctgtgtgtattttcaaacagtctatatacccccttaatctttgaatgaaagtccttttaacaccacaaattttaaaaccgaacatcttaccctttaaaatttgaaatactgattatattacccctacattgatgtacacagtgatggtgcgtatttggatgtttaaatgaatggttttaaataactaacataacacatttacacattgtcaatccttggtccttaatttatgctctacagtaagatcatacgagtattatattagtatttatttgtaggtgagaaagaacaagtgggaaaataataagtagagattttgacacacacatgtccaatgtgtatgtcacatagtcaagcttgtccaatctatatgcaaattaaataaaaaaacacattgcaaaactattttagcagtgaatgaacgatcttgtaaagttgggggatttatatgttcggttcacagtgtttcctggtacataaactttttccatttccccccgcactaaccgtaatttcgttcgtcaactcaactggttccgctcatatgggggggggagcctatcaggatgattgtacacacatttgacaattatttttctttcgtaattgcaaatttctagaaactattaagtcgttatccagaaagaaattttgaaaatgcaattaggtttttgggacaaatccagtgattacacttacacataaaaaaaattcagatattctggtatatcagtggtctggtctatgcattgaaagatgatatcttaagacaaataaagcaaccggagtgcatctaacaccagtgcgcactcatgggttatactagcatcaatctttattagtcctaatggcatccatgcattcaaactgtccccttggtacatatgcatacgacacgtgtgactgaaaccattttacacaagggggcatgatttagcacataattaagggcaatcagttttttcttttccgctgaaactcaaaaatctagctagctactgaaggtagttctcatcatgcattgcatctatctctctcaatttcaaatattgtttaggctccattcatcatgaccggcttcttcatctcccacgcggtgagctgcgacaccttgatctccgccttcccgttattgaaaacgtaaaggcgcgcgttcttgccgatggccagcgacgggtacaccctcgacaggatgcacgcctttcctccagccccgaagctctcaacaaccgacctgtcgatctgcacaagagagacacaagatatcaaaacatattctacaatttatgaaccttttccagatgaatgttataaaacagtaacccgttcggacgaggtgatacctatgaggtacctatcagataggtatcagacgatacctcaaagatatcatcccattcaaatagtttattagccaattaatatttattaggtatcggacaatatttaagaggtataattttatccgaacgggataccgtcatgcaacattttccttttttcccgataatttggtcctattacgtaccaggctcctcagagatatcttcccgttggtgatgtccgtgtcaacgaaccctgcaaacgtcggctggtacatgttcgggttgcgcgatgacctgcacgcatacgcaccataccaaaaaatcagtaaacggagtcaaggcaatattttgtttattgtgtagtgcgatcaatcaccgataaagtgcaaaagccgcacgtacttggtggggtcggtgcacatgagcacgacgggcttgccggcgccgccgccgcgcgccgccggcctgaacaccctgaagaacacggcggtcttctcctccagccccgcggacgcgagcacccacaggccgaacggccccacgccgcccctcgcgtcggcgccccgcgcgctgcacagccgctgcgcgtcgtacgccatcgccgggtccagccgctccgccgcctccaggctccccacctcgaagctcacctccacgtcagcctgcaccccaccaaacagaatgcatgatcacttcatcagaccagggacaatagcacactataagccagctataaacacatttcgatcgaggagataaaagaggagagagaaaaacaacaagctatagatttacagcaaattatagtacggactttaagatgcatatgtgtatgacatgtggaaccatgtattaattatttagtatatgtttataggtaactattatatgaatttattattagattgactatagataatttagagccagtagttagctatactattaaacttgctatcagagatcacagctcctactcacgtacgtcaccaacaaagcacattaattgagctccttaactatctctctaattatgttgtttagtgtcttagtgatatgtgcactaatcacgctgcaacctggaagttgtacgtgacatgcgcggatgacgagagaatcagtgagatcagttaagtacgagcaaagtgtgcaggagatggtaaaaggggacgagaagaaagcgacacggcacacgtagtaggtggtgttcagtgggcactgcacactggacacaacttcaggcgtgccagataagataaagatcggtccaggacacagcaaaacaaacaggataacttattaataattactactgtcatgcacagaaccatggatgtgtgagcagttttattcgaatgcccttttggggtaaaaaaaatagttttacagaattacagatgcaaaaaggaatacctgtgcagtttgtagcccggtcacctcgacgtgttcccctggcttgaccaccctgtccttgagaatgaccggccacttccctctcagcctctcgacctcctcgattggccactgcaacagttgcttcccacttgggtccagccacactttcctcggaatcgcctaaaacatcacatcacaaacacacgattcaatcaaagattaccagcaaaattgagctgctagtgttgttccatttgacttttaagatatactctcttttttcaaaatacttgacaccattcgtcttattcaaaaaatttaagtaattatttgttcttttcatatcatttgattcattgttaaatatacttttatgtatacatatagttttatatatttcatatttttttaataagacgaacggtcaaacatgtgctaaaaagtcaatggtgttaaacattttagaacggagggagtatatggtgatattgactatctgaagatggcagcatgcatggtggacacgtaaatggcatgcacgtatgcagtcaggacgtgcggttaattacctggattccggcccagcccttggccacgtcgtcggcggcggtgtcggactcgttggcccatccccagaggatgcggcggcgcttcgccgggtcgtagaacgtcttggaggcgtagaagttgccgtagtcgtagcggatgtggtgctcgtcgccggcggggtcgtccggcacgtaccgctcggccttccggtcgtacgttccgacggtgtagtagtcgtaccggcgcaggtcgaggctgttcttgagcacgtacttgacgcgcgccgaggcggcggcgtcgacgacggcggacgaggtgtcgacgccctcgcggcggccgtccgcggtgaccgggtagaagtccgggcactcccacatccccgtgggcgccgagtgcagcggctgcgccgcgcgcgtccaccgccggaagtccctgctccggtacacgtacgccacgccgcgggactgccccgcgaggctgccgacgagcagccgccagtggccgtcggccccgcgccacgcggtggtcgggtcgcggaactgcgtcgcgttgatgccgccctcgggcacgatcaccgggttgtggccgggcttcacccactcgcgcagcagcgggtccgacccgttcctcggcagcgccacgttctgcacctggtagttgacgtcggggcggttgacgccggtgtacatgatcaccggcgtcccgtcggccatcatcgtcgccgaccccgaccagcagccgtacttgtcggccctgatgctgggctcgatggccggcttgagcgccacccagttgatgaggtcacgtgacactgagtgcgcccacacgatgttcccccacacggcgcccttggggttgtactggtagaacagatggtaccaccccttgtagtacatcggcgctgcatgcacccgttcagtttcaccaaatcaagaaatgatcttcagtcttagtagtacattgaaatcaattaccatttcagtttaatcgcgcgtgtacattgcatttttctctacactgctcacgattaattatagaactatagatgcttcatttcgtacgagaaaaaggtgaacttttggctaattccctttctgagaggaagttaagattttctgaactttgtggtcatcagccgtggtaggggctaggtaccccacggtcgacaagcaagcctgcatgtggagtcccagtgcgcctaccattttcgtgctaaaatgtgctttgaacctttaatcctaccatgaaaggcgtcactaactacagtcctctcccgtacaacgaaattgcaagttgcaaggcataaaagttctagtactactactactactactagtagacagagattcgtgacaggatatattataaagggtgggaaaacgacgtaccgttcggatctgcgggtttccaatgttgatgacgcagcagcaatcacagtgtagagcagagcacacccccaccaaataattgcacaagaaaattgccggttaggactaagccttgtcacaagaatcattagcaagaaaagtagaacaaggtagtacatctgttaacagttcgaagggactaagtgtgagcttcatgaaaaagagatggcaaactctcagtagtttactgtgagatgcttctgaagctacttctttcagcgtgaccgcgtgggtgctaacgttgactctactagctgacccgacaaaatggacataaaaactgatgccttagtgtactgtccgtaatttatgttgtgtgccaaacatttgatatgactatgatgtcaatattttcaactctgactataaattactcaagttgagccatttagttcaggtgatgttctacacaacaacgtcgtcaaaactgtactagttactctgcacgattctgcgtctcaattctcaagaacagagcactctgttccctttgctcatctatccagtatccacaaccacaagtggtgccctatgacctgcaaatcatacggcctgaccggcgttctggcatgaacaatggcaagttggcaacatttcagttagttcacattaccattgatccagttcttgggtggctggaagtgatacccagtccggagctcagagtcgacgatggacggcggcacgccgtccgctgtggtagcagccgcctgcagctcgaggtcgtcgtagacgacgtgcgacgctccggcgagctgctggagcagcagcagctggaccagccatgcccaagcgaccctactaccaagaactcccattgctctcacacttgggcacaagaagtgagagcgagaagaggagaggaggatgagcaggagcagaggagagggggtcctatttatactgcgaaggtgaagagatgcattatggaaaagacgctgttttttttcccctaagcgttgagatttcaaagattgctgagtcggacaaaagggcagaagaatggcaggcccgggcgggccgcattactgtgtggacgacctaacattatttgtgccctgggacgtccgtgacctgcatgtttctctcatgtttttgatatatatatatatatatatatatatatatatatatattgggatttgtcttcatattggctctgatttataagctggagctcaaacaagcctaaatccatatacttttttttcctaacatggtcaccgcatggagcacaaagccatctataacgtattgggaaacaaaaagcaaaagttgaatggagatcgttatcaatccgaaccaacccaaagatatcaattcgatttttcatgtataaaaacactgaagttagcttgtaaagaagagagcagcactgctccttctcgtggcttatatctctatctacaggccattacgaaaatgtcaatccgttctattgatctttcatgtctagaaaattacggcatcatcttttcgtttatacttatacttatcagctaaacttaaatttttaactttaaatttgaagctgattttgggtttttttcatcgaagtttatttttcactctttgattttagattgctaagaacacgtatataaaaattttattcacaaattacttttcgtttgcaaatatgccgtttagcttattccacgaataagccaaacgatgtggttgttaatctgtttgtttttaaatcagtgttcacaattcactatgaactattatattttctctcatataatagcatatatgttttctcaatatattgttcaaatatattaaattgacaatataattttaaattttgcaataactttacgaaactactaatgggtaatattcatattgtattttatatacgtgttagttattaattattttaatatcaatttttaattatttgtaaattatatatattcctatatgcactctagactcgtcttttaatatatattttttaattccgaattttctgtaaattgtatttctatatagactctatgctcttcttccaatattatttatttttatttctgaatttttattatttttaattgtatttctatgtggactctaaacttatctttcaatattctttaatttttaatttcgaatttcagttacttctaaattgcatttctatattgactttaaactcttcttcccatatttttcttaatctcgaattttagttatttgtaaattgtatttttatacggactctaaactctactttaattttattatgtttattccaaattttagttagttttaaattcctatatggactctatactctaattctaatattccatttttttaattccgaatttctatttttttttcttaattgtatttctatatagactctatactctatttctaatattccttattttttaattccgaatttcttttttttcttaattgtatttctatatagactctatactctatttctaatattccttatttttaattccgaatttctattatttcctaattgtatttctatatggactctatactctacttctaatattctttattttaaattctgaatatcagttatttcctaattgtatttttatatggactctagtctcctcttctaatattccttattttttaattccgaatttcaactatttctaaattgtatttctatatggactctagtctcctcttctaatattcatttttttaattccgaaattcagctttttctaaattgtatttctatatgaactctattttttctttttttctgattaatgtgagaatttctagaccataagagcgaacgtggaggctcctttttctattcctttaataatataatagatagatttgtctatagtgtacctctttttttaaaaaaaaattaagggacctatatactacctccgtcctataaaaaaccaacataataccagatgtgacacatcctagtactacgaatctggacatacatttttcaagattcatcgtactagaatatatcatatccggttatagattcgttttttatgagacggagagagtatcttacaagcgtatgttaaagattgtgtgtgttcaggggttgagtgttcatatatgtggtcgtgtcctatcgtacactaggaggctcacccagaggaggcttcggagtatggccgatcaagcataagcatcatataccctgtacaacataggctattaaatagccctctggaatcttgctatttatgattattaaacgtagattaccgataaaaccgattccataacccctaggctatttt

SEQ ID NO: 57801 - DNA, 4274 bp, Oryza sativa
ggatatatatactaactactaaattattgcacattgatacatatcgtactacatatattaactataattatttatttaattagggtgtgtttagtgggccatccggaactgagttgaaccacgcggtgttggtggtgggttacgacgagacggaggacggcacaccctactggatagtcaagaactcgtggggcgcaggatggggcgagagcggctacatcgcatgatccgcaacatcccagctccggagggtatatgcggcatcgccatgtacccgatctaccctatcaagagctgcccctgccccatcaccgccgcttctgctgctgcttaaatcatccatgatctgtcgtcgtacgtcttccaacatatataccgtaaatgttatagcacgcgtgcataaaattatctgtggaaataaataaatatgcacgcgtcgcgtggatatataattactactactacgtacgtgtagacgaaataatatgagtgtgcatgtgtacttgtgtgtacctatgtgattgaataaaatagagctctgctcccgtatatacgcatgcatgtgtatgtagatatgcttgcttgacaagcggcaattaatataagagctctgctagttaaagaattacatatgttcttttatgttctatttaatttcggatcggactacgtacgagctgtatttatattagccagaactgtggcacagtgatgcaaaactacttaaattgtaagtattttaacacctacatccttcgtctaaaaaaatcaacttctaattataaatcatggtcagaaattagtcttgttatatgaaggttcactacgttaggttggatcacctctaactagctcaaaccctcccctctgatgggttcggccctgataaaaaatgagtggttagtgataatcctactcaccttactcacctctaccaactcgaggcccgttagaggagaatgtcgcctctaacggatcgcaacaaagtcgcccgttggaggtgactgtcacctcggacggctagatagggatacgaaagaacccataaaccttactcattgccagaattccagcccaccaatatggacaggccagtatctaggagttactagctaggcctaaatgggtaaggtaacccaaagtactgaagcaacaaatataggctaaattatgcgcacgcatatcagtaccgaaggtccttttgcattattagcttgtaggaaagcttgtacagtatgtacgttcattactactccctccgtcccaaaaagaagcaacctaggaggggatgtgacccttcccagaataatgtatgtggatataggaggggtcacatccctagacctaggaggggtcacatcccttcctaggtcgattctttttgggacggagggagtagtgcttcagcaaactatctaactggtacggtgtgccacgttttttgggaacggggatgaagtaagctccacgcgcgatatccaacgtaccatgcgggtagttctattattacacccatatacggcaattttactagtaaaaagttaagaaatatatgtcgatcgaaggaataattaacaacaagagctttatttatttatcaagcacaccaacgtacacacgcatacactgctatatcgttttattcaaactccatacacactcgggtaatgtatacatgtctttatccacatgtgcgcgtgctgaatatgtacctttatttatttacttatgcacatgtgtgtaatgtatatatagttgacgatctattaataagtttcgtagtacgtactatgcatgtgtatagtgtatgtgcgtgtagttgtacgtacatgtatagctcagttatatatgtatattgcatggtaggttggctagtaggatgcgatagcagttggggtttttggggggcagggacacttctttataggatatgtggcgtgcgtggcgatgccacataggccatctggggttcccacgtcacgtttcatgcggatgtagccgctctcggcccagtttgcgccccatgaattcttgacgatccagaattttgtctcgtagtcacaccataccccactaccagcacagcatggttcaacggtggtggcgtttggcaaggcccagtgaacacgccctgcatccatgcatgcacagtgataagttcattttcagcattttaattaaatttcactcgcgaattgaattaggtgaatattattggtgagagagataatcgctgaccccttggtagaactgccacccgctggcgtcgagtgccacagagatgggctgctggtagactttgagcagcagggcggcctcgcttttgttcacccactttacatcgtccaccgtgatgatgggttgtttgcctgccaccgttctgcacggatgcttcgtggcatcgtaggccgggtagtacggttccttcccgcaccgatccagggtgatcccgttcttgacgatgtactgctgcgcctggtcgggccaaccgccggagcagtcgccggcgccgaagcagtcgagcacctgctgttccgacagcgtcagcaggttccctgtcatgatcgcgtttatcccctccaccgcgcccaccgccgagaacgcccagcagctccctttgtaattaattagttaatcccattcattaattttatcaaacaatttattagcatgttttcgtaattaagtgaattattaaacatgttatacgtaccgcaaccgtcttggtccttgacatcagtcacagcaccatgctgcctccaatcccacgtcgccggaggggacacgtcgccgaccagcagctgctcctcctcgatcggcctcgcttgcagcgccggcgccggagacgccggtgtcgtctaccttggcgccggtgtatttggccatgaactcctcggaagtcatgtcggcgaacttgttgaggccgagccagtaggacatgcccttcctcttgttgaattcgtggatgtacctggcgttcttcttgaacacctcgaacctgctaaccttttcggcgaggtccccccactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacaggttaaaacttgtcacccgtcacagatgagtcattagtgacgtgtcgtaactacctgaccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttgtatgctacaagtgagattcgaactcaagacctcaacctccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaattttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagaggatattttttcggcccgtcagagatgactcatttttgacaagttgcgttggcccgt

SEQ ID NO: 57802 - DNA, 86458 bp, Oryza sativa
  unsure (1)..(86458): unsure at all n locations
ttagtcccggttggtagggactaaagatcttcctcttattaaccgggactaaaaatcatttttagtcccggtttttaatggaaccgggactattgtggatatggatcgaccgaccaaagatggtttctctaccagtgttacatgactccatatacttaggatatatatttgaaatatattaataccgaaaatttgacacccaaaaaaaaaactagtataatacacccccaactatcgatgttggacacttaaccatctttgagttgttttgctatggttttttacacgtgggatgccacgttagcccttcgcaacattgaatgaaatataataatacattaatagtttaatacagcgtgtaggcctgccttctctctcacaccgtcacatgcattctctctctctctctccctgtttatggttctgtaaagtggacaaggagatgacacacggcaatgacggtagggttctcgccgccggcataggtggtgcctgagaccggcgcagctgaaaggaggcctccctgttctaccaacttacctaagctcttacgcatgttaggtatttccatgttgattattcacactatgaaatccatcttgccacctttctaccacactcgcatataacagctagagaataatcaaatgtcccctctctgtatcgaattggaggtggcttgcttctaccttgtctggagaactacgatgcagatcgtaaagtccttcccgtgctgccatttccaaagctggtcatgtccctcgatctacttgttccgtcgttcacggattccacctacttgcccttgtttcctccctgtgtggagattcttgttatgtgctcagccctctctattagcgaccgcatacagctgcttcggttggcgaccgtgcgcaacgtcttggatctgctccttccccatgacacctcctccgccgactaccgccacaacctgttggagatgctccttccccgccgccgtgcaccgtttccagtaggcctcctgctatcccctacgttcatagcgctgatgccttcgaagctccacgccgccgttatcgctgcttgtgaaaaagctaggtcaaaacgaaccaaccaagcaatatgggcttggcctatattttcctatgcgctaacgtgatgaagggtgacgcagcatcccacgtgtacaaaaaccacggtaaaacaactcgagtagaaataagtattcaacattgaaagttgagaggtgtattatgcctgggtttgtagttggggagtgtatttttgacaaatataagaatttaggggtgcaaaatgtactttgctcacattctataactacaaaatctatgggttgttcagatcgatgtcatctcaaaccataccatcctttggtaaagttaccaaaattgtgcatccatttagttcctttttttgacaatttagtccttttagaaaacttattttgaaactaaccctcgccaaaaactttaacaaaaaataggccgtgggctcagcgctagtgcctttggcgttgaacccttgcccacatggatccacagatggcgtggggtcagcgccaatgcatttggcgttgactcccgtatacctgttaagtacgtgaagtatattttgatatcatgtagtgcagtggtgaagcccatcccttgacttggtgacctgggttcgaaccttgagcttgcacctttttttttcacttttctatgggtaacagagaaaaaccaaaaaaagcggttaaaccgctgcactatgaagaaatcatgacaaagaatagcacaatgtctaattattacgtacatggggttagcgccaaacacttaagcgctgacccatgccacgtccacaaccaactatgctagcgtggcaaattttagtgctgtactatttggtgctgagacgttggaccttagcaccaacaggattggtgttgagtccacggtctatttttagttgaagtttttggcgagggttagttttgaaataagttttttaaaaggaccaaattattaaaaaaaggcatttagtttcttaccaaactcttgtaaacacataagaaatccagccaaaacttagcaatattgttaaatttggtcaggtttatttggctacaatccgaacaaggctgaatatctggtgagaaatctggaagctgcgtggctagaaccagggtttacgattccgacgaaatccgatcggatttcgcgaaattttgacatttcgacgagactcgaaagtagaaaccatctgagatttcgaggaatttcatccaaatttaaatttgaattgataaaaaaatcttataaatactatgatattcatagaacctattgagatataaattttcgaaaaaaaaatgatgtattgtgtgtatttactaaaagctacatcaggaaagaaaagaataaagaattaaaaaaaagaaacaaattaccgatcggaatttcgatgatttcgatcggaatttcgccaaaaccgaccggttttcgagaacttgtcagcaaactcaaggatttgtattcaaattttattcaaattttggtttataaaatttgttcgaaatttaccggttttccaccggatttcgtgaaattccgaatttcgccggtgcccgaaacggaaggtcatgtcagaatcctaaaccctggctagaactagaggccccttaaaccattgatgcaatacctgtagtgcatattggagcatggaacagtcggaaggggtgtgacttgtgagaggtgaccggggtcgtcgtctccgaaggatcctgcttctctgctctggtaagacccgatgggtcgaatcatggcgcatggaaggacagctctctttaaaacctgattggtactccgtactctggtgtgacctgcttgtgcttggagagatatctttttcctcggcctcctcccctttctgcctctcgcaaggtgattgatgtcttcatgaatgtcagatggtggattcggcacaagcgactccacagatatggattcccttctcgtttaccgggccggtacttcgtgctgtatatcatcagatcctcactgtttacctcttctctccacgtacgttggcttatccttctcttttcactgtaatcacgttttgttccgacgggtcatgcaaagcagttttacacaacaaagcaagacgcttgatttcagaatgcatctcaattctcaagctcccatctactgctcccagaatcgttgcagttgcagagctgccgctaaactcaacttctgaactcatatggttcaaaacagcaacactcactaacagtttggaacttctgacagtatatacagtggttttctattcttctctgtcagtctaacagggcgcagtgcctacttcttcctcgcgtggattcgtgctaaagctagtaagctcttggtcttttcggctaggtaagacaaggcgacattccctgcagcttatacccactaaaagcgattaagcctctattaactaagcacgcaagtgatgatggcctcatgctatcattcgatgggggctcgcccaggacagcatgcggcgcctacccatgaactcctgcccggctcggctcgacagactgcatctcaatccattcaatcagcacaaagctgagaggaatattatcagataggacagagctaattagcgccttttcaacggaaaagctcgggggggcttgttcgcacgaaacagcagcagtaatcatgtaaagagcaccacgccaactctagtattagcactgcgtggctcacacgtgctgaatgtacgagagtctgaattgaattgtgcgccgatgaacctggtgctctgattacaggccgggcaacgaattggaaagggagaaacgatgtaggcaaagctcattgcaagctttatacggtgttcacgagttgatccccacctcaatgcactcgaatcattggcacattgggcctgaacctactcgtcaatggcatgagaagaaaaaaagggtattgcataatagtatctgatctgaaagatgctacaactttgaatcatgaaatggtccagtaccaatgctttacgatcaaaatttgacatttttttagcagaaagtgattaattcatatttgacacgagcattatatcaattaaatgcaatcactcaccatcttttctagataattcaagttggcgaattcagacaaaaatcaacacatacatgaaagacaaataaattgatgcatcgtgcttacaacatcaagtgaagtgccgactaggcaagtaggacccagcacctaccgatcgaccaccaccaatatcaagatgttacttgcccttgctttctcttgataaatcagcagctgcatgagcagccgcgctagcactagtattgctagatgcacatgcactagcctgagcttccagatccaaaatccatgatagcacttgactacttgtagtaagaaaataagaaaagaaaataagaaaaaaaattacagatcaagcatgggaacttggaaagccaagccagaagaggagatttggctcacaggggaacgaagagaagtatactcgtgcttccgtggtgccaccggcggcggcagcagcggaggcggcggccaaacggcctccgcctggcgttggcgcatgcaatcttccgctgcgcatagctgcgatgctgttgctttcgcgtgtggcgatgacgacggcaccgggaccgtgcttttactcctgatgactgtagtaaaaatttctacggcagccatggagtggagctgtgctgtctgtcacttgcttttttgggggacggagatgcagaaattgatggacccgtcatgattatagtattattattgcagtcacttgtgtcctgtgagtcgagccgtcgagcggcacgattgatgtgatggccaatgtacacatgactactcctgctcgcctctctttcggtcttttgttcgtcgggccggagaggagaggagaaaagatacgagatctactcttctgtgtactctagtattcaatccgcgtcaaaataaactaattttaagaatatagagtactatattttagtattaaaaatctagatatatgtatatctaacatatccccaaatttataatagaagtttattttattttgggatggatgaagtactccttaatgacgcgaggcacaagcatcgtgtgaggttttatcgccgtaagagcaagttcaatagtatagccaactactagctccaattcatctatagccaatctaatagcttatttatacaatagttacatactacactattaatacctggtcccatctgacatacacacactgcgtcttggagtccgtgctatagctggctacaaatctgtagcccgctgctcttctctctcctcatttaattccttaaaatgtatttgcagctggcttatagcctggtattgaacctgctctaacaaggaaaagatatgggggcactaatccatttcctcgctggattttcgggaataacccagatccgacaaatggcactctgctcagcagatggatgggtggtgtaagtttttgtgtaatggtatagttatatcgtacgcactgctgcagtgctactgttcatacgatgaaaaaacagctcggtagcacagccacaaatgatgctcttagttgtaggctaacctatacccgtggccggacgaaaccgagcagcaatgcggagtaacgtcgggcaacggcccacaaactactatcgtcgcagaggcatacgagccgaaatattggggaggcgctgtattcacgtaaggaaaaagtacaccaaaggtccccagcttgtcatcgagttccaaaatcgtaaaacctgatacaacacatctccaaacttagaaaaaccagtacaaactatgtccctcgacggttttgactttgattttgtccgacgcggcagccaactcagcgtgggccccacacgtcagcctcttcttcccctccccctctccacctctcttactctctcctctcctcttctctccacaggcagccggcgggggagtggctctgcgtgggcgcggccggccagcggcaaagcagctccttcccccgcccccgcgcccaactgctccttgcccctcgcgcgccgctccttcctcgccgcccagcccagctgctccccgccgcccgccgctcgcatgcatctaaggcgttctacacgccaagaacacccacgtcgcccgctaccgccatgcagctcctctcccggccgcccacgcctagttgctctctgccgagtgccacccatggagaggggaggagagaggaagagaggtggagaggggaggggaagaagaggcgcggcaggggaacacgggggctgggaagggccttttggtggcgacaacgatgcaggagcaggtgtcgttagcgaccacacgagccgctgcatgtgcagactcgccaacggcactccccgtcataactctgcctcggcctccaccttcctcgccgtcgcctgcaccgcttccccaacaaggtcaccatcgacgtcgccctatccctgccgccaccgtcgccgctggacgaggcaagagggtgaggtcggaggagcagcgcatcggccatcggacgatggcggctgcccacggcgaggtccccgtggaggcggtggtggccgattgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctttgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaaatataatattcacaaacaaatgtagaaccaacctcaaatccctcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacaccagtaatatttgtttctaacagtttaacttctgaactattnttgtactagtgttgaanntatgggaagacaaataatggttctccaataaacttggccattctatacaatcannattctcctatttacaagtannctttgaattaaattctacttgtccttttgaactccagnnatttaatttgaaaaatgcccaantataagaactttatggctccgnngttcttatcttagaanaaacttgcaaatgcttttcttcaattctctgctctgttatatccacatttaggcttgtaatagccaagatgtaaaaagacttcatattcatgatatgctcatttaagcttctaatagacaacactggaaaaggatggagagtataagggaagaattggggcattagagatgttaggcatgctacatcttggtttacgccttcatcaatccagctttttttcaacttagattggcattgcttcctaaattcaagtgaaactggacttagtaaataaaatttcctttagtaacacctgcatgtcatgccataaaaaaaatggagggtagataggtataggtgaagcgtgcatttgctcgagtttgtcttgtgtcatcttaaatggacatctgcagaaggcataagaagaaacctggcagatgatggtattgaataatcttcagttccatgcataagaacaatgggaggcagaagagctattgtctgggaacttgactgcttgacaacaatttccggagaataacgtgacaatgactcctctccttccattatgctgaaacagttattcaaaaattttccttaactgctgtttaaacaaaacaaaccactttccaagcatagacatattactacctgaaaaatattgaacgattaagaccacgttcatgaaaatggtcaaccaaactatgcatgttgtatctgctccccaaaaaaaaaatgttgttagtgcttccaaattccaatgtatgcttagtattctatcagaataatccgaaagagaaaagaaaacaattgaatattggaggctggtgcttattcgtaatatggtgataacaatcatcataattcatcttcaggagataacttttgaagtgtctatcaaactccacagcacattgagaaatgatttatttgtttgactaggagaaacaatttactccattagagatttatatgtaatcacattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattggcacacatggaagcaccagcaaatgaagagaatggaacaaagaataacttgggggagaattcatagggtttctatttacatgttagtaacaaatacaactaacccagatgatgtgaaatgatgaagactattaatttatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcaatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaattaggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggcaaagcaaaaattacagaaagtgtccgtgcacgtaataaactctctgcttttttgccagttgccactagtttaccatcaccgtttcgcgagttgccggaattcccctatcgccgtcctcgtcctcggccgcggactccacgccgtccctgtccgtgcgagatctccatcccaatttcatcgccgaacactccccgcctcgtcgtcgtcgcaaccacggcgcctcctcctcctcctcgacgagacgcccgcgggtgcctacgccccgtgcccgcgtgaagcttctggctgacgtacccgccgccatcctcctcggtcccggccttcctgtccctcaaaagtttcgcgaccatctcgatggctgcgccggcgtcgtcggtcatcagcagcctctccgcgacctcggccggcgccacctccacctcccgcagcagcgcctcgatctccgggaagagcgggtggtcgtcgccggcgacgccgtggtaggtggcggcgagctccctgaacgcgccgaagccgaggtagcccatgtgcacgtgcatgtccatccggcctgggcggagcagcgcctggtcgagccggtccacgtgcgtcgtcgtgaagatgaggatccgctcgtggccgctgctggaccagaggccgtccaccatgttgagcagcccagacaaagtcacctgcgacgtcgcgcggtacatggcaacacaaaaaaaaaaaacgcacagctttgtaagcgacacggtagcatctgatcagttttgctaacctaagtttgagattgaattgatggttgggatttctctttttggatgtctcttaatctgatcttcctttgcaatggtgctgagactgtgaaaacgattgagcttatcaccaaatttgtttgttttcaagacgtgactgatgcgtgtgtgttcatttttagtgcggggtcatggccgatggtgtacgtatgattgtattcttgttgtacctcacaaaatggcaaagttgacaacgcacgcgagacaaaccaaacaaaaattatgcgctctcttaaagttgtgaaacagtaaaacaactagtagtagtaagatattatgagaacgagtataaaatttgtgtgctttttagaaaggaagatttgtaatctacaagtgcatgtgcatgtgtacgcactagattttagaaaagctttagttattacatctttaatataagttttaaccatgattgttttcccgaacaaagattttaccctgctagcctgtcctgatttagaatcaggaatttacgcttcgaatctcacaagaacaagtaatttagcctgtcgtttggctagttcaaagtttaagccttttgtttcgcttaccatgcacaatttacagttacagagctaatgaggtgtattaattagtactactaagcactactaatactgaccttacgattcacggaaggcgggttgcttccgtcaggacctccatgcggttccctccgcggcgccgcgacgacggcgcagtcgacatcctcgatcaacaatatggacctgttcttcatccggatcagcagcttccgcagctcggtgttggagcggacgccgccgagctcgaggtcgtagacgtcgaagcggaggtggttggagatcgcggcgaccaggctggacttgccggtgccgggggggccgtggatgaggtaccccctcttccacgccctccccgtccgctcgtagtactccttcctgcccaggaacctgtccaggtcgtccaccaccgcctcccgcagcgcggcgtccatggccagcgtcgcgaacgtcgaggcgttgcggagcctcacgggccgccacttgccccactcgttgctgtacagcttcgcctgcctctgcccctgggacatggccgcgacgcgggccatgacggccgggaggtacgcgccgagcaccatgtccttgtgccgcccgtcgaagctcagcttgaacacctcccgcgcgtcgtccccgccccgccgcctgccgccgccgccgccgccgtggctgctcaggcgccacgtcagctccgccccgtcgaacacgtccacgaccgccgtgccggggcgcatggcgagcgtgatctgctccgcgccggcgccgcgcggcaggctcgccttcatcagcggcacgggcgccgcggcgaggagggtggagacgtacgccttggccgcgaggaagacgcggttgtagaaggcgccgtcgaactcctcgatgaccacgcagtggcggcgggacgagggtggcggcaggaggagcagcgcgcccagggccgtgtccgggaggacgtcggcgacgatccggcgcagcagcatggcagcgcccacgacggaggaggccgccgtgatggcgttcttgtaccgttccagagcttcgctgttcggagacgccatggctgtcctcgctgcagctgcagtgggaggctctgattaaggttttcgatctaatcaagtgtttgagtggtttcagtaacagagattagcattcagcaggtgaggagagcttttggagtggttgccgaaagggaataccttattataaacattgtaaaggtcggtttaattggttggtgtttgatcactctgtcatgtaattaaccaccgtatactaatgtttgttgtgtaggttgtgattaatgtttgcttaggaaggagattagtgggtgctgactagctaacagttcggtctaccgtgtaaagcacttcagtcagtcaacaggtgccctctgagtttgccaaggaaaacactcggaaatttcgaacgtacatttcaaaaactgcgatttaattggttgtgcggcttggggtctttctttaacgtttggtaatcactctgagatagccttttgtccacatagtacattgatttatatgtgaaatttcaaataaatgtatcttataccccctctaaattacttgtgttggcagttttcatactgtaactaacactccatgttacactttacacccataaaaactatccatatcggtcaaattatggcttgtttagttttcaaaaaaatttttctaaaaacatcgaattaaatctttggacacatgtatagagcattaaatatagataaatagaaaaactaattgcacagtttgtatggaaatagtgagacaaatcttttgagcctaattaatccatgattagccataagtgctacagtaactcacatgtgctaatgatggattaattaggcttaataaattcatctcgctgtttccagacaagttatgaaattagtttttttattcatatccgaaaacccttttcgatatccggaattaggtttaataaattcatctcgctgtttccagacaagttatgaaattagtttttttattcatgtccaaaaaccctttttgatatccggtcaaacgtcgaatgtgacacctaaaattttctttccgcgaactaaacatggcttatattaccccctcctagactagcaaaagttgatccagctagtggcttgaccaccacatcacttttcattgcacataggtattgccagtcagtccaatcaacaacaaagacgcaccacaaatccacgatcgttctcgcctcgtttctctgtttttgtctctacctccagtgtcggcaatgttgagccgtcctgaccggtggcacaataatcttctgaccagtagagcccacccactagaaccctaacacatggaggcaaatggagcagagctgtatcgtagaaccctaacacatggaggcctagtttcaaactttttcttcaaacttttaacttttctattatattaaaacttttctacacacaaactttcaacattttcatcacattattctaattttaatcaaaattttaattttaatgtgaactaaaccacccctgagctcaaggaggggagtggcctagcatagcgggttacagactgacaggcatggtggcagtagaatgagaagatctctatagtgcacgttgaaaatgacacaaaagctgacagcagccagcaggcaaagttgatgtccatcacaacgcacatttttaagtgagccacgtttttccgtgctcaattttaataaatttaaaaatataagtcacgcataaagtaatattcatattttattgtctcataacaacaaaaatactaattactccattcgtctcattttaagtgcagtgatgattttttatgccaaaatttaatcgtctgtcttatttaaaaattttaatcgtcccgttttaaggagcattttgtgaatgtatagtccaagaatgatttgacgcggttagtaaaaccacattggcgtttttatgacttctgtatgaaattgatggcattaaagtaattgaatgaaaataagtggcaggtgtacgaacaattgaatcaaaataagtggcaggtgtacaaatataggtgaacattgtctggcaaactgcaagaagaatcactagagacatggtggtggaacaagtgaagacttggacacatcatcgcacttttcaaggcttaaatcccactatctacctccgtgctaatacaagtacagtctaggttttatctaacttttaaccttccgtcatatttaaaaaaattataaaaaaattaaaataaaataatcacacataaaatactattcatgttttatcatctaataacataaaaatagtaatcatatttttttaaataacatagatagtcaaacggaaaaactcacaactacacttatattgggacggaggtagtaatacttaccattatactcataaaaaaaatacatttacacttttaatggaattttggtggaaccagcacaccaaaatttaaatttagacttaacacggtacttgaatttacggttatttactctttcgatggtagatggtgtacatgtttacagcgaggcgtctgtggtgaataggggtcttcttaataggggtaagatgtgagtgtgtgcgtgttgtgaactcttgtgtttgtactgtattcttaaaaaaaggggcttgtttggttgtcactttgaactcaacacaaagctttatgtggaggtgagagaacttatataaacaaagagtgttgatttctatacaagagctagctccttatatacttcaagataaatacattaaatgtaccggtgaaaaaaatatgagaaaaaaatagagacaattttatagctcatctattatacatatcagctctaatacaaaattataactaatagctggctctactattatatttggttattgatcatagcctgaggatagattacattaaatgtcaccagtggctcccggctagtataggcagcttcacaggtttgccagtgaaaactccatttaattttaatattgatttgtgaattgttatgaaatttgtacagtaaatattagttacattgaagtttatctgggctcaaaaaaaatttttggttccgccacttagggctaatttgttggagcttctagttgctgcagcttctctcagaatcaaatgctcttctaagcataccagcttttggttaaattatttatagaatccagaaaataaactagaagttagaagttagaagctgaaaaacttaatttttctagattcccagctatttctcaaaacataaactttccaaacaggctcttaggccatgtttctttcagtttgggattattataatctagattattgagtcagattactataagctagattgttataatctgtagtagaataagcggttagtttgtttctttcctagattattgggtttgcaagtctaaagagggagtgggtggcatggtgggtaatttttcatccaataatctggaaaaagctcacctaaatgagcttatcaaattataaaaagctggcttcggattataaaaaactacttcaataaattgtctgtttctttcaatttactcttaataatctggattatataatcccaaactgaaagaaatagggtcttagagcaggtacaataagttaattaggttggctccaaaatttctcacaccaccttaatcctatattaagggggaagaattgaagcgagagaaacgagcgagcgcttaatctagcgtcgggcggtagcgcagcctcccacgccgtatagcctgcatgcagcccgtgaaggcgattaaaaacgcgttatatgggccccacaaggaacccgcctgatcccatcctccagctctcatcgcatctcatccaactgcccaaatcggcgtcgacgctcacgttcctcttcctcttccgcacctacgcgcgaaatcacctccagccttgggcgtgaaatcgccggcgatacttggtgttcctctccctcttccacccctacgtgcaaaatcccctccgtctgtgcatgcgaaatcgccggcgacgcctcctgttcttcctccacttccgctcatctgctcctggctcatccgctgatctgactggtggtcgcattggtgctcatatgtgaggttgctgctgctattatgtaatgtggattctcaagttgattagtatcgatcaactttcgtatacatacaacatacatagacatatttgctgaatattcttgcttggattgacttgcctgttggactaatccggcaagataagtgaatacaacaactaattacaaaggaacaaactgaatgatgtatctgttttgtttcaggaacatatgtgctcttttgtccactgaataatgatgcacttctttcacaaataaagtttttagtttcacaaataccttactgaaatcatgttgtgtgtatttgtggtgtaccaccaagacatcttatagctaacttatagctagcttgttgtatgagttggcttttaagttagctctacttaatatgacaaaattttggagctagctgccagctgcactattgaccttgctcttagtgcattgatggtaggtcatcagtcatcacgtattcacgtgggtaaacgtacttcgaagtaccgggaaccgggttatacaggagaacaaatatatctcttcaagtactccagttacttgctaagggcattcccaacccaagacactagccatagtttccataaactccacatcattaagaaactagtactagacactactcttccaatgcaaacactactattacatacttcaatttaatgatacttatctctcatgacgttttggatgttgtgtataaaccatgtctcatgcaagatatggtttccctctctttcctcatttattcacttgccacatcattttttatcctaagtggcagcttatttaatgctatggacaccatcatagtcattggattagaaatgccctaatagctcgtttcttgttttgctcgggggattaacacattaatcatgtttggattagatgcgattgctttcgtcgcctggagctcaggcgaccgtgggtccgctccatggcaccagcccaggcgagcagaagagcgcgtatcatgcaggtttggtggttgcttcaggtggtgtttggatcagggaattaactttagttcctatattttgatactaatttagtgtattaaatatagactacttacaaaactaattacataaataaaagctaattcgcgagacaagtttttcaagcttaattaatccataattagataatgtttaatgtagcatcacataggctaatcattaattaattaggctcaatagattcatctcgcgaattagtctaagattatgcatgggttttttattaatagtctacatttaatatttataattagtgtccaaacatccgatatgatagaaacttaaaagttttagtcccatctaaacagggtctcagattggtctccggccaggtgaatccatctttggaagccaacaaattactccatatgtccctaaatatctctaaatatatgataccgttgatttttttaatatatttgatcgttcgttttattaaaaaattttaaataattattaattttttcctatcatttgattcattgttaaatatacttatagttttacatatttcataaaagttttttaataagacgaatgattaaaaaaattaacagttatatagatttacatatttcacaaagtttttaacaagatgaacgatagaaaaatatcagcggtttagggacagagggactaccaaacagccccaaaaaatgctttgttgcacttgcaggctgcagcaggataggcgcggaggcgccatcgtcgtcaccagccgcggcgcacgaccacgaccgcgaccgcggtgggcggcgtaaccgcgctagctccgccgtgccgcctcacctcgccctccctcccaccccgccgtacgtcccgagcgcccacctccaacgcagctcctcctacctccgcttcgccgtacgcatttttaatgtcatcaccagcattaatttttcaccgcttaaataaattttcgagctcagacggcgccaccggccggctgcgtcgtcgccatagcccatgctctcgcatacctcgagatccgccgcggttgctttcgctctccctgatctgatcatcccccactcgaattctccccctccttttttttctcagccgcggaaaagaaaaaacagataaaaagaaagaaaaggggaatcttggagcccgcggcccgttttgcagcctcacccctcaactgtgcgtcgttaatcgcggggccctcccctccccgtcgctgctgtggttgctgtcgtgccgtgtgggcgtcacaacgaataatcaatggcctctcctgcatcaccaagaagagaagaggaaggaaaaaaaaaatcagagagagggagaggagtaaaaaaaaagaagaagaagaaaaggagaagggagacaggggagtcagtcttctccctctgcctccgtgcctgcgcctttgcttcggagtccgccaagtttagattcgaggaggagaagggaagagaagagaagagaagagctctcccctccctctgcggcgtgtcggagcaggcgattggctccgttccaacagtccaagacgaggattattttacaaaggttaggtcttgccgccgccccgctgccgcttgtctgtctctctcccttctcaagtgtgcctcatttgttgactttgctaatccccaaatctgatttggctcccccgcattgcgcgcggcggcaacctcttcctggtgcgcttgccacatcagcctggccatgaacaaagttttcgctttttttttatgcgggagagatggggatgattatgcttgaggggggatcttgagcgtgtgtataggatcgagggttttgaacctgatttctgaaagcgcctggtttgtgaggctcaagagtctctgctttttgccggtttgagcttttaacgaaagaggcgatgggctctgttctgctgaattagccacctcgaggatggggaggttgaaggattgaagctctcttttcctttcgcagaagtaatcgcctgtgttctggcctctctgtggatatgtttcagagcttacctgtagcgtcgagtttgtctgcaacgaaaattgctggtgaatgtttcagatgttatgtattccatccatttgagattctcaaaattggttttggctctgtttaggatgtttaatgcctcaagttcctagttggtccacctatttgattaactccacacatagaagagcagaagttggtacatccttgctgtgcattgttgaaactatttgcccgttctgtagtgatctgaaagatgtcacattctgcgtgcgatcccttctgtaatgaggtcagtggtcgttttgggaaagcaagcatttcagcaacagagtgggatatttgatatctacaggccttagtaatgctcattttacagacttttcagcacaataggttgtgtctgtttccttgcattgttaaagttagaaggttccctatatatatgaaaaaaatgcaatgcggaagaaaggaacagagtaacatatttgaatcgtaaacagtgagctgggtcaaataatttatagctatcaagaaattgtcttgtttgtctttcgggctttaaaacaatgtgtgaactcctcgttttggaagaaaaactctgacatgaaattactatactgttttctatgtacaccgttttccattgaaccgttgagtttgtttgttgtttacagaagctgccttttataatgcgattgttaaatgacttgatgtatagctttatattttctgtgtatctatttgtatttggatatgtgaacatggttggatatgaacttaggctctttcttgattgacttagggtgtaggatcctgattttgttcttgaggtatgtcctcaaccagttcttcacagccaccagcatcgtcagatagagaatctacaccagccagtgataatgcaacatctcctgattcagatggtaagcagcatatcattttcttatatgatctctcattctctctacatgactgcactacatacattattattccctttcttatcttccaatttatccttcatggattttgcaggcacgaattctgctggacccgcaagaagcagaattgcactgcagttggatcagcggtcattgcatttttctgttactgcttgggtaaatggattaagcacaacaactagaactttcagcaattattgcattgcacataattttctattctctgaaatcaattcaatgctgaagatcacgctcttgtctcaaaatcccattggtgtctatataagaatacttttttctagggcaccctcattggcctaaaaaaggtcagttttagaattcttcacaagtgagttaatgttcagaattcattagatatattatcacataatagactgatgagcatatattatatcagaataccagatgagattggtgtagccatttatttatttccctccttaatgattatttgctctttagttccataggaacaatatttagtatactttttaagtgctcgccagtacaaaatttcaactttagtttggggattaatttgtatgccttgttttagcttccatgtattaatcatgagcacaaatttacacagcttttagttaacatgtttaaattactttagctgattgtcagattatctttatcacacacacaacacatttgtttcctctgttttttataggttcttattgttgcattgattggaatccttccactgacaccacgacaactgcaatataagggatatcgtttgtcacttctcggcacaacctgcaccacaggctatgctttgtttgctttttatcgggttagtaacatgtcatctgttttattcttcccttcttagataccttgcacaacttttaccatttttccttttgttcagctaccaagagcaggaaacatgcatgctgctcagatctttcaccatgtagcttcgtcaaaggattttataccattcatgtactgtcttatgtttgtcatgtctaaactgcacttgaagcgtaagcatggcttgtttactgacataatgtattcttcatatttccacctaaacacctttcctagtacttgacacgataatattttttgacagttgttttggtaccagtgatttgctgggcacttgaacatgtggccagatttctacggcgccattttactaattcctctctatacaggtaaatgaactcaacagattataagcacaaaatcgatgaagagtatgtttgtcttgccttctatgcatatgctgttgtgctatcattcacatatttaggataaggcagttgaggcattatcttcccattcttggtttatgctgctatattgactaaacattttgattacatggcttttactacttcatctctctgggtgtgcaatacctgtaaaaccatcacaatgcaatgaagaaaacaatatggctgtacatgccctagtccatcagttgtaaatcaatatgtgcaggaaactgtcataaatgttgaatagtataggaagaagggaagatatactacgaatattggacattctatattgagcctcggagggctaggtatatataggagtacatagtgaggagataaggaatgattacagataaggaaggaaccatacaaaccaatcctatcctaatatgactctaactaccatataaacaaaaaaacataaatactttatgtgcaggaaatctgcatggcaataagttgataaaaaacaaaacaaccctgcaatactttgcctgccgaacatactggtaaatgtgttataacatttgaacgcattgtgaatttgtaggacatatctggagaaaccttgcacatgggttgagacaaacacaactgcagtcaaattcctgagttcaaatgcggagattttgttgggatttcttttgattttgtctctgttctcgtcagtagagtcctacccttcagttttaattcccccattcccattaaccattcatcttaatctcttattactttttacttctgttgtgtaggcgacaacgcaatcctatgcaaacgttcatgtactggcaggttagttttttacataaacactgattaatttctccaaatgacatatttctctttttttttgttgactacaatgctgcaacaagacttatctttcaggtttttctatgatatcatttgtcatcacaattaggaatttggagtgttctttttatatctagtataatatacttttatttttcttgcgtggatatcatcttatccactataaacaagtgcttgtttagttgtacatcaaacagaataagtaccaaatgacgcttaattttgcactgcacatgctggctaaaatgctggtgacgagctcgtccaaatgcggatagctatatttcaataatctcaggatgccagccaagggaaaaggtgctcccatggctgaacaaaattaccaattaagtgtatgcaatatttgcatttaaaagataatttgggcaattttagttacttctgctctcagttgtaaaccgcaaaccgcgcccctgcatttaaatgaatgcttgtcgggttgtagagaaaatttattatttattaatgttatagtcacagaaaatttctagcaaatcactatctcactctgtttacccgctattgcagttactgaagctcatgtatcactctcctttcactgccggttatcacagagctatctggcttaaaattggccgtacagttaatccctatatccatcgctacactccttttcttcatgacccgataaatgctggcatgagatggtggttcaggtagcatggatatggctcaattaatcatgtaaaggtgtttttggttacagttcacagttaacacatggaggatcttttcagtaagttgtagtttgcgagcgacatgtttagtaccttttctttttgcgatgttgcgctgatattacttttagttactgacaagtaattcttgtaactttaccttgactgtagaactagtgtagaccttagtaatatggccaataccatgaagtgaaaaatggaaaagcaatttattactatgatgcaactggattctgctcctgatttgtatcagaccacttcatgtaccatcccaaaatataagttttgggtaggatatgggcattaagaaggttacacacgaaattaaatggaaaaatgtatgtggataaattgtttatatcttaagataacttttaaatgctataagttattaaattctgggacgaagagatcagttggtttcaggccctgggccatgtagatgcatttggttgcaaggatggaatgggatgggatgggacgaacccacttttgaggttgtttggttgaggggtgagtgggatgagatggtccctggagaggaatattcctctcagatccgggaccaaccgatccggcaaattctggcggacgaactcgtcctagttgggacgagcgaacggcatgacccgctcaagcttgaggccagcccgcgcgctcgccctactcgccctcaggagcagcggtaaacaccggcgggctcggcgacggcgacggcgaccgcggctgcgggggctcggctcggcgaccgcgggggctcgacgacggcgaccgcggggggctcggctcggcgacggcgaccgcggggggctggacgacggcgaccggcgggggcttagcgatggcggccgacgggctcggcgacgacgaccgcggccacgggggctcggctcggcgaccgcggggggctcgacgacggcgaccgtggaggctcggcgacggcgaccgcgaggggcttgactcggcgacggcgaccgtggccgtggggtggctcggctcggtgaccgcgggggactggacgatggcgaccggcgggggcttagcgacggcgaccgcggggggctcagcgacggcgacggcggatctagtggtggggagggcggtggaggtggatccgcgtcctttgcctgctcgccgccggcctgctcctccaaccgcacccctgctcgcccgtccgtgctcctcctctgttcgtccgcctgctcgcaatattgcgccgctcctcctcgccgccagccatcgtcgcacctccgctcgctctcctctttctcgctgacggtgatagcaaacggcgcccatcccatctctagctcatcccttcaaccaaacaaaaaattaggattgtcccatcctacaaaccaaacacgtaaatggaatcatcccaaccccaaaatcagaaatggtttcatcccatcccacctagtcccgaaaccaaacacacgctaagatgactagtgcatattccaggggcaatttttgcaacagtacatgaaaatgcagtgccgcaatatttcaagaattgttgccaacactctattcgaagcaggactattaaaaaaaatcagtaaatcagtactattacaaagaaaattgaaatgcgataatatttatttcatgaaactcccaggctccaatgagagttcatgcgaaccatccctaggccctgagattaagtgtgaggtggagcacggatccggcctcgatattgtactcgtgggccgccttgtcgtcggtgaccagcacccctttgtagatgagctgccctatttgcctgtcctcctcctcgatgcgcgccctgatcatggccccggtgtccgtcggctcgatgcccaggccaaacacctttgccgctgagaggcttcaccttgatgttcatgctgcctggaaggaggcggagatagaggctcagcgtcgagccgtcctggatgttgtagccagccaccgtgcagccgttctccagcaacttgtggtcgaagaagagcagctgctggtccggcgggatcgggatgccctccttctcctggaccttctccttgacagatcgtgtcgctgctctccacctcgagcgtgatgagcttccccatctgggtctccacgacgatctgcatcttcgtgtctcgacggacgtcgatcgacgacggattcggctgctggtttgtggaagatttacgacgtacgacaaaaccgcggggctttgcttcgatgctgtgggcgtattggctttgcgtcgagacttgaatcgatcgatgtaggactggtgttgtgttatgcggctccggtcctgtggtttttattggtggtagaggcaagctttcgccgttcgggttggtttccagttccgatacggccgcgacgcccagcgttcgcgttgggctccatctccggttcggcggattatccaactcgggcctgtatctggactctgaagatacaaaagacgtactgttgccggttgggatttttccttgagatcatgtagtagttctcggaatgggactcgtcatcgtgtacgtttctacgactacgatgccggagtacacggctttgtcgggtacgattatacgatgtgccgaaaagatgcagcccgatctaactcaggactagtgtgattcttgtattgtaagcgacgaagtgcatcccagtcgggtacggtacgattttgatgtcgaaagggcgtaaaagttctgtcattgcggatacgagaaaaacactgagtccactctcacacggtaggagtacatgcattatttgaagctggccggcgtgccaggatgagacgaaaaaaaatttggtggagaccgggtataattctgtaaatcggctcccgtgcagccccgaccccgatgattgccgcatggacaatctcagaatcggacgtctagttcgttgcggcttcaggcccagcgcaaatatggcataggagcctcgctcgactcggctcccgggcccgtcgggtcgtgggctcatatccctctcgtatcggcctcattcgtccgcagcagccgccgccgccaccgtcggccagcggcgtctctctcatctactgtctctcgtccaccatcgctccctctctcggacatcgtccactcggcggtgatgacgagggcaaccggctcacaatcgccgacacccactgcggcaactccatgcatggttggtctttcggcaagaaatttaattaccggtaaggagattgaggttgagggtgatgacgcggaggttgtacacatcggtcttgtcactcattttcttgaactgcacattacgccatcagaaaatgttagtggcactatcagtattaggtatatagatgccgaaattttgataatttaactcttttagaaaatttatttgaaaagtaaaccgtgtcaaaaacttatttcaaaaataaaccgtgacctcagcgtcattgacgctgaggttaacgattaaacgccaacgatcatgacgctaagcacaccttggcggggcactatggagggttggatgggatcagccatgggttttggcgctgaccccttatgtagtgataaagtgggtttgtgttaattcttgtcactttctatgatgtgccttggtggtttaacttcctatgatcccaggttcgacccctcattgctcatttttttgcttgctttaatcacacgaaaagaaacaaaaaaaaagcaggacgtagggatcgaaccctagtcttctgcctgacagtggacacattcaccgttgtgctatacttcggttcataacagtattagccatgttttgcatgtaacatatatatggggtcagcgccaaaatgcatggcgctgacccctatcgcacctgccaatggctccgcgtttttgatctcagtgccaatcccaatgatgacgaggtcacggttcatttttaaaataagtttttggcatggtttactcttcaaataagttttctaaaagggttagattgtcaaaatttcggatatagatgcagattctcaattcatatagatgaagcccaagaaatgtagcgtgaatttggagcaaatttgttcagagacagaaaggtagtagataatgttagtaaagcactgttgttaaacaaaagtcgatctccccagaaaaaaaacaaaagtcgatctgccatttactatggccggaaaaccgtatgatatacatgttaatttgttcaactgaacttgacactcttttactgaaatatatgcactgaccaagtgaccatgaagaaatgaaatgcttaaatctccaaaatcttcagtatgtatcaaatctaaatggtaaaggaccaaaatgaatattagtactttatcaaatctaattagaatctgcaaacgttcagactacatacattgaaatgtagcaattaacaactatattaaagtttgaatgcagaagcccagatcaaactaactaatcaaatcaatcctgcaccatggtaagaaagaagcccgtgagctcgatcaagagatagcagctactgcccacgggaagatggagtacatctctgcgctagccgccggcaaacagggcgaactcgtcgttaacgttgcggtcgacgagagggatgggttgtgggggcgcggccactcgctatcgccgccccgccatgcagacgacggatgagataggctgcgtcggcggcagtggctgctgctgagaagagatgtcgatgatgcgatgtgagccggtgaggcggtgagccgatgggcccggagccatcgagcgagtcggctcctccgtcctgtttgcgctgcgcctggagccatacatagtgagacgttcgattctacggttgtccacgcggcaatcatcggggtcggggctgcacgggaaccggtttacacccggtctccaccaattttttttctggatgagactatcctgcttctctttgtccaatagggctcatcattctgtacgttcatacgactacggtgccggagaacacggctggtcaggtatgactactatgcaatggttcgaactgatttagatattattataaaaaatgatctttcatttatagaaacgcatagatcaatagtagctacagaccagcaaaatgtatgaatggtgcatacggttgatgatgaacgtaggcaaattaaatgtgacaaaggttatgattggttgagaatagaaagtaggtagagaaattaaatagtgtaagtttgtaattactcttattggttttattattcttaatgttttggataaggttgaaatcaaattttttataactttgcctttcagtaacttttaaaatattagtttaaaggcactagaacaacatatatagatttatcttataaagtaataaaaataaaaatatatttatttattgtacatattataatagaaaaatatagtcaaagatatattttgaagactgtcattgtataaaacatcaagaattatgaaagtagaggcagtagttgagaagagaatatgggtgataaaattgatatattttacaataacttttaaataacagaagttatattttaggatggagagaataactgactttaggttatgggtcaagtaccaacaatttccggttctataagtcaatatcaagcccaatcagatgctatatatactagtgcatattcaaagccaagtttcacaacattatagaaaaatgcattgctgcagtatatcaacaattgttgtcaatactccctcctaagcagggctattaaaaaccggcaaaataatatacttaaatgagcaatgttaaaaaaaaatcgaattgcaacaatatcatatcatgaaacccgcgggctctaacgagtcatctctagcccctgagagcaaggacgatcgtggaggagcacggatccggcctcgatatcgtactcgtgcactgtcttatcgtcggcaagttgcttcccgccgtagacgagcctgccctccctctcatcgatgcgctccttgatcctgcccatagtgtccgtcggctcgatgtccacgtcaatctccttgccagtgagcatcttaaccttgatgtcgttcatgccgcggcggaggcggagcacgaggtgcagcgtcgactccttctggatgttgtagtcggccagcgtgcggccgtcctccagctgcttgccggcgaagatgagccgctgctggtgcggcgggacgccctccctgtcgtggatcctcgccttgacgttctcgaccgagtcgcagctgtcgaccacgagcgtgatggtcctcccgttcagggtcttcacgaatatctgcatctttcttcgttgacggtcgtctcagctggtgatcgatgcctgcggcgatttgctgtgcgacggccggaaaactgggacaagagaagaccgcgcggcgacggcgaggtagtttgcttcgtttgcttctctcgtggacgttggtttgcgtggtgaagccttggggatcgataagcattgcagttgcagctctcatcgtgccgttttatcgtgcgatcggcgggcttgggtcgcgttcgaatcggcttcattttccgataccagcaggggcagaacatcgttgtccgatacgtattgcccggagtaaaccgtaccggaaggtccggaaccagcccgcacaaacaacacaggctggctcggacgcaccaagggccaaggcaggcagctaccatggccaacgaagtttggtgctgacgccactgctctctctccggccggagtcccggttgaggttggctagcatgattggggccgaccgccggatcgaattttttttacaaaaaacatgttaacactcacaatgcgtgtacattcatttctattaatacatacacatatactctacctctataagcaccttcgaaagattagaccaatatattttaagatagacaaagtcaccatggacacctcactgtcgacgaacatgtcgcctaccactaaaagaataaatagttgtaaatatgagcacacatatcaaatctaaaatttaaactcgggtaggtatcaattgagctacatcagaatgaaaatgaattttgtcaatgtaataaaacaaggaaaaaagttattagatttgaccgtctgacccagttttttaagaaaatgtaatttattttggcctttgcttatagaaacaaactacaaacaatttactacagaatttgcaattaagtcgacaatggttaatcacagcttaattgaaaataaaaaaaaaatccgaacatcagcctaaaaggagtgacatatctattactaaactttcatcgacgaaaatctatgtaaccattattttttactaggtttagaatttttacgttggttttatgggcaaaatagatccgatccttataatagtactctcaccttccataaaaattagacctattactccctccgtctcactcattactctcaccttccataaaaattagacctattactccctccgtcccactcattaagacgtggtcaaacttggcataatctttaagaataatctttgactttaaatttctcatagactataatatttgtagcaaaaaaaaaatcataatatatgaaactaaatttaagtgataatacaatgataatattttcatcaaataaaatttaatttataataaactattaattgatcaaatatttaaagagtttaatcttaaaatgtgtgtgtgcattaatgagtggaacggagggaatactttttatcaccaaaactaggagaaattaattcattttgcatataacaaagatcaacaagtatacgtacgcatgcaactaataaatattaagatgattaattaggttctcattaaacatttaatttacctatccaccatttaagtcttggatgtatagacactgtaaataacaataacttatttgaaaaaacagtaaaatatgaaataggtctttcttgtggttggagagagtacgttctacatatgttgatttatttgtctggtcactcggtagtagttattttcaccctcgatgacacgcaacttgacgttcgtatatgctttgcaaatttgtatgcatctttcacaagcacaaggatgaactcatcagttaaccgacattgtcactcatatgcttcttgaaaagaggaatcgatcgaaagggtagtcctcgctgcttgcgctgtggctggacctagacgagctccgcattgaggcgcggctttccactgttccagccaagatgacgcgggtagcctcatggtggtccacgtaggatttttttttaagctaaaggagagagaggagaagccggtgactaattagggcaagtgctatgatagatgtgactaccacatttaaatttatctatattattcactcactaactatgagacaaaccatacaatatatcacctctaatacacaaataccaatatttctaatactctcacattcttcttgaagtttgtgtggaggttgcctcttggtttaagggtgtctcatcatctctctcatcacttctctcctctacctcatcactcaatccaatgtggcacttttagggggcaacacatggagcattagagcaaggctaataatatagccagctgcttactgaatagatctttacaggctacctctcagccaactcatatagtggttagctcttaactattaatatatggtccacctgtatcgactctcacatattttcttagttcatgtgcctaagtcggctataagcctaccacccgctttccctctctctctctcctctcctctcttatccatctcagcatgtattcaaccttcttatagccttctattatacttgctcttatagtacttgcccttagccgtccggctgcacgctcggcccgaggtcgcggggaccaccaggagcgatgggttcgccatctgcgtccggtacgctgttgactgtgtccaccaccgttgccatcgctctccattgccgtcgtcgtctcgcgcttcaccgggtcgccgccctcgtccgtcgtcattgccagcgccgccaccatcagcagccttgtccgtcaccgcagccgttgcactccactgagtcgccgtccttgttcgtcgttgcggctgccagcggcctcgtccgtcaccaccatggccgccgttacactccactgagtcgccgtcctcgtccatcgtcgtcgccgcagctggcctagtccaccatgcccgccatcgcactccactgggtcgccaccctcgtctgtcaccaccgccgccaccgtccttgtccaccatgatcgtcatcttcgtcgtgcttcactgggtcaccgccctcgtccgccatagccgccgccacctacatccgccatggccgccgcccttttagacccttgccgagttgccgtcgccctcttctgccgccgttgcggccctcgtccaccccggccgcctatgtccacctcggccctcatccacggcggccgcccaccacaggcgccacgccgcgttctttcgccgcagctcgttcaccgtaggcgctgccgccgtcattgtccactgcatccaatccccatcggaagagaagaggtgagaggaaggagagaggaagagacatggaaagatggtgggtcctataaagataaaatatttgtattacagtatttcctattgtcatacattagctacaacatttattatagatgacatgattattttttaagccaacaatgggttgtattattgaccttgctctaaaggagtaagtggctccgtttactgtgactcataaatagattcgtgaattagccattatattttcagtggcagatccttctcaatcgacgctgaagtgctatgcccatgaacagtgatgcatgatgacaagggacgaagcgattggaaacagacaaccatgatctgtacatatgttgtggaggtcgggaggtaagagcaccatggaccatggtatgcctatagaaggtaagagtatatcggtgtagggatgacgaaaagagggtcaactttattttttttaaataggtaatttataaataatataattgagatttgagactgatcagtatttattaattttgaatcggcaaaaaaaaaaacgtctcaactaaaattattactccacaaaagaaacttcataaaatctctgtagatcgataatgcaaagaaacttcttaccaaaaaaaatactattagcttatattgttccaaaaataacctaaagccctagctagagtctagagtaactcgatgcctccatctactagttggagcgcgctcagaagttcccgcctcggagagcgaggacgaggtggaggacggagccagcctcgatcttgtagtcgtgcgccgtcttgtcgtcggcaagctgcttcccgccgtagatgagcctctgctgcacgggcgggatgccctccctctcctcgacgcgctccttgatcctgtccaccgtgtccgtcatctcgatgtcgatgtcgatctccttgccggtgagcgtcctcaccttgacgttcaggccgccgcggaggcggagcaccaggtgcagcgtcgactccttctggatgttgtagtcggccagcgtgcgcccgtcctccagctgcttgccggcgaagatgagccgctgctggtccggcgggatcccctccttgtcctgcaccttcgccttgacgttctggatcgtgtcgctgctctccacctccagcgtgatggtcttccccgtcagggtcttcacgaagatctgcatctcgacggattcggcttgcttgtggaaggtttacgacggctgccggaagctggagaagcacgtaaaccgcggggctttgcttcgatgtcgtgggcgttgggcttgtgtcgagacttggatcgatcgatgtgtgtggctatgcggctctccgggcgtgtggttttattggtggtagaggtagcggcctactagtgttcggggtcggcttcccgctccgatccggccgcgatgccaaaatacagttcgtctcggcttccagctccaggccggccccgacgcccagtatgtctagtatacggacgtaaaaaaactcaatcctaggtttgaatctggacatagtgtatgtccagattcaaacccaggattgggtttttttgggacggagggtgactaccgtacagtgtgatctacagactactgctgtgcatacgtattcaaaataggacttgcatcgtataggccggatacgtggcttatcgggtacgactacgatgcccagtagacgtaaccgattgcaatggtccagatgaacagatacagcacggagctagttctgatgagaccatcagctcatagcgattcccatcattgatttctatagcaatatttttagctaacgatgaaaaccaatggcaaaaaggaatgacaacgtaatacaagtggctcgtgcagcctttttatgcaatagagaaaacaatgaatggttgaacatgctccagtccatcaaatgtaaaacgtaaaacagaaaatgttactattattttattattacctgagttcatgaaaacgcatgtctccttagatccctaactattaggagtatatagcaattgctcagtacgtactgcgagcctgagcgcagcccaagaactctggacgggctcagatcctgagttttggacaacactatttcctaccaagtctccaacaagtcaagtttatattgaagttgactctggaccttgcaactcgtcagatcaccccgtcatgacagcacatttcagcaaggctaaagcaatcaaacgtagagctagccacttctacttctgttttccgcatctctgttctctcctcgcattcacttcagcagcccagctcttgccaatctctgtctggaacttgcctgcagtaacaagatttacagatatgtttaacaacagaggacatgtttacaaatttttaaatagcctgcaacaatgacattaccagcggtagagaggaagaactcatctaacactttgccatgctctgtagaataagatgggaagagttagtgttacaaacggattataatccacaatgtacatcagatatgtactacttgagtaggatgacaacataggcaggcagctggaattatattgtacagtgccctgaacaaacaaaagaagaagatggtggcatgaagaaagcggtttggtatgattgtcaacacagcagcagactattcaaagttcttgctttgtaaaaccaagcatcaatgcacgcatcagaatggtgcgataaaaaacatgatgtatcctgcatattactgtaacagcaaattgtttcagaggaaggacccaatctaccgcctggtagacttcacagtttgttaaaatgagtaagcagctagttgaatgtacacaaatttaaaattacagaaaagtaatacctttctcatattctagtgcttgaagtatcatttccacctgcaaaacaagtaaatacaagaaatggtaaaatcccttgaaccatagtgaataaatagagaatgaaaacaaagaaaaggacaaatgagatgtgccccagagtgaaactgcaaatgaccaatatgtgccacaacacaccaaaatacaatataaatattacaccttaaagagttaagaatacaaaatgaacaatatgttgcatgcagggtttaaaattccggaacaaatttcaggtctataggtgggtcccaatagacagtgagctccggtgaaaaatttcggcaaaacactgttcatggtccaaatccccaatttccaatccccttctcactcacctttctccccccgtcctcccccaacatctcctcccatcctcccagcactagcgagcaacaccggcagcggttgctggaactggaggcagaggggtggctggagtggccagcggtggttccgcggctctccggagtgacgacgatgacacaagcggcaaggcggcgcgggcctcgcatcctcgtgctggagtgccagcaacggctccgcggctccggctcgacggcgacacaagccgtggacctcgcatccttgtgtttggctggagtggccagcagcggctccacggctgtcgggcgcgaccgcgaccgcgacaacgacacaaggcacacaagccagagaggacacgacgacacaatccttgcgtttcattctcctatcctgtccccctgctttggattggatggacttgatgcatgtctatattctgatatatgtcaaatttctgtaatttttgttgttcaaattcaaattttgtttgaaaatttcgttcgaaatttccgaaagatttccgaaatttcgttattttgctgacctccgaaaattttccctttcccgatagattgaaccctggtttgcatgacacccctcttatgtaataaagaatattcttacaagcaaacatgcatgcgttaaagtattggaaattaaaaatattttgcattttgcacaagcccaaaaagttcaatgaactactgaaaccattcatcaaaacaaatgttatattcttgtttattttgtctatgttaatgaagaaaagcaagaattttccagttcatatgaactaaatataaaatatttatctatgagtgagttgtttcaggaacttggacatggtttcataaagcgttactctagcaagcttgaaaattgtagaattgtgctgaatttgtaccaattccaaacaaaaagaaagctagtatattaacgaaaatgataattctggtgtacatttcaaattagactccaggttgagaaaattaaaatcaacattataaaaggcaccaagttaagaactaagaaaaagaaaaggaacaagtagacagttcagaaaataaaaggcacgcttactttatcaaaatcctttacaaggttggcttcaatggatgaattattttcatattcttcccagagctccttgatctcatcagctacaaaaaacagaacactaaaagtagtgaagattgatgtcaaacatcatccttcatgaactcggacgtcacatcccaaatggacacaaacctattggtcctccaccgagaacttcacacatttcatttagagccttttgttcacggcggcttttttccgctttaggtataccgtcggatggagtaatgtcaccaacaatagctgtcaaacaaaaaggataaaaacctgaatataaaaggatgctaagaaaagtgggaacatacagattatacagtcctagaataaggatgataaatattggcagatgaagtgcaataacatattatcaacaagtgcatacaatagaaaattaagctaaaaacagctgatagggtgttctttggcataccttcagcaatgtcatgcacgatagcaattttgatgcatctgttttaggtaaaataaatatgtcatcacaaacaagtaaataactaatgactaatttagaaaggaagcctgaaacatctggtattttgttgtaatcaattaactagatgaacaaagaacagacgaaagggcattttttaatgctatggaaatttgaataagaaaaacacggacctttctcgatctacagcaggtaggtcaccggcaatcaaagccataagggccatacggtacatgtgatcagcaatagactcaggaccctttatgctatggtttatccagcctttccttttagtggtctgtataacagaacagaaacatgcacaactcaatatatcgcagaataataacgagtataatagacctaggcaacacatgcatggagagatgaacaattgaacaggatccagacgcttgttcatatgcttgttgctggtcacacatcccacctacttatgacatcgtaagcaaggtacccatgatgcgagacttcatggaatcatggtaatcaattcacaatacaaaatggcgattatgaaacccctcatagctgttccacattccccaagctgttactctagaaattaagggggtatcaccagcccggttgtacacacgcggtcagcgaaggacaggcatatgccttcggagcgacgtatccagaggcgatcggatcacgaggaacatcccgttggcgtaccttaaggcgatggcagagggtgaggaaatcgatggccgaggaggcagacgacgccgcggcggagggcggcgccgcggcggccgcgtcggccggcgcaggcgtcgtccgcctagggacgggcgatccgccgggtccagggatcccggaggcggcgcggacgccgggcgcgaggcggcgccgcgccgggcgctccacggggagcgaggccgggaggatgccccgcggcgcgcggcgctggaggccgccccctggaggggccggcagccgcgtggtcacgcccatcggaggtagggctcgaggtgcgctgtggatcggagcttgtggtggtggcggaggcggaaggctacggatcaatgggatgggatcgccggaggaataggcagcggcggcgggtctcctctcctctcctttgcctctgctcggggtaggtaggatcacgaccgcacgagacgaaggcgtccgatcggacggccaggggtgcatccgctcgaacatgccgtaacgcctcgtgatcatccggccgtccattccgtccattttaatcgttcgccgttcattacgcaggagcagcacatggtgctagtgctatagggacaagccaattttgcttgcgcgtcatcttgattcgtgctctaaacagcatctggaatcgagtactcggaattatacatcctgattttgttcttttattaacattctgcaaagatgtcgattacactgcaatagtacagtgggtctacttcatgaccatatatgatgagattgtaaacttcgtcggcagctctgtcacaataatctcttctaagctcgatcttatcataggccaagcattaggattcgcagcgatcatacgacgatgaagctgaggtgctggaccgttaaggcatttacatcaatcacacagctcctcaaattagccatagcgaatgcgattagattacactgagatatagcgataacaaattatcagtgacgccatcagatcaagttcgtcaggggcctcggtgccgaccgaagcacgagaagcatccctgtggctggtcggtcgggatcatgccaccgcccttggacgtgtcgatcgcctccagcatggacaccacctccgccatcgccggccgcttgtccgggttcgcgtcccagcagcgcttcatcacgttggccaaggagctagggcagcagcgcggtatctcaggcctcaagttctgtagtacatcatcaatcaaggatggtgattttcttttcagtgcttcagagttcaggaatcagagaggtgaagtggggaaaacgggataggacggcgtttttttttatttacctgacgaacaacagctgaagtgacctctgagaaactcagatcaggatacggcatatcgcagcagtatatctcccataggcagattccaaagctatatacatcacacttcctgttgtaaggatggccgttgagaacctgcacaatgatgccaacgtatgacagtaaggacaataacagtagactagaattacggaagaatggtacgtgcaattttggaagatcgcagaaacacaacatgacaatgaataagatgattgaggggatgcagggttaagattttccattcgccaagcaataagttttttgaacgataccagcaaggaaattttcagtgacatatagtcacttttcccttcttaattcgatagtttggtataagtaaagacctatcagcataaatgatacatgatcagcataagatttccgtatggttgaaggaaaatacctcgggtgccatgtaaccaagtgtgcctgtttcacccgtcatatcactaggatttgaagcctcaattcgtgcaacaccaaaatcagcgattttcactgttcttgatttgtcaaggagcatattttcagtcttcacatcacgatgaactatcttctttgagtgaagatagcttaatctgtcagtgcaaatcccacaacaaaatcttctgagattaaaacggaataatagatgtaaatccagaaaaaggaccaagagaaacatatattattacttaccccctagcaaggtcaagagccaattggaccacaactttataggctagcttccttctcctgttctttatcagaaaatttttcagtgcacctccggcaaggtactcgacaacaacgcagcaaatattacttggcatgccaaaatgtccatgttctgtctgtatatttaaatctcttgcacccattatagccccaataaactgtcagttaaatttcaagatattgtcaggacccagttgagaagcagaagacaactacgttcaccaagtgaatgaaaaaaataatgataattgttgatagctcaaaatgaactgtgtagatggcagatactaatatttattgcttggtaaattcggcaccatgttctaaaatcaattccattgtaattatgccataccaaataggagtacgcaccttcaaataggagtacgcaccttcgctactattatcagaaaaaaaatattgtccaattatacaagattctaatgctctttagcagtgcatggctaaacaccttaataactattttatacagaagaggaaaacatggaatccaattttagacacgatactgggtgtattatatagctagcaccagagtttgaacatgactgccagtcctcctactgtcatatctgatatctctagccatgaaaatattattgcaccacaaccaatggtttccttaatagattataatgccagagatacatcatgataaaacaagtttgcccatgtggttgtgccggacaatattgaatacaaattggttttgtaaaccagggctaataaatgtaaatttcccaaatgttctgtaaaccagagataatgtaaattggtctatatatttatcagtgaaacgatttaacctatgaaatttgaagggatgaaaaaaaaaagtcttctccagtcaaagattaccttggtaacatttggatgatcaagcttatgccagacagcgacctcttgtgcaaatgctgctcttagtgaagaaatttctcgttctgatctatggccatcctccccccagtcaagcattttgactggatgatagagaagatatatcagttacttcgacaatgaaactacaagtagaaataaaaagtcttttttgcatttagcaattgattcgaagacaaagttatattgaagtagtaatgctgcatattactacatcaatacacattctttttttaatgtaaatcaatagcacattcttgatgagggtaacaaaatcttggtgaactgtgcatgtctctgttttcctaaaagtgtatttagcaattagctgttaattgccaagtttgaatctatctgggggaatataatgtgacaagtgatgaattattcatgcaaaagcagtgaggaagctggttttgtcatacaaactaaagtggtagagaaaggcaagccaataaaaaactccagtgagttagcaaatactttgaaaaataaaaaaaagaacatgctggaggaacactgccatttaaaggaagctgatggggacttgaaccctgactaaaaccaccgctaccttgtgctaccaggttacatgagcatcaccaagtgatttaggattctaatgacctcttatgaatctaactgatactttccatttcaagacattgtactcaatttcctggtgaaccaatatattgaaaggacggcatgcaataggtgataaagttctggacagaaaaaaccactgcatctgcttttgccttctgtcatgtgattatagctggtgatacagtgcaaaattgctaatccggaccttttatcaacccgaatttggttcagatgcttttgaattttcctggtccctgaaaagtactgtgcctagttgcaacttgcaactttttgatctgaaatatccgctgctttaatatgtaatcttcaacttccaggtgctcatcataagacaaaacacatgaatcatgcctattaaaacttttaactgttggttggttcaatcacatgagaagggttgcacgccaaaagcacgcttatctacccagaagtcacggaatacaccatggaatcaagaaaagcagaggtatcacctttagcaatttgctgacaaggaaaagcactaatgacacgacgagcgaaaacaacttccaaaagcacccgaaacaaccgcacctatggtaaatgacgtttgccatctatcaatcgatcggctctactccataatccatatcctaatccaggaagaagaacataccgatgaaaataattaaatcacgcatcaaactttcctaaaaacttggagaggaatcgatcggaaccagaagctaacgcaggcagaagaagccactaacgagtactagtaagcaacaggccatttcatcgaatagctcatggtcatggacagcaaaaaaaacttggtcagcgccgagtggacgaatatatctgcaaagcaatcagctgtttatagcagaggggcgaaagaaaaaaaaataccagcgacgtcctggccgtcgtagacgccgcggtggacggtgccgaacgtgccgcgggcgatgacgcctctgatgacgagcttggcggggtcgatctcccagtcctcccggcgccgctgatggtgcggcgcctgcggcggctcctccccgagcccgagcctggcggactcgccgcggcggctcccgctgcccccgtgctgcgacgcggcccgctccgcggggcggccgaggtggcgctccagctgctcgtcgaggctcttgaggtcgatctggtccgcccggacgaacccggcgtccccgctcccgccgcccgcgccgggatgcctcatcgcgctcaaacctgtcgtcggagctagcgatcgatcgagcgagctgggggggttgggttcggtggcccggggtgggtggaacgtctctgtactctggtggcgttgtggatgccgcggcgtggtggtggtggtggtcgcggtggctacaggggaaggggacgggttggcgaggcggggacggaggcggttcgaggtcgtcgtgtttggggagacgacgacgactccatgtgagagcgcattggggtgtggggggaaggcgaagtactaggcgcactaggagtaggccagtgatgatgacaacttgacaagtggtgaccgaaggagactcgtgtcgcgggggtggggcccgactggagggggggtcgtcagggagtcggaaagtcagagctcaggaggtttcgtttgtgtcattgggcccatttggcatctttttcggccgggccattggcccattagcatctgatttcgcataccgtgtgaactgtgaagtagtatcacgtgtgagttgtgatggcgtgagtctcgcgcctgcgcgcaaaacggtgcggccgttttttccgaatgttttgctcccttcaaatcttttccagtctacatagaatatataggagtattttgttgaactagtagcgggtgcactactacgtagtactatacctgtacaagtgtaatgtttgcaaattgcaatattattatcgttacgtagctgttttagtactgttaaaacctgtagaaaaattgcctcccacgaaaatctacagagaactgaaatgacagtagaaaaattggaaaaaaaagaggaattgtttttattaaaacaatcgcttgaaagtggtcctagaaccgtagttttattctaaaacgttccaaagagagaaacgtcaggctttctagtcggaataagttcacttcattacccatttgatcgaaatctaaaccataactctaaactacaaaaccagatatctcgatcttcaaactcctaaaaccggtgtaattggactccctgagcggttttgggggacggttttgctgacgtggcgccatgtggcgcctacgtggcaatattgaccgagtctttgttacacgtggtgttgatgtggcacctacgtggcggtagaaataaaaagtatgcgtgggacccattagtcattcacacaaaaagaaatgtgggcccaccttcttcctcctccctctctcccttctctctctttctttccccttcttccccttcggctggtggcgcgcggggacagcgagagcgagcggcgtcggcatcgggcggcggcggcggcggtgcgggagaggagctggacgaggaggcagtaggcgcggagggagtggggggtcgacgacgacggcgacgaggaggcggcccagtagaagaaggtgagcgcgttcctggcgacgagctccggggaggagaagtggcagtgcttggcgaggagaggaggacggcgtcgacatgatcggcagcggggaaggcggcggagagcgcctccactgtcgctctcggatggtgcgcgaggtagtgggagatgcgccgaggcgtcgtggcggcggtgacgacgatagcgcacggcggaggaactcgccggccgtcggcacgcaggggaggaactcgccggccgtccgcgcgtggggaggggctcgccggccgtccgcgagcgggggaggggctggagctcgccggtggtagggagcagcggcgaaggggaagaaggggagagaaagagagaaaagggagagagggaggaggaagaaggtctgacatgtgggccccacatgtcagtgggcccatatttctttttgtgtgaatgactaatgggtcccacgcatactttttatttctactgccacgtaggtgccaagtcaatgccacgtgttacaaagactcgatcaatattgcacgtaggcgccacgtagcgccacgtcaggaaaaccgcctctcaaaaccgctcagggagtcaaattgcaccggttttaggagtttgggggtcgagatatctggttttgtagtttagggtcatggtttagatttcgatcacatttgagggtcatgaagtgaacttattccctttctagtcctgtaacaactttctacgtaaaattagagcccacgaaggcgacaattctggcccgttacagcgcctgaagaacagaaggcctagacagcagtcttgggccgcatcgagccatacaagcccaggaaataaagcagcccagttcaattctatcctgttactactaatttaatcgcgagaaaaatccccagcgggagagctcacgaactgttcccttcccatggcggcgctgcctctcctccggtggggcgcttcctccctccgaggaggccactcctccgctccgccttcgagccgcctcttctccgcgctccgccgacctcccgccgccgcccgctgcgagcccggctcgagggtcatgctcaaggggatggactaccctgagctcgaggtaagagtactcctctcggcgtacgagttccgtggatccgtttgcgagttgttggtcggaggtttccgttaagcttatctggcgcgctcttccgcagaattgggtgcggtcgcagggcttccggccagggcaggccatgatgctgtggaaatgcctctacgggaacaacgtatgggcgcattgctatgacgagctggctggtaggtttcagtgtttagttgttatgccacggactatattcgctataattttgcagtctacaggttaattcctctattagtaaccttgagagcacatatatactacaaatctacaatggtgtctatcctgaaggaaatgaatgccaaattgtcaactgccaaggagataaaatctactcataggatttctgaagttttgatgtgtcagcaaagttgtttatacatgaaaactgctaaattagaagtaggttagtggttctattcgaaagtaaaaaaacatgctactccttttagtctgcatgtacttgttgcattatgttcagatgtgcattttctgcaaccttactaccttcgttacagatcagttcagcatatatactttatctcttgctacattatgtaagcagcaaaatctaaaaattcgtcataattcataacagtagtatttttaggggcggattgaaaaccagcggcatttgatctaacttaacaatggtattagcgtttcagaaagtcatgctccattagtgttattttctgaatccccacataaatgtagattgattttgctatcaaatatcaagtagaatttattttcgacaagcaaaaccagtaactttaccaaagctttacaagttttaagattagctgtgatggatttatattgcaccattttgtctttcttgtttttgtgtaagggtgtattccagtgatccagccaattggaacctacaagtggatttagcaattatcttgtgtttctttttccctttgtaattttggttgaatgaatctgatcgtttgcatctaatttcatccaggtttaaacaaggacttcaggaaaatgctaacagatcatgctgatcttaaggcattaactgtgaaagacattcttaacgcgtcagatgggacccgaaaggtagtttcttctgtgttacttatatcttctgtactatcttcagatcattgattatggaacacagaatgctacagatactgttctctcttgaagatggatcagtgattgaaacagttgtcattccttgcactagtggcaggacaactgtctgtgtttcaagtcaagtgggttgtgccatgaattgtcagttttgcttcactggaaggttcgtttacttcttttgaataacacttaacttttcaatgattgtgttggtgataattttacagcgttgcttatattttcatgctatatctgtaggatgggcttgagaaagcatttgtctacagctgagattgttgagcaggctgtgtttgctcgtagactgttttcagatgaatttggatccatcacaaatgttgtatttatggtaagcatcctcctcatggtaactaatggctctagcttttatggtcgttgactgagcagctgactgtatagttaattaacataattcactttgtagtttacatcttgaatctgtatatatctatctttaacatgccaatatttttgaactgtcgaacatatccttaatgtgatatcttgtgccacaactgtcaagataatcatatagatatgtttttatgcactctgttttcttacaacatccccctgcttctgtctgtatttcatctcaatggtatcaatattaactgttgttaaaattcaattttgttaacttgttacattgttttggagaactgtgttagtttaactattagtcttatcatgaactcatgggtgtttaggtttgtaatattcactggcatataacagttaattgattgtctgccttgcatttattcatatgatgcttgcagatacttctacaacctttcattaatatcaaacttttacagggcatgggtgagccgttgcacaacattgacaatgtactaaaagcctcagctattatggttgatgagcagggccttcagtttagtcctcgcaaggtcactgtctccacaagcggtcttgtcccacagataaaacgcttcctacaggaatccaattgtgcgctggctgtgagtcttaatgcaacaactgatgaggtgaaatccagttttggttgttgtgttgcaaaagtggtttggcattgttctgttgtttctataagtctatactatctttttcttaggtgagaaactggataatgcctattaatagaaaatacaatctcagcttgcttcttggcacattaagggaggaaattcgtttgaaaaagaagtacaaagtgttttttgaatacgtcatgcttgctggagtgaacgacaggtgaggaacctttggattatacaaaaatttccctgattgttgttggcttgtggcaattatgttatgaagttgtcttgaatattatttcttaatacttgcgtaaaactgtttttttttcttatttggaggtattttacatataggccagaataatttagactataattgctactcttattgtaatcatctgttcatagggaattacttgtatgtcttggaaataaccttttttgtccttgcaataaaataagttaccccttggcccttgtatgattgtatcattaatatttctgtggattactatgcttacagtgtggatgacgcgaagagactagtagatttagttcgcgggatcccttgcaagatcaacctcatctctttcaatccccatagcgggtcacaattcaagcccactcctgatgagaaaattattgagtttcgtaacattttaattcaagatggccttgttgtatttgttcggctcagcagaggggatgatcagatggctgcctgtggacagctaggagagcctggggactaccagctacccctgctccgtgtacctgagaaattccaggtcgctttgtgactctaaacagtaagtacggtactacaatcctcatagatattgtagaatagctttgacaaaagacatgtaactttcatgcggttcttagaggtcattctctgggccaacctgacgactgacggaatatttttgttactttctttaaggaaaatttttgttgttactacaacaagacagtgtcttcagctggcttatggcatgtaaaagaacatttaggcatagtgccgctaatctgctaagtaccaaaatccagtattttccatggatgtgtgacgcttcatctctccctatccgaattgccattggattttagcaatatatgtctgcattaatgcttccactgtgcaatacaaggagataaacctaaatcatgcaactttcaagttcatggcatttaggcactttgcatagttcctgattcggcctaagtcgtcaaagttaattctttggttagtgcaggtatgacaggcatctccaaaaggttttacaagattgtgccttgcttgagataccttaaccattaaggtgtgcatgccattgccacgacctgaccaccatacggaaggaaaggaaaagccaatctagcgcaaaccccacctgtaaaagtcacttctttccaaaagcaactctattatgctgcacatattgggcgtctttagcactaatctgctgccgaactggcagtctacacgtctactcgttgctttagcagaggcatagattttgacagttgctgattttgtatatggcctagtttagttaccaattttttcttcaaacttctaatttttccatcacattaaaacttttctacatacatataaactttcaatttttcatcacatcgttccaatttcaaccaaacttttaattttagcgtgaactaaacacaccatgtctgttctcttctgcgagtggctcttctttcaattatattttcggcactggattcttgatatttgacacaagctttaatatacggactacgtgttcatctcctcacctgctcaccagttttagcaggaccgacatctgctggggagccttggcgacaagggttgtgacatttgctgttgtcaagtccactttgaactaattcttttcttccatgttaaataaaagcacaaccttttcatgggccccccttgtgaaacatcctctattaaattctggtttcagctgctcaaggcacctagcaggagtacttgccctccaggaatccctccctgtctaaaaaagaatcattctacatgccatcactaaaacactatctgttattgtttatagcggaggcaattattaaagagtggtcctgttcgatctgctgcatttgttttacagcgattatacatcctcagagatcatttctttggacaaatatggtttacgaggtccatgacgtacatgtcaaggcagcaaaacataaaaactgacagcaactcatgttcactacagggcccacaaaatcatctcaaaccggatggattagcggcctcttgtgcgaactactactgccaatcgcacgtcttcacgatgtctgtctctactagggagtatactggtcttttcctggacagaaataactccctgtccatttcgctcctaatatcatacaatcgttttgacccttaatttgtagccgtcaaagacggctccaattcgcctaccacgacgatgacatggcaattatttacgggtaataattccatcatgctagcaaatccaaacttaaataagagtatagaataagcttgcgttctgtcgccacctagatccgatcatgaatcatgatctgattaacttgcatcacacgcgtatcctaattctatcaagaatcctcgcaaactgaaaaaaaggaaaaaaatctgacaagaaaagaagaagaacaggaagttgtacacgcccaaagatctgtgacgttacagagaaataaccgtgataatctcaaatccaacggcaaaatcttggatgggggaaggaaaagcgaagtgcggtgcaacgtggaaagcaacacgtaacctctccacccccgtgcttaacacgggcgcccatccctcccgtcggatccgcctccctcccgtgtttgcgccatgggcgagaccccgcgtaccccggcgccggataggccgccgcctcccgtgccggtgcgcgttcccgtgccagagccccagcccgagcccgagacgccgcaggcgtcgccgtcgccgcctcccgcgcccgatccgccgacgccgctgttgtttccggagtcggcgccttcgacgccgcgcgaggagtaccacacgccgccgccgtcgctggacgaggcgcgtgacgaggcgctggtgcctcatcaggagggcgtcgtcgacgtcaacgggggatcggaggccgccgccaagagcccgcagctctcgccggtgcggctccaggtgtcgccctcgccccaccggttgctcccgcctgcgccgggctctcccgccgtcaacggtgaagatggcgccgccgggacggcgcaaggccgccgtccgggacgcccgcaacttcacctcgcgacgggccgcctcttccggacgccgtcgcaggggtccctcgccatgtcgtcgccctcgccgtcgcctacgccgccgtcaccgctgactccagcgcccgccaccaccgcgcccgcacccacgcccacggccaaaagcaagagcgggcagaacacgccgaagcacaaggaggcgttgaagccgccggccacgcccgtcgcgacggcgatcgcgataccgttcaacccggccgaggaggccatgacgtcgcctctgcggatcggcaacggcaaggccgcgcggctcgaccaccagcacgggcccgtggcaggggcggcggagaacggaggggacgtgccgccagaggtggcggccgtggccgccgtcggggagaggaggacgacgtcggtggcgctgcgagtggccacggcggtgctcagcctggtgtccttcgcgctcatggtcagcgcgcggacgtccggctgggccggcgaccactacggccgctacgagcagtacaggttagcgaccacttttgcctagatgctcgttttttttttctcttttgtttgtcacgttttagtcggatttgtccgggttttgacggttacgggagttggtacttgtaggagtagttagtatctgacttcttgggagttggatttatttttctgtcttgcaattatgggggttaattgaaattatagtcgttcttactaaattgattgttcgagaattttcgttactgttccccattggtttttgtcattttgctgtatacaaacgtggatactggttctgggaagctatattctgtactcttgttcaatagtacagagtagtatttcacgtgctctgcttgaaattcagattttatcgtggttgatccgttgatgttacgtatgttgtgcaccgatttttgaaaaaaaaatattgttgtacaaatagaacttgcgagtgaagattaagaaaatttaaacacctcgtgaatgcagagatacttgttttgattcaggtcgcttagaggtagaacacaatttcagttttaggttaagacaataatcaaacggttttctctgaatttctaaactagctcaactctacactaaacagaggaacatagcttcatcttttggtggtttaataactttctcttctccccattgaacaacactaaaacttgcaggtacgccgtcggagtgaacatcgtcgtctgcatctactcgatcgcgcaagcgttcggcgagattcgccgcctggtttcgccgaggtttcttttccggagcacctcgagctactacttcagcctcttcctggatcaggcaaagccccagcctctcatccttcacctgaaatgcgccattccaaagcagggaaagcagaggtgtttccggtgtctgaccatctgatcttcctggtctcgctgcaggtgttggcgtatctcctcatgtcggcctcgtcggcggcagcgtcccgcaacgatctgtggatgtcgagcttcggcaaggatccgttcaacaagaagatcaacagcgcggtgtggttttccttcatcgcgttcatcggactcgccaccaactctctcatctccacggccaatctcttcagcatgatatgatacgtacggccatctctcaagctgatttggggatgtggagtacttagtttccatcgtgtaaatttttgtggcacatatacacatatgttctctgtctagggtcatgatcaggaattcatttgcacacacacgactaataaaatataggataaaatatgttacactgtttcatgattaaaatatgttacactgtttcatgattaaagaagcttgatgtgtctcaaagtcctttctttgcatagcattgctagggattactgttgcaaatcaatcgctgttgagatgctacaaattaattatctgtaaagatgtggtgattatatgtaacatctaggatagcacagtatctgagagactgtagctgctggaattggatactattccccgtccggcaacaggaacaaaagcgacggtgacactactatctgacaccactatagtgtgctgttctctgttgatttcgtccaacctacgacttctttaatggatgcatgcataattcataattgcatatcgtttaagattctggccagtcttctccaaaacttacagagaatcttgcgctgaaccaagaacgtacatttctctgaccgaacacaagacgcggtctctactcgtggagctcgatttggttcactctgctcagccagatggagtgcaggatcatgtggaagaggtcgtaccggaggggcctcgcgtgccacaggaaatgcctctgcagccgcttgacgcagccgtgcatggccacgtacttccggagcgtgatcccctgcagtatcttcttcaggtccggtacgtccttctcggcgacgaccaccgcgaaggcgctccagtccagcacgtcgctcagcggcagcacgaagttgtcggcgatgatcaccggaacgcactcgtagtagagcgcctccacgatccgggggctgttcacctcgtaccccatggggcagaggcagaagcggctgttcttcatgtgctggatgtagctcatccgccgggacacccgcgccgggagcggcccgtacacccgcatgtcgtcgtcgcggccgtcgccccagtgcttgaggagcaccggcctcaccctgccgtgcacgttgccggcgaagaaggcgaggatgccccgccgcgacaccggcagcccgccgacgtaccggagcggccgcctcggcgtccggatcgtcgtctccgggagtgacacgtccctgcccggggtgaagatcccctccgagctgtccgcgttgcacagcgccttgacggtgttccggcgcaggtcgccatgcgccgtcgtcgtgtaagatccctgcagccattgccaggaaccaaaaccaaacacgatcaaaactgcaacacaaaaagagagtgaaaaaaaaaacatcaagatgttggtttacccaatcatggcaggcgacgaggaaatggtcggcgcctctggtgcgattccagaacgggtacttggcggcgaggcctttgacgaagtcgcggaggtaggcggccagcggcctgaggttgtgggagtcgggaacgtagagcgagatcctgagctgctgggagctgtagggaaggtagaagaggtgcgccttggcggggtcggtgacggcgaacctccggctctccttgaggagcttcatgaaccagccctcggacgcgtagatgccgctgaggggaggcgtgtggaagatgggcctccggccgtcctggtaaatgtaaactttgagtatccgttccatcagttcatagctcctggatgatcacattttcgctacaattatgacaagcttagtcaccatactgaattatcagtggtacaaaaatctgtacaaaatgcagaaatattatggtttgataattatcagtggtcaacataatgtacgatgccgttgactttttcaattaacgtttgatcattcgtcttatttaaaaatttataaaaaaaatatgtaaaaatataagttaagattataatttctccgatgataaaaagagtcacaacaaaataaataatagttatataaattttttaaataagataaatgatcaaatgttatgtaaaaaattaacaactttgtatattttaggatagaggaagtaatatacgcagcaaggaacgcaaatcgggagacactaacaatcatgtatggagatgttcacaattccggattttctttttgttcaaaaacaatttcgaattgtgattttggggtgggtaatgttttcctacgacgcaaaaataaccccccaaatttattcgaatttcatgaaaaatatttaaatttcaaaatgtttcattcaaattacaatggttatgtaaattctcgctaaccatagcttgaggtttagcaatagtagtcattcgtcccacaaccttatgtaaaaattatctatagtttctttgaagaaaaggctggaatgaatttcattactaaaaaaatgatcaaaatttctaaagttcaatggaaatttctaaatatttgttcccctgaaagtttcccgttccgaaatagtgagcctcttgggtacaaaccacggcccattgacttgtctgatctgacatcacaatttcgtttaaaaatataagacactagatatatttatgatacattaattttcactaaaatgtagtcaaatcagtattatactgtaatatatctatattttcattttaattacactataaatttaaaaacttacaatataattacactgtaagttttaattattaatctatatgttttccaatacacactatataagagaatttaagatataaaaaaattattacctccttgaaagagcataagggatagaatgttagttgttacacacatatataagatgtatagccatcaacatagtaaaaaacgatcgaaatctagtaaaaaaaaatacacgcttctacatgtccggaaatccagagaaatagaaaaaaaaccggcaactcgatcatcctgtttatcaaaacatgctagaatgagacgaactttaatttggtagctggtgcgtgaaacgaggaacggaagaagaagcgacgcatgcaccaataatattatacctcttgaactgggagacgttcttgaagagaggcgcgtataggtcggggtcgtcgatcaccggcccggcggccattatctccttcttggcgtaccgcagtgcctcctccggcgccatcctccaatacgacggctgatcaccagttcgacgcaggaattaacaaactcgatcgatcactatgctaacacgaataaataataattagatttggatcggcctctgctcgatcgatcgcgtacctctcttcgtcgcggccttgcagcaggtggcggtggcgcgggaggaggaggaggcggcgtcgccggtgctggaggaggcgacgagggcggtggcggcggggagatcgcggcggacagtttcccggtgaagtctgtggcgggcacgtggggtgaggatgggagggagaagttgaggagcacggtggtggccgcggccgccgcgacgagggaggcgatggccccgatgcgccagcaggagacggagaacatcgcgccgcggcggtggtggagccggcggcgggacgggccggcggggtggtgcgcggtggcggtggcgaggcgctgtggcggcattgggtggaggaggaagcgggaggcatgaatgggtggaagagcgcgcgcacgcgcgggctggcgagcgtaggcttgcgcgtggccgagtttgtagagaaacccgaggcgcctacggaccaggtgctcgattttttctgagaaaaataagatgcccacgatatcaaatgtgatcatacatgcatgcatacatgcaaaacttcctagacaaactttaaaactatttttcctcttaaattatttattcaaatcatggtcggatgacaccattaaatccgttccaattaaatctttaaaacagtaccatacatggatataatccgataaaaaaatatttagcttattattgaattatttttaaatgttgcatgttaaatcaagtaaatcagaattgtttcgctaagtagatcgcaaatgtttcattttttttaaaaaaaaactgaaacaaaaccaaatcacctcatgaaacattttactaaaatatatgaaacaacggtttctcaaaaaatggggttgtttcaccctgcgtaaaaacaatattttagcaaatagcgaaatgatatttcaattcactgcaacatttgatccatatatagtgaaacattacgagtacactaagtgaaacatttttaatggaacagaaaatgaaacggattcccttaatagggggtttccataatacgtgggtgatttgttgcaaaagaatattccaattcattgtaacatttgatccatatatagtgaaacattttttgtgcataaaaaaatgaaacgaattcctttaatagagggtttccataatatgtaggtgatttgttacaacggtgtgcgtggtggggacacgtggcgggggcggcgcgtgcgcggggccgcggaggagtgcaggcgctcgatgcatccacgccagcatcgggggcccaatttgaggcattttccagagaaaccaccgcgatgcgcggctgccactgtatttttctcttcgacactcgatctcttcagatgggccgtgtgtgggctgtggcacggggtgggaggattctgggcttctagcccgatttggtctgagagatcgagactaactggaatcatagaatatgattatataactttttttacacctggagaatcaaaatgacaaaatctaacagtgaatagttcgtgcacaatccaagcagatttttttatcccctccgtttcatattataagtcgctttgattttttttagtaaaacttttgtaagtttgaccaagtttataaaaaaatatagtaacatttttaacacaaaataaatagattattaaaatatatttaatgaaatatttaataaaactaatctggtgttgtagatcttgttaattttttttcataaacttagtcaaatataaaaatgtttggctagaaagaaagtcataatgacttataatatgaagtagggggagtagtatcttttttctcggtgtatgtcaaatttggttatgcatgtttgtttagtgttcagctttttttttaaaaaaaaaaacatggacaattatccctaccctcggtagcttacaagtttatgcccatccctggtctagtacaatttctttaattttatcccttgatctcaatcaccatgctatgattttattttcatcaatttcttggagttgaattgtaaaagagtagaatattataataatggtgtcttttctcctcttaaaagtgttcttttccttcttttggatatatagacctatctgtattccctcaaatgaagcattaaactatcgtttggtacaccctcattcagctaggcaaacacatatgcgaataattttcaatgttattgaacactagaaatacaagtcgtcttagtggtgcgatctgtcggtgagcccgggttgcctagggtcatcgggccttggatccgccccctgcatatataccttatattgacactctcttaaaacacaaccattgccatctctatatgtgtctaacaagaaccttgaaatgtctaccttgcttgagatatcttaaccattaatgtccgaatgcttgtcatttgtaaccacttgaacacctagagagagaaaagtggcccagggctaatgtgagaaaatttagtcacaacaagataactatcttgttgagaaaggccagatgacatagcttgaaggagattagggttctagaaaagaggaatagacatagactagggcacagatcattggaaggggaatcgatcgattattcttgcttcattaacgaagatatatatagtaccaaaccttttaaaggggtgcctcgatttgtccctaagataagtactaatttctattaggcaaaatttgttacaggacacccaaaaaaagtgtaattagctgtgggacaatgcaaagacgtgaatttgcccgaggacacttcaaaaatgtggtaatttgctgcagaacactaaacgcattaaaatataatatccagtcaatggatgagagagaaagcacataaaatggtaattttgcccttatcttcttcttcctctcgtccttgcccaacatagagtagagcctcctcagcttgtcgtgtggggcgcgcatgggcacatgcaccagcggccgattgcctggaacccctccacgcaggcctacgactgggtcggcttcacctgcgacgccaccaacgccaccatccttggtctccgcccacctagcgtcagcctcatcggatgctacgcctctaggtgctctcccttcgatgcaaccacctcttcggtgatgtcccatgtgacctcttctccctccctggctccgtcccgcccgacgtcgccaagctcacgggtgctccaacaccttgctcgcacgcttctcgccggagtccttcgccgacaacctccagctctacgataagcagttgagccagccatgcgtgcgagtcgttcttcccgtccccactaccctctcctgctggcgcgccgacggatagcggtcgttccatgctagtggcctataaaaagaagtggaaatgtccggcacggcgatccacaacagcggtgaggagtccgtggcggcgggcgtggcctgcgaccgcactcacaacaggggacgcacgcgagaggatagtcagaagaagaacgagagaagggagaagaagataagggcaaaactgtcattttacgtggtttctctcttatcaattgactagatattatattttaatgtgtccagtgtcctgcagcaaattaccattttttagagtgtcctcgagcaaattcgcgtctttacggtgtcccacggttaattacacattttttaggtgtcctgtaataaattttgcctttctattactacagaaagtaatcaatctaattttatcaatgaggaaactaatctgaccaaattgcattgttggtgccttgttattaataaataatgagagaacaatcaatttggttcctcaacatcgcttagggtgaccttgatctctaacatgtctttaggtgaatgtggtcgttgaactcaccttacacgccatgctaataacaaaataactcaagaaaaggttaatgttgatctcaatctcaatgttaagaatagattatttttcatccttttgtgtcttcattcaagataaataaagcctactactttttccatttcaaattattgtcattctaggttttgagtccaacatttttaattttttagcattaatttctaaaaatccgtgtactttaataacataataacatgtgaattagatattatggtttgccaacaaagcttcgaagagttgttttctacatatgacatatcggatgggctcaagggcagatccatgagtactttgtacgggttcatctttttcctcctccagcccccctaccttcttcctcttcctagcccccctaccttcttcctcttcctcttctgatttttctgaacttttctatttttatctttaaacatgaaccctttcaaaaacttatttctaagatctgatctttttgaccacgtcagtcggactagcgtggtaaaacaacaccatcaggctagtctgattagcgtgaaaatgttatttgtttacgtcgatttggctggtgtggcagcgttatttgactatgccaccctcgctgacgtgacatgacaaaactgtcacgcccgttgtgtatggcgtgtcagtattattttattacaccaaacaggctggcgtgatcaaaaggttcagattctacaaataagtttttaaatggtttatttttaaaatttaaaaataaaaaaatgatcttctcttcttccccctcccctgtctcccttctctctatgcggaaccaacaggatggggcggcccccaacacccacctttggatccgcccctcggcaggctcatagactaagggcctgttcagattatagccaaaataaatcttacctaaaatttgggcaagatggcaatattgctaaaattttggcaggatttcttatgtatttaccaaatttagtaacaaactaaatgtagatatttttttagcaattttacttaaaaaattgtatatttgaaaatgacaacaatttgaacacgctctaagataaaagaaacatccggaatcaaagtgacttcaggctggtttggacagagaaacatccggaatcaaagtgacgtcaagaccaaactttcaaggacgaaattgactatgttaccaactataacgaatgtaactttgtccttgcactctaaaaaaggtggcacggcggagccaacggactcctctcgggccgtccacatgatgcacaaaggcaaccagctgtaaaagtatgcatgcaatgcttgtttctgaaggaaaatccattgtactgctacacatatacgggcctgggagtctacacatctccacacaccttgctttagtggggacacagatttggacacatttcagatcatatagatacatgatgatctgatcagcagttttagcagtagtaaaagactttctggtttgctagaaagatgtcgacattttgttaatctcagtcagtttcctgtccgtgtccgcttgctccacacgtataggtatagatctttagttgtttgcctattttggtctgcctgatttttttttccgtggcggcatattataccttttaactttacattaaaaccttctccgggaatatcaagcatagttcatagcagcgcttgctgttttaagatatgtattattttttttacatgtgatttggttgggatgttatttgttactatcatgtggagtttttgcaggcccgttttaaggtgtgaatgtgcttgttttttacaatatatgttcgttagattgtacttacatctacttatattcacttacatatataattttaagaatttacaatataaatatatgccgactattttttataaaaatacgacgacatatatagatagttcctaaaattttgctctgcatggtgatcatgagcgacagatcttgttgcatgtcaagtctactctagatcaattcttttcttccttaacaaataaccgtacaatacataggaagtactaattaagtgcatcctagcttcatttaattctcattcaaggcacccactcttctcacatactcttcttgtcctaaaatatacagtcttaggataggaggactacgaatatggatatatgaatataatcccatcatatcctagattgcagtatattgggacgaaaggagtagtgacttaagaaaagatatattggacataaccttgtacaatatatcaagatatccttattgtaataggttatgtctgatcaactcctagattttatatttcgggacaggaaagtaatataactgaggtgaactattgtcttccctagtgatttgtacatgtcatccaaaatgtaactaaaaagattttttttttaaaaaaacaacaagatagataaatataaaatatatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccctccaaattaaattcctccgcaaaagtctagtttgcctccctgggttcgatgggccgaattccgctcggcccatctctccccggccccctctctcccgggcgccctcgccctccttctccgccccgcccgcgcgccctcgcgcgcgcgcgtgcgcgtgagccgccgcgccgagcgccccctcccttttccctcgctctgtcgcgcctgcagccgtgcagccgctcggccccgcgagccagcgtgtgcgcgccagcgcggacgccgcccgttgcctcccgtgcgcgcgtgccgtggtggccgaccgcctggtcgccgccgtcgtcagcgcctgccgcgcctgtcgctcgtgtcgccgctccgctccataccgcccgccgtcatcgccgtcgtcatcgcccggcccccgccactccgcgcgcaagccgccaagggacggaggccgagccctcctttccccctgccgcgtcgcccccgctccctcctccttttcccgattcggcaaaggggcgagccccctttctctccctccttttccccttttctccatttttcccctctcgccggcgtcacctcctgtcgccgctttggacgctagccggagtgccagctcgccggcttgaccgcccatgtcggttcctctctcccaaaccgacattgccgcccatttaaacccgtcttccccctcccttcctttcctctcccattcgtctcctcgccattgccgccgccccgtgctctgtctcgcctccgccgtccttcgccgagcgccggaagagccggtgcgttcgaggacgcggaaggggacttcggccgcgccctcttcttccttttcctcggcccgaggccggagagatcactcccgcgccgtcggcctctcgtcacagcgcccctcctcacctcggtagtgcctctctccgttcttcctcctcgctccatctcctccccctagctttcggtagtagcttgagtagcctccccgtagttagccggcgccgccccgaccgttgccgtcacttgccgtgtgctcaccgccatcgccacccgagctccatagcacccgctcatcaccagtctcactcagcatagttccacccaatccaacgctagcatcgagttcccaaagccacttatatgctctcaccgccaggaatcaacctctcatgacctcatcaccatttccctcttctcccgccatcggttgccgccgccgcaatccggcgccgtcgagcaacctccggcgaatccaagccgttggctcgcctccccttgtcacgtgcaaccgcccggtgtgctcgctgttgcccgtatcaccgtggttcgctccgccgctcgccgctgtcgtccgccgtccgttccggccggcgtcgtcgtctacctcccgccggcccgcgtggctgccacgtaggcgccacgtcggcgccacctcggccgcgaccggatcagccgacccggccagccgctccctccgttttttccccgtgcgcatggtccgcggtgagccgtgaggctgcgcgtgggcccgccgcatccgttcctccgcgaaccgcgcgcgtgcaccgcgtcccagctccgcccgcgcgcgtacgccgcaaattccctccgcacggtgagccgagccgctgccaagcgggtcccacccgggaccgcgcgtggtgagcccggtccaccggactctctctcctccctcccgcgcgcgcgcttgggccgtcttgggccggccggcccgttaagatcggccggtccgctccatttcccttgggccgcgccctagccgcccgagagaagtctacttctcctccctcttcctttttatttttctcaaaaaggatttaatttaatcctttttcctttagatcaaaaatccaataatcttagaaattcaatatcttcccaaccgtaaatccgtttgactccgttcaacttccaaaattccccaaatctcgagatctatctaatggcacgcttagaggtcattaatagggctttatttttttcgccgtttgttgagttgtcccgtttcgcgtgtagtttcagagcccgaagacccgcagtgcgaggatttcgaggatcaagctccagatctcgagcaaggcaagccacctttgaacatcttgaacctatatttgaaatttaattatgttgcttgaaaaaaaatattatgcattgataggatcgcacttaatctgctgtcccgtctgcaaggcagattggcggacttacccaatttgttgcatttgatccttccattgttaattgctatatctggtccccttgtaaccatctagttgcgtctcgatattcgtgcaccccgtgcgagtatcgacggacgccttcaaacttaaaatctgaataccaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagataagtacgaccacatgggtggaatgggacacccctggctgagtaactagcttatcaggggagccttgatgccgagagacatgtggattcaccggggtggtgtcggggaggacccctgggcttgctggcacagtatggtctgggacctaccctgttgttggtctgggacccctctcgtcggcatatggtaaacctgtatcggctttcgaaatgccttgtcatgaaagcttggaggtctcccgacgtggctgatcccctcgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgactactgattgtgaaattgctgtcgtgaaaatgggttcgacgtctgaaaaatcagcagctgacgggatcagctaggcccgggtggccgtttgaaaagttgttggcccgggtggccgtttaaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttatttcccctggcttgctgagtactcccgtactcacccttgctctagataaataatcccccccagttgctgaagaagatgaagcggatcctgttgatgtggagttcttccaggagcaagccggctacgatgagttttagggtttcggcctagttcccaagtcgcgcctgtgatgattggtccaagtcctggcttccgtttccccttttgtattgcagttgtgatattctgtcttcctgtgataccagcactgtttcctgggactggtatcgattaacaggttaatttggagcgtcacgggctagttccagtcggggctagttcggggcgtgacaatatctttacaaatatacaactttaaatttgacatttacgaggagaaaaaacatatttgaatgcgaatagtgcattattcacaagaaaattgttgtttttatttttagttgtgtatgtcaaattcaaacttgcatatttattatggaagaacacgttttcaaaaagttatatgactatataggagatataattgtctacaaggatgaaaatactctcacctaatataacgaataattcacttgatgggcatgtcatcgcttattaacacacttgtgacattttgtgctctttaatttatggagaatatggtttgtgctcatggttgggatttttcttgaaacaaagccaaaatttattgtattatcggtggagagcatctaaaaaactgccgtaagtttttctagtaaaaaaatttcagatgtaactatagtataattgaagtgtaattacatgtagctgcactataaccagggtttgaaattttagtttgaaatttccgaaatctcgcccgaaatttcggtaatctcgccccccgccggcatgctcaaatctcatccgaaatttttggctttttgcaaatttttgtgaatttggtcaaattttattcaaattcattcaaaatcaatcaaaatttcaaataatttcgttccgaaatttccaaaatttcagtaacccttggcataaagtccaaatttgaaattgtcaaccttgattataactacgttgcaattacggtataacttacataaaacttgtattcaactgcgctttggttaggttaggtagtactgaaatcttatgcgtaacatgtataaaaatttctttccagcaatatttttccttcatgtataaatctcaagatgatccgatggtcataaatccgaaagttttaggggggaaaaaaacttgtggaagtttttttggcaaatccgctgtaaaagttacacgctcgtgatgagtgccgtggagtgctgtatatatagagatcgcgcagagctagctgcttttgccaacaaccaagaagctagctagtgatcgcgaagagatggcgtacaacgacgacgagcagactgctccgacgagcaccgccaccgagccggcgaggccgacggtggggatcacgggccaactggtgaagcaagtgcgtctcaacaagtaccacaacgacgtcgcgtccatggcaccccatgaccaggagctgctgctcgagctcaggggctcctcctcgtccaccgacagggcgggcctggacctcgtcgccgtcatcgacgtcagcggcagcatggacggggacaggatcgacaaggtgaagaccgccctgcagttcgtcatccgcaagctcagcgacctcgaccgcctctgcatcgtcaccttctgcaccaacgccacccgcctctgcccgctgcgcttcgtcacggcggccgcgcaggccgagctcaaggccctcgtcgacggcctcaaggcctacggcgacaccaacatgaagggcggcctcgagaccggcatgagcgttgtcgacggccgcagtctggccgccggccgcgccgtcagcgtcatgctcatgtccgacggctaccagaaccacggcggcgacgccagggacgtccatctcaagaacgtccccgtctacaccttcagcttcggcgcgagccacgactccaacctgctggaagcgatcgcgcgcaagagccttggcgggacgttcaactacgtcgccgacagcgccaacctcacggggcccttctcccagctccttggcggcctcctcaccatcatcgcccaggacctcgagctcaccgtcacgcggttccatggcgaggtcaccatcaagagggtggtctgggtggacgcggggacctacccgcagaccaccgccagcgacggctcctccgtcacagtcagcttcggcaccctttacagcgcagaggcgcgcagggtcatcgtctacctcgcgcttgctgacaagaccgcctcccctccgtacgacgccaatgtctgcttggcacagtacagattcaccttccaggcccagcaggtgacctccaaccccgatctcatcaccataaaacgcagaccgagtgctgcaccaggcgcggcgaggaagccacagccggtggagaacgagctggcccggcggcagcacgccgacatgatcagggcagccagggacatggccgaggccaacaagatggaggacgcgcggaacaagctggaggaggcgcggaaggcactggaggagaatttcaaccaggcggcgaacccgacggtggccatgctcctggaggagctgcggcagctgcgggggctcatggagaggcagtacctctacaacaaggagggccgcccctacgccgcctcctcgctcgcctcccacgaccgccagcgcgtcgccaccaggggccaagccgacggcgtccggctctacaccacgccgcacatggacacctacctcaagcaggccgagcagttcgagaagaaccccgacgaggcgccgccgcccgccacgaagcacgtcccggagccggatcaggtggtcgatcaagagccgccggcgccgcccgccgaggccgacgtcgtcccggacgtgccgcgagacatggcggcgggggacaggaggacgctgtcggcggcgctgcgggtggcggcggcggtgctgagcctggcggcgttcgtgctcatggctagtgtccggacgtccgggtgggacagcgaccgctacgacctctacgaacagtactacaggttattgcatgatcacttgcctgttgcgtctaaacatcatgcattcttaacatgcaacaagtctagatgctagcaatactcccttgtatagttgtatgtagatttatctcaaaattaagtacttcctctatattatagcctgggatggaaacggtcaaaaatcaaccattgccataatcatattttttttctcggaaatgggataaaacatgataaaaattaaaattaaaattgtatccgaaatatcgggaaaattgaaaaatggaactgtacgaacgaaaacatgttataattgatcggaaactagtaataacgtcaaaaacattaatttgtaaaatcatatttttacaaattgtctctcttttagccttgcacccaagtttggaatttcattgagaaattgatggtactctaaaatttggattaaatagagacctcaatcatggtattgggtatttaaaatacagtaattgctatattataaaaaggataatttcctcaataataaggtaaaatttggaaatagcaaaatcttttccattttttatttatattttttactgttttaattttcatctatgttggttacgaccggtagaacttggaaatgagagtcggtaggtcaggagtttccttgaccaagcattgttagtaggttttgtaaatattctacaataaaagttagggggtgtttagatcccaccctaaaattttacgccgtgtcaaatcaaacgtttgaacacctgcatgaagtattaaatataggctaaaaaataactaattacacagattacgactaatttgcgagacgaatcttttaagactaattgctctatgatttgacaatgtggtgctatagtaaatatttgctaatgacggattaatttggcttaataaattcatctcgcggtttactaacggattgtgtaattagtttttttattggggcaattgcgcatttgaccctcttttgaaaactacctaccaatttgacccccttttttcaattttgcttatttgacccttattttcagaattaaagatacggtatgaccctattctgttaagggctactaacggtgttaactgaagcacaaaaggtcccttttgcccttactcatttgaccctattacatgtgggacccacctgtcagttctctcttctcctctcctctcttctctcttcttcttctgacgccgcctccttcattcctccgcgtcgcttcttccctccggcgccggctgccatcgccgccgcccctccctcccttcttcgcgcgccaacctccgcctccctccccgctgcgcgcgcagatgccgacgccaccgccaccgccaccacctccgcagacgccgatgccaccgagagccgccgccgccaggcccggctcccctccctcctttcgccggcaccggtctccgcctccctccccgcacgccgatgcagacgccgccgccgccaggcccggctcccctccctcctttcgccggcgccagcctccgcctccctctttgcgtgctgatacagacgccgccgccaccgccgccaggcccggcttccctccctcccttcgccggcgccggcctccacctccctccctatgcaccgatgcagatgccgccgccgccgtctccgtcgccaggcccggctcccctccctcccttcgtcgatgccggcctccgcctccctccttgcgcgccgatgcagacgccgccgccaccacctccaccgccaggcccggctcccctttctccccgcgctgcgcgccggcctccgcctccctccccactgcgcgcgacgctgccgacgccgccgctgcaactcgctggcaggagagagagacatggagagacatgtggatagggttagagatgggtatggttttctcaagggtattttgggcattataaattttaattatatttcgttcttttttttaaatcaaatcttaacggtgttaagaaaacagggtcagacggaaggttcgtttttgaaaagcagggtcaaataagcaaactaaaaaaaatagggtcaaattggtagttagacttcaaaacagggtcaaataagcaattgtcccttttttattagtctacgtttagtacttcaaatgtgtgtccatatatctgatgtgacacgctaaaactttttatccctagatctaaacacagccacccaaatgttttcctggccatcacattcattaatgactaaggtccagggagcagagagtcttcttcaacctctagatagaatagatgaagaagcagaagagcaagtagaagaactcatcgacaacttgttccggcgatggtgcaacaacagtgatggtccgaaatccagcaaacacaacggaatagatttatcagggttagaggttgatgtgtaagggtggtcaatggaggggcagctttagaggatgaccatggaaggcaaggcaccgctgcccttgaccacagtagagagagaagtagattggttaggagtcgaataacggtggatctagcggtgtgatccccaaaggaactagccagttcctagcttcactacaaagtgatcagcttctcctttttaatttaggtgaataactaatctaatcctttaagtttcaccaaaggtttaatttggttcttcaggttttattttatccacatagatcactttactattcacccttctcatttcatctattatcctttttagttaaaaatattctctcttctccgccaatgtactatgacaggtatgccctcggtgtgaatctgatagtctgcgtctactcgaccgcgcaagcagtggtcgaaatcgggcgcctcatttcgccgaggtttgctgcttctctgaacccgataacctactgcgtcagcctcttcctggatcaggcaagcccaatacacacaatacatcggttcttcatttttcttttgaaacatctatcaacccatcaattcttctgctcaaaatgcgccattgcaaagctacggccatatttatattcaaacttttttctacaaactttcaacttttccatcacatcaaatgttttgatacatgcatgaagtattaaatgtagatgaaaaaaaaatcaattacacagtttgcatgtaaatcgcgagacgaatcttttgagcttaattacgccatgatttgacaatgtggtgctatattaaacatttgctaatgacggattaattagacttaatagattcgtctcgcagtttacacatggaatctgtaattttttttttgagaattacacagtacaacgcagacactcacaacgcacgcgcactcacccccatgaacacacgcacgcaaaccctacccctatgagcataacccctatgaacacacgcacgcaaaccctacccctatgagcatcttcgaagactgggcttttttgagaattacacagtacaacgcagacactcacaacgcacgcgcactcacccctatgaacacacgcacgcaaaccctacccctatgagcatcttcgaagactgggccgacaaattctgaagagattgacgaagtcaccacagacgcctctctatcgacgggtacgtcgcctaccactgaaaccacaacgccgttaaatcctagaaaattcgctctgtaaccactaggctacaggccctttcgctctgtaatttattttattattagtctacgtttaatattttaaatgtgtgtccgtatactttaaaaaaaatttggcacacgaactaaacacaacatacgtgttggagaagcagaagtttttcagcgcacacgcgcgcgcggctaattggtttcatttggctgcaggtgttggcgtacctcctaatgtcagcctcgtcgacggccgcgttcggcaaggagccactcaacacaaaaatcaacaacgcagtttggctatcgttccttgggttccttgcgctggccgccagcgcgctcatctccatggacaatctcttccgccgcatgctctgattgaccaggccgtcgacaatctactcacatgcttctccgatcctcatgcaaacttttaattacatatatttgtgcaaataagtgggacgcgtatgagatatacgttgttcttgtcgtaaaaaaaaaacattctttcttttctaattaggagtacacattggggcatttgtagggtatatatgcagatgcccacgtcatgagggcatttgatacttcaggcgtctgtagaggatacacacgtatatgatggtgtgagtatggcatgtcttagttgtgggcccaattgcactctctctctctctctctctctttttttttttgaaaactcaattgcactctcttaaaagcacatttctagtttgtaaggctagagtggctatatatcatatatgtgtctcaaaggtattgtttgttgtaacttgtaacaattaaaatggctaattgtttcaggaaacatatgcgatcatttagcctcatctcatcgacgctctcctgatcctacataatatgcttccataaataacttatactattttgtatacaattttgttgcttctattttcataaatataatctctatatttttggcagacaactctatttatgaatcttaagaaccataatttagaccccaccatgatcaaatgatgcatacatacatacatacatacatacatatacatacatacatacatacatatatatatatacatacatatatatatatacatacatatatatatatatatatatatatatatatatatatatcattttcttcaatttataacttggtaataatttctagatctttagacgcacggtgaatgtgatg
